United States Patent 7,868,149 (PLANT GENOME SEQUENCE AND USES THEREOF) - sequence listing, part 75

SEQ ID NO: 40740 - DNA, 19801 bp, Oryza sativa
  unsure (1)..(19801): unsure at all n locations
cgcgagagagagagagggaaaaatggggggaaagggagaggggatcacggggagttattccccccactttattgcacgcggggacggcaggaggcggcaggatttgcagcggcggcggcgctagggcgcgggggaggcggcgggagcggcgggaggaaggggatgacgggtgggccccacccgtcagcgagggtggcgggcgggcccgcccgtcagcggcgcgcgcgcggggagaggccgagtgggcagcggggagaggagagagaggaggagggagatgggccgggccggcccaagggagggaagggggacttttagggtttttctttttataaaatcattttaactttgtttatttcttaataattattatttgtgctctgaaaattccactaaaatttatttacgcattttaggcttttaggaaatttacaaaaatcctctaagccttatttgacttttaactttgcacattttaattgttggaggctttcacatggattttaattattctaggcatcatttaagggatatattttagagtcgttttgggacgtgacaggggttttgttggcggttgttaaatgccattctcatacctccaacatctgcataaagtcgagacaataaaacatccaacatagtaataggtgcttaatctcacatattccacaagtgttggtgtatatttgtatgcagatgataaaccttgaagttgggaggaaaatcagactaaagtgaggagaattatgtatccatacaaggaggggttgtgaacttcattgaaacatcagtaaatgaacccaaaactccgagaaatggaaacaggaaggcccaggaagtccaccaaccgaaggccagaccaggagggcccaacccaggttcggccgaaccctagtgatcaggggcggagcccaataagctgagggggattcccaggaacccggcccaaacttggaaatcacttgttacccctatagtttcaccatgtaggaaccccctcagcccaaaccaaggaacccccttcttgtccagcccagaatggaaaaggcccaagtaggcaagcagcagacacaaacacaggcaggcccattcgatggagtcctttgcgctgctcgaggcttgccctggaagcctcacaatcatgggagtcacgacgcggtcaagcgggcattagcacaacacatcgtttcgtcttcaggataatcaagttcgctgtacgcgcctcctcgctctcgcaatctcgccggctgcctccgttccggcggcagcctgattcaaatcgccgacgccaattgacactgtgccccaagccccaaggtcaccgtgctcctgctgctcggcactcctgattttgccgctctgcccgtgatgactggttttagctagggcgagccgagcagcccgagcttctgccctttgaagtttaatcgttgcattgtgtgatcttgtctagttgtctaacagggatgatacattgttgcttgagttggagcctctgagctgttggacggcaacttggtgccgacgtttcatccaagattagctctccttggctctgggcctctggtctctcccaatccaccgacaacctccaattgagagcaagtgagatttcccctcacttctcaaccttatttcttcaatcttgaaaattttcatcttgtcttgaataggttttatacgatctactgatatgttttgtgaatagtgactttgtgtctgtgcttgacactttagtaacttcgtgtatatttattagttggtttctttgttaaggtacacaatttctaaatatttatgtattttcttgttgtatattgctatcaattagataatgatgtttacagttattagacacacgagtatttagtactccataatagtgttccaactagatatgcggctatatacaaaagaaagctgtaggaaccccccttgattttgctctggctccgcccctgctggtgatcgccgttgatcccaggttttggcatggacgtcccagatcacgccctgatggcggttgcggggcacttcggacatttccccttcgccaaccgtcatacctacccctatataaagacatcatctcactcacttcaacacacacttccaagcttgagctaaattataagaggctctattgtactatattgttgttaacgaccaaatttggtaatctaagtattggagatggagttgagaccgaggtggaaattaagatggaatcgctcgaggaatagagcagaatcggctgatgtccgaatcggctgcgactaggatcggcagagttcgagttggacagggttagccgattgagccgaatccgataatatgacacggcatacgttgtcgggttaggttgacgtgcttcatgatgatttccacgcatggatggagtcctgagaaggcaattgtatagtgcttcatgatgattgccacgcatggatggagtcctgagaaggcaattgtatttattaattaggatattttatgtaatttctttagagatatgtttgggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcaatctgtcagtagaagacagccgattaggttaaataccgatgttgacttagattatataggaaatccaccactctatgacacatccaacggcttgattgtctagatattgtcttttttttcatacttatagatgcatctgttgagtttgatcgtatgagtcgtgattagaatctcaatctctagcctgcctttggttgccaattagggtagcatcggggtttcagccgatcttatctgatttgaatatatttatcttatgtgcttgattgacatgttaaatccgccctttatgttaagatctcgtcgtatttaagtatattaagctttccgtttggtatattgtacttgctttaatatctcaatataaaacggtatcggagtattagccgatacatgctagatctatctgatcggctatgctatgaacatatataatcttgttgttaatatatatttcggtctaagtgatttatactgtctcgacatggcgaccaatctatcccaatcacttgatttaagtatatatcgacataaggattatatattgttaatatcaacagccgatcaagtagatttagttctttcttacttattaatgtctgccgatcgatgcatatatgacatcggctcaaagataaatgatatgtcatcggcatctagccgatcggctatcgtttatagatttaaccgcggtttctttgtctttgtctcttgttgatcgcaggatcaaatcaactggcacgctcacatacccaaaggcaagttttggacctgcactggagttaagcagatctcccagacctcgtgtttttacatcaacacgcttttggcacgcctggtgggaccattagaagtcagaaccgcaacagtattctctcatggctgagaaaccaccagcatcgccgtctttgcgccggcaaagaagtttcttccaaaactaggatcccgaagtttggtgggtctgaagttcatgagagcaacatcatgctcatcattttggacaaattgacacctgaacaaaagaaggatcttgaggcgatgatgtagcaaacacagaaccaattcttgaactcattcatggagactcgccaaggaacaattgttcagaggtacaagatgaaattagatgctgatgttgctgcgacaagttcttccaaggatggggaggtacaacaggtctcagatggtacggctcaatcaggtgataaaagtgctgcagatggctcaggtgataagggtgatggttctcagggagtgcaaggtgaggatcttagcccagatggcaacctggcgcagctacagtttaacaacttccaagatcggattgactatactgtgcgacatgctttgattaatcaatctggagtgttagtcaatactttgtcaaacatcgtgaagtcgatggttgatggctcaatagctgagtatcaggctacaggaccagtttatttaccaggaggtgttttcccaaattatcggcccttgatcacaaataatcagccgactgctcagccaattgctcccaatgcgccatcagttcaaccgacagcaccagtgtcggctcctgcacctgctgcaccatgatcagcaccagggcaattaattaatcctcggttgttggtgagagagcagccacagcatagtggacaaaatgtgaatcggctaactcaagagcaagttgcagctatgttcttaccaactcggcctactgctgacccagttcaacagcagtcgattcagcagacaccaccgaggcagcaagttgctcagccgattcaacagcaaggtttgctaaatgcatcggttgggtttaggacgcccgataatcagccaaggcagcacattgcaaatcaagttgttccagagcatttggttcataatgtgcaaccagatcgatcggtgataccacaagttattcccaaacatttggtgcacaatatacagccaaactttcagaattatcaagggggcaatttgaattatcagtatcagcctccatcgccgcaagttcagtatcagcaaggagggtcggctcagcctcggttcgctcctcagtacaaccagttcgagcctgtgccacagcaagtgcagggggtgcctcaacagagaccgtgggccaatatgattgcagatgtgatgagagagcaatttgggctcaagccaaaggacgctagaaacttgtatcggcatccaaaccctgagtggttcgagagggttccattgcctaaccggttcaaagttccagatttcacaaaattctcagggcaagatagtgtttcgacctatgagcacgttagccgattcttagctcagtgtggtgaagcatcggctgttgaggccttgagggttaggttgtttcctttgtctttgtctggatgtgcttttacttggttttcttctttgccatatggatcaatcaacagctgggccgatttggagaagcaattccatagttacttttatagcggggttcacgagatgaaattgtctgatttaacaacgattaggcagaggcatgatgagcctgtgcaggactacattcagaggagatgaggaataagtgttacagcttgagcttgactgatgcccagttaaccgatttggctttttagggtatgatagctccgatcagggagaaattctcatcccaggactttgatattttgtcacgtcttgcacagaaggtaaccttgcatgaacaaaggtttgcagaagcccggaagaactttaaaaaggttaatcatgtctgtccctacatggatccgatgatgatgatgatgatgattctgaggtagcagcagccgagtgggttaggagtaagaaggttataccatgccaatgggtgaagagttctagaaaagaagagaggtatgacttcgacatcaccaaggctgataagatctttgatttgttactttgggaaaaacagattcaacttcctgctggtcatacaattccatcggctgaggagctaggcaagaggaggtattgcaagtggcataattctgggtctcattctaccaatgatggcaaagtcttcagacagcagatccaggcggctattgaaggaggcaaaatcaagtttgatgattccaagaagccgatgaaggttgatggccatccttttcctgtcaatacggtacatacagctggtcgaacagccgatggggggaaaactcggggttttcaagtgaacttggctaagattatcaacaagtatcagagaaaatatgataagcagcaggaaaggtgttatgacgaagatgacggcggttttgacgaaggtatgaggctgtcgtctattgaagactgtcctaggtgcagcaatgttacagaaatttcaaaccgatcgcataatagaggcaatccgctaaggcaagcaagggttcctgttcatcaaagattgggcccaatgaaccaagattgtgaccaagaggacaatgaaggcagaaagactcaatggtgtccttctggtatttttacaaagaatcagaagagaagggttcagaggttgaggaacagggagcgctttcaggaggttgagcaagaaatcaaccatcggctgaagaaaacgaagccgaagcaggagtggcgcgttaagaatcaagttcctacagctgatgaagccatggccgatgaggcaaaaatattggctaaagggaaaactgttgtgattgcatcggttaacatggttttcacactacctgcagaatttggggccaagcaagccgatgttgatgaagttgaggaagcatcagctaggttggttttatcaccagaacaagcagtctttgagaagccagaagggacagagaatcggcatcttaagccattgtatgtaaacggttaaatcaatgggaagccgatgtctaagatgatggtcgatggtggggccgcagtgaatttgatgccttatgccacatttaggaagctaggcaggaatgctgagaacctcatcaagacaaacatggttctcaaagatttcggtggcaattcgtcacaaactaaaggggttttaaatgtggagctgacagtcggcagtaaaaccatccctacaatatttttttgtcatcgatggaaagggttcctacagcttgttgcttggaagggattggattcatgctaattgttgtattccttcaaccatgcatcaatgcttgattcaatggcaaggcaacaagattgaaattgtaccagccgacaggtcagttaacgttgccagtgttgattttgctctttgggagatggatggccttgattgctagtctggaaaggtttgggaaggagattttctaaaggtgttcgattatgatatacagccgattgaatacggagagcccaagttattatattgagggcatcgtggagggttcaaacgtctacaccaaggacacagtagatgatctcgatgacaagcaaggaccgggtttcatgtcggccgatgatttggaggaaattgatataggtccaggtgatcgaccaaggccgacatttatcagtaagaacttatctccagaatttagaaccaagttgatagagcttttaaaggaatacagagattgctttgcttgggagtattatgggatgctaggactcagccgatcgattgtcgaacatcggttacctatcaaaccaagggttagaccgcaccagcagcctccgagaagatgcaaagccgatatgctcgaacctgttaaggctgagattaaacgtttatatgatgctggttttattcgtccttgccgatatgctgagtgggtttctagcatagttcctgttatcaagataaacggcaaagtaagggtgtgcattgatttcaatgatttaaacaaggctaccccaaaagatgagtatctgttgatggtcgttattgaccaatttcaaccgtcaatattatccaatatatgaagactagctatgcttgcaatgcataattctcaaataaaatagttacttccactatatgctttgctactaacatgtatgcaggagaagcactcgtaaatgaagagaacgaggtggaaatatatcgatcaatcagtcaaaagtctgccaacgatctacaattacatgagaaggcccaaaagtccaatttaataatcacaaatgggcctagaatgtatgtcactgatttaggggcccacatggaagtctccttgaggaagctaagggccagaagagcccatagggggttggccgaccccttgttgagcccaatccagtcacattttggcctggagataagggaggccaaggaggaagcagcaggccaaaaactaggcctgttgggccactctagggttcggctgaacctagtaccttgatctcagccgttggctctcccctttggcatggacgctccggatgaactcctgatggcggttgcggagcatttccgacaattcccatgctctacaaccgtcattgggtgctataaaaggacctcacctccttcactttcaatacacactcaagcaaggatcaaagctctctacaaagttagtagtagtgttagtggagtagagttagaatagttccaagtccgcggaggcttcggggagttcggtaaaggttctatagcttttcctttcttctttgtaagacttccatttatcaatataatattcttatttatacaagttcggtactttattccaatcatagactatgagtaccagtcttagtttattcataagtagtataatctgtgtagttaaaccttctgggatttgcattgatgctggtataatgtctgattacctggtcataagtctgctctggctaggctgagagctatggcccggggactcagctgctctgcaccgattgaatggttgtagagtaataagtagtaatttaagcatggagcttaggttacctcttatcattatttgggggtatattctctgggtgatttgcaggccgctgatggtgacagctcagtacgggtgtctcccctgcagtttatattcctacatacaatttcctagggttggatacacctccgaatcctacatcggttggagggttatgacaggttgtcgtaagaaactcggcaacccggggtaactttgcttttcatcgggagggcatagctatgctgcattgttaaaggggttatattacatagtgtacaggaatagaacatatctaacctactgccacttagctataattaggagatgtaggagttagctaaatccttagctgtgtgtcattctacccttaagctaaacatacccctgcatagacccttgatgtatacaagtaatatataaactattagcatagtactctcttaccatatcttcccttgggattaaacaaatacgatacctaggaatactcccgggtgaaatggtacaatggtatatctgtgcgattccggatcacatctgtaaccataatataccatgagtatttctagtgctattgctgggaattatatttccagtagtgtcgctaagaaataccaacaagcatttctggcgccgttgccggggaagataaatgattaagagtttactacttgctaatagttttatatttacctctgtataagtcattgtccttcgtaggcaaaccttgtttgttttctcttttatgtgaaaacaaggtagtacaggactagttctgatctgccgaccaatttcaaatctggagtcactagtgaagtgaagccgaccccgtgtcgtttatccttaaggttactctatcggcaaccagaccagccaattccgcgccaccagaattacacgatacggctgagaagtccctttgcaagttcgctgctcgctctgctggtaacatactagttggaacccaagtcagcaggggagatggtgactttgatttaaagaccagctaaattaacgatggcgcaggcttgcccgttctgtggcaagcctaaggaggatgcaagtgctcatttgcagcaatttgtggaaagccatagcacgtataccgtcagaagaatcagactccaactgttgccgttctccctcctcgagagagcagaacagtggttctacatcaaccgtgcaacggtgaataccgaaacaattgctcaacagcattcctctcaagattcttcctgatgggcaagaccaacgctcttcgcggaagaatatctagctttcagcagacgagggatgaaaccattcttgaagattgggaaaggctgcaggaatacgtcaccacccgtcctcatcatgggatggccgagtggctcatcctgcagaatttcttcaaatgattaaccccctcgtcctaggatcacctggatgctgctgctggagggacattcttctcaagaatagtcagatgccaaccaattgagaagatggtctcaaatatgggttggagcgaggaacgactccaaacccgtcaatgcggcatgtacaccgtcaagaggacggagatgctcgccgcccagttggatctccttatgaagagactagacaacaatgagaaggataacaagcagggtaccgttaaagccctggacttccacacgacatgtgaggtctatggcaacaccggtcactctgggatggattgcccgaaaacccatgagaacgttatgctcatgaacaataacaatgggtatcgtccacgaggagaccaaggatggagcatttctccatggggtagatcaagaatggaccaaacacaaggaggtcaaagtaaaaccccgaaggacggatagcctcaatactttcatgatgaacttcctggagcaggaagaaacgagtaaccgtcaataccttaagccggcatccaagaagccgggaatacaggccggtcaacctgtgttcccagttacgaagaggccgctgcccgcacctaaggcaaagaaggtgtggcgggttaaggagaagacactcgttcctgtacctccggaactgggtgcctcattgagctaaatacgtcggaggtatggtcgtgctcgtcggacctaaaacgacatcccccttgccaacaggtaaattggtagttatctcatatttattttccattgcatcaaagcatgtttggattttcaaacacacattgagatctgaatttgaggcaaattcttcaaataaatttttgtgagcaaaataaaataaagtttttagaaaacttttgcacagccaccaccacattggtcgttggaatccaatagctaaaggtggggctggttgggtccaccaagggttcggccgaatccctggttcggccgaaccggcctggcaccggctggctggaaatttttgcagggtagcggctagtggggcccacatgccattcctagccgttatccatgcactatatatgtagctcggctgggagaaggaagtcacaccaccttaactcattttcactccctctcaaaaccttgctctaaaaatttattcaaagttttgcaagctcgcctcaaattcacacaatttgctgcatttagtttagacacttgcatatacaagtttgctttagtttggtgcaaggttatcggcgggtatttgcttaacccccgtccgagtagtcttgtattcttgctctttgctgtagccataaagaaacgacttttgggcatattcaagagacgatcaagctcacggacaagccgacacgataagccgagtacaccttcttccgcggatgcatccatgaaggaggcgtacattccaccgaggctgtacaacaactcctttcacgacctcgtgggcgaccgggaaatgcaagcctatcatatgctgaaagaccgaacctgtgctcggacctgagcatacgactcgaccttctgaaaaggataggtatagatgctgagcttcattactttttggcgtgctataggttgggataaatttcatgtgtagacgagccgggttcctggcgggcgccgaaaaggaagcagtgacgccttttcgacgaaagcttagcttggtaggcgctgcttactcaccctattcccttagacaatgcaatgctgtgaacacgaaagtttgcagttcagccctcttctcccatgcagagtcgcaggcagcgcctcggataaaagcatggacgagccacatgcagggaaacttgcacgtgtggttctggccggggaccccggtatactgtactaatatgtgtaggtccctgtaattcgagtgagattgtcatggcgcaaaagcagatatggtccggtattcccttgttccccgtattggttatgttctttattccttgtctagcagaaactaatcgagctccgtctgatctcccagaagcggaagctgaatcagttgctggctataatgtggaatatgcacgggatgcgatccttaatagttcaagtcccatagagttattttttatctttgattcccaaacgctgcgtgcaagtcaagcttacagaattcctgccggggcgccttctttcttatgccagccaagtagtaatcagaaaaccaatcaatcttccttacactacgacaattcacttgaactaccaacatcatgagtgacccaggccggccgtatatgcgtcatttctcttcatcattgtctctatttgttaattgctcgctacccgtagtgggccttgagtaggatttaagcacgggtttcgaaccgtgcagtttttatgtgccatgctagaggtaggcgatggtgttactttccggttattccgcaaggaatatcaccttttttggaaggaccttagcttgcatctaggctttgacaaaacatgcaaaattaatttcaggaacgcatttcctgattttaacaagcgtatgttttggcaaagtatttcgggtctctcatcctatagaaagcctagaactaatgacatccataatcctaccttgaggctgttgcataagttgcttggtttcacatcgtttcttagagctgatatccagatagcgcgaactagtcctcttgtatgccatggttagaaaaaaaatcaacgtttcacccattcaacccatgatcaagcaatggttagaaaatgtgaagttgtctggtcctgttgagtgtatttctttggtgactcgtttagcatgaagagttgggactatgcttaatatgcaagtatctagtattcttgttaccggctcttatgttgatgaggcctatctggttcaaggccacgcactcaaacatggtccaaatgattttgtttcccggctatacaaatgaaattccgttacctaacccggagtttcatttgtataactgccgagaactaaccatttctctccaagcggagttgcctcgtgatgtcccacgcaggataacacggcgtatggggagaaaagcaccccaagaggcgtcttcctcttcaccaccagtgcagatgtatggagacagttgggacccgaccgcgcatgcccttggttggacccaattccggcaacatgacggcggaggttcgtcctggcagagtgccagcgacagccggtggcatgagccgtaggagctgcactggggatactcgcgctccttcagttcaagtggtctacctccatcctcttggatgcattgctcagtctcctctcgaagggatttgggagaactcatccgggggacggatacacttgaactgcaggcaaggaacatgcaacataccttggaggatgatgtggtacagtcatgggaatggcagcagtctgttggtgcacagctcgcaaatttcaacactatgatgcaacaatagcaagctgactggcaagcgtttcaccgctaccagggatttgatccccgccatgagccatagcaagaagcaagcttgggggggatgnntntccnggccgccgagtaacggcagtcctatcacattgcatatttccttttcaacttgcatgtttaaattgttttattgcatttataaatctgaaaacaacataaaaattgcaaaactaaaaataccaaaaagataggttagatttcatatgctaggtaagacatgcttagttcttcatgtcgaaatgatgaatagttactctgttttatatctctcatatatgggttcatggttaagtactctctcaagaattgaataagagtagccaacaattatccgggaacctgaggtaagtgagttgcactttgctgatctgagtctaggttgttgtgagatatgagatagtaaataagagttgctatgaacctattctaagtttgacttgaattccggatgttttattttccaaaatgataaatttgaaagttcctcatttgatataaattcctaccagagccaaaaatatccatattgattaagccatatacattttggttacttgtaattctattgaactttgtcaaatctttgtgacttgtgtagatactattcatgctctatgaacgagatcatacacccacatatgcacacatatgctaagcttctacactagaagatagcatccatatcatccaccatatccatgttatcattatccacaaataagctctccatccatgcttcctttccaaagaaaaatcctttgcaaaaaaaataaaatttaaaaaaaaagagggaaaggtatggctatgagaaaaataataaattcttgctctcccaaaattggagcatgaaagaaaaaaaaagagagaaaaaaaaagagaaaaagtagccataccctctctatgaaaattaaaggatattttggaggaaaagcataagcacaaagaagaagcattttctgtatccacattttattttctatcatgttttccaccatattattcgcacacactttgcacgatcttgatcttgagtatgattagtcatctattttagtccaagtttttgatttagtaataaatgtgaatacaagtgtgccatgttttatccctaccaagctccacatatcaaaccttagagtaggaatcaaaaggcaaatctggtgaggaatccatattcatacactttgagtgatctagagaattatttgaggaacttggctttcttttgcaaaaatcattttaaaacttccggaatgaaagttaaataaagattgggtaactagcgctctaattactgttctgtctctcaaccgctcaagacaaggagatgcagtgtttcgtgggaatcaggggtaagggtaagccaccatgccaaacatatttaatttgagatagagtacccataccttgcatctatatctttgagatatacaacattgcagcaactcctgatcaacaaccaagtctttgttcctttcgtcctttactcgggacgagcaaaggttcaagcttggggggttttgttgacggctgttatcgaccaatttcaaccgtcaatattatccaatatatgaagactagctatgcttgaaatgcataattctcaaataaaatagttacttcaactatatgctttgctactaacatgtatgcaggagaagcactcttaaatgaagagaaggaggtggaaatatatcgatcaatcaatcgaaagtctgccagcgatctacaattacatgagaaggcccaaaagtccaatttaataatcacaaatgggcctagaatgtatgtcactgatttaggggcccacatggaagtctccaggaggaagctgagggccagaagagcccatagggggtccgccgaccctttgttgagcccaatccagtcacattttggccaagagataagggagaccgaggaggtagcagcaggccaaaaaccaggcctattgggccactctagggttcggccgaaccactaggttcgcccgaaccttgatctcagccgttggctctcccctttggtgtagacgctccggatgaactccggatggcggttgcagggcatttccgacaattcccatgctctacaaccgtcattgggtgctataaaaggacctcacctccttcactttcaatacacactcaagcaaggatcaaagctctctacaaagttagtagtagtgttagtggagtagagttagaatagttccaagtccgcggaggcttcggggagttcggtaaaggttctataccttttcctttcttctttgtaagacttccatttatcaatataatattcttctttatacaagttcggtactttattccaatcatagagtatgagtaccagtcttagtttattcataagtagtataatctgtgtagttaaaccttctgggatttgcattgatgttggtataatgtctgattacctggtcataagtctactctggctaggccgagagctatggcccgaggactatggtgctctgcaccgattgcaaggttgtagagtaataagtagtaatttaagcatggagcttaggttaccgcttatcattatttgggggtatattctctgggtgatttgcaggccgctgatggtgacagctcagtacgggtgtctcccctgcagtttatattcctacataaaatttcctagggttggatacacctccgtatcctacatcggttggagggttatgacaggttgtcgtaagaaactcggcaacccggggtaactttgctatgcatcgggagggcatagctatgcctaagcatagctatgctgcattgttaaaggggttatattacatagtgtatactagttagaatatactaagatgttgtatacttgaagtacaggaatagaacatatctaacctactgccacttagctataattaggagatgtaggagttagctaaatccttagctgtgtgtcattctacccttaagctaaacttacccctgcatagaccttgatgtatacaagtaatatataaactattagcgtagtactctcttaccatatcttcccttgggattaaacaaatacgataccttggaatactcccgggtgaaatactacaatggtatatccatgcgcttgcggatcacatctgtaaccataatataccatgagtatttctagtgctattgctaggaattatatttccagtagtgtcgttaagaaataccaacaatatccaatgctagtagcctatcagctgattgatgctgcttcggggcagaagatattgagttttatggatggaaatgcaggatacaatcaaatctctatggccgaagaagatatccataagaccgcttttaggtgtcctggtgcaatcggcttatttgagtgggttgtaatgacttttggcttaaagagtgctggagctacatatcaaagagccatgaattatatataccatgatcttatcggctggttggttgaggtctatattgatgatgtggttgttaagtctaaggaaatagaggaccacatagctgatttaaggaaggtttttgagagaactaggaagtatggtttgaagatgaatccgacaaaatgtgctttcggtgtatcagctggccagtttttgggatttcttgttcatgagagggggattgagataactcagaggagtgttaatgcgatcaagaagattcaacctccagagaataagacggaattgcaggagatgatcggcaagataaattttgttagaagatttatctctaatttgtctgggagattagagccttttacgccattattgagattgaaagccgatcaaatgtttacttggggggcagagcagtagaaggctttagatagtattaaggaatatcttagctcttctccaattttgattcctccacagaaggggataccttttaggttatatctatcagccggtgagaagtcaatcggctcggttttgattcaggagcttgaaggaaaagaaagggttgtgttctatttaagtcgtcggctcttggatgcagaaacaagatattctcctgtggagaagttgtgcttgtgcttgtatttttcctgtacaaggttaaggcattatctactgtccaatgaatgtactgtaatatgcaaagccgatgtggttaagtacatgttatcggctccgattttaaaagggagggttggaaagtggatattttccttaacggaatttgatcttcggtacgagtcgccgaaggcgattaaggggcaggctatagccgattttattgttgatcatcgtgataattcaatcggctcggttgagattatgccctggactttgtttttcgatggatcggtgtgcactcatggttgtggtatcggcttggttataatttcccctcggggggcaagttttgagtttgcttatactattaaactatgcaactaacaatcaggctgagtatgaagcggttctcaaagggttgcaattactcaaggaagttgaagccgatgctgtggagattatgggtgattctttgctggtgatcagtcaattggcaggagagtatgagtgcaaaaatgatacattgattgtttataatgaaaaatgtcgagaattgatgaaagaattttggctggtgactttgaagcatgtatctcgaaaacagaatgttgaagctatgatttggcccaaggggcatcgggttacaagccgatgatgaaggatgtcaaaatagaaattgccactataacaaccgatgattggaggtatgatgtgcatcattatctgcaagatccatcccaatcggcttctcagaaattgcgatataaggctttgaagtataccttgttggatgatgagctatattatcagacgattgatggggtgttgctctgaagtttgagtgccgatcaagctaaggtcgcaattggtgaggtacatgaaggaatttgtggcactcatcaatcggctcataagatgaagtggttgcttcggcgagcgggatatttttggccgacaatgctagaggattgtttcaagtattacaaaggatgtcaggattgtcaaaaatttggagcaattcaaagagcgccagcatcggctatgaatcctatcatcaaaccatggccatttagaggttggggaattgatatgatccgtatgattaatcctccatcgagcaagggacacaagtttatattggtggcaaccgattattttaccaagtgggtagatgcgattcctttgaagaaagttgattttggagatgctgtacaatttgttcaagagcgtataatctatcgatttggtattcctcaaaccattacaaccgatcaaggatcaatcttcgtgtccaatgagtttgttcagtttgccgataacatgggtatcaaattgttgaattcttcaccatattatgcacaagctaatgggcaagccgaggcatctaacaagagtttgatcaaattgattaagagaatgatgatctcacatgtgccttgtgcaacacacatcaaagagagactaggcttcatctcttttttacatgtcccttcagtgtggcttgttggcagcagatgggcatttcctggaattgtaatctggagtttttccaaatgcttgtcttggcgagaattagatttgctcgaaagggtttccttgaagtttttttcatggcagcatggcatatttggaagcaaaggaatggattaatctttcaatctgtccagccatcaattcagtcatggaaagctatgtttgttaaagaagttcatctgcatatgtgtagaatgaaagatcctctcaagcaatccatttctgattggatacaaactttgtagcatttttgttttgcttttccctctgtaactttgtacatatctttattttataatatttaaactgctgggcaaagccctggcatactcgattaagagaaagatgattaagagaaagatttctgattatcctcggcagtggcatactcgattggccgaagcattgtggtcctatcggatggcttgtcatggttcgatccaagtctctccttataagtttgttcatggacatgaggctgttttaccatgggaagttagaatcggcataagaagaacggagttgcaaaatgatttgacagccaatgagtattataatctcatggctgatgaaagggaagacttggttcaatcaagattgag

SEQ ID NO: 40741 - DNA, 5643 bp, Oryza sativa
tagggactcaagataacaaattcggcaagtggtcgctgaattgggaaggaccgtttcaaatctataaagttgtgtctaagggagcttacatgttgcaaagacttgatggagaagtttatggaggagcactcaatggaaaatattttaagaaatattaccccaagtgtttgggttaatgcatgatcggctggtgttgccgatacatgatagctgatgtatttacatcgccttgagatggccgatattgttgtatcgcgcttagttattttttctattgtaatcggttgtgttttgccgatgtacaatggccaatattgttatatcgcccttagttcaatttataattttatcaatgcctttgacattgtaaaattatggggggcacatatatgcaaagttgaaaaatttttgagcaaaaacgaggagttatattaatcggcacaaaggattattaagacaagttaaataatgtaccagaatgtcttagccgattacaaaatctactatatcctattacagaatgtcactgagacaagtggcgctggatagccgatatagctctctgcctaatttgttctacttcttcaatggcctgggcgtcttgagcatcggttccagagatgacttttaaggacttggtcatgtcagcgacatttttgatggccgatttcaaccttgccttctgttcttcgacagcttgcgggagatcgggtagcttattgtgttccaaatccagttcggcgttgcactcttgaagttgtgccaagagctcaatcttacgagcttcaagccgatcaatattggatttgatcaggccctcggatagttgatcaagcttagccttttcttcatgaacaagctgccgattggcctggattgtagcttcaatatccctacgctcccagcgttcggttaatctcagtttggatttctccagtttgaattgatgttgttcaagataagcagctggagtgaggatgtcggctagttcttccgggatcagagcctgaacttcgtgtagccgagtcctaattgatccacaatctaccaccaagctgtctagagatgatgcctctaacgaatgagagatatcttcaagagtcttcctcacatcattggataagggagctaaagctttgcttgtggtgtcatcttctgtctcatcaaagtaatccttgatatcaaaagagaacagatcggctaagacctgcaaaaataattcaaagagacttagatgccaaatagacatggccgatctaagtccttgtgtcaaagggaaacttactgggatggcagaagcggctggttgtacttcttccttgacatggtgactccctgcagccgatggaatttggtcacttgatgattgctgtacaggggaagaaggaggaggaggaggctgcaaaaagagataagtgctagataagatcggctatgattgactagtgaaagaattgagaatatcttactggtggagccaatttgagagttgttgctgctgatttcttcttcacagcagttttcttcttctgcaattataaaatctataagcaatcggctataaatgaaatggttgcaaaaagaaatcaaggagagttgtttaccctggaaaaatgagctggagcggaaggagccggagtagtttgtttaggtgaagccaatggttttctttcagtatcgcttactctagctgcagcttgatcaacatcttctccaatctcttcttcatccagagcttgttcaatggatggatctagggcaggcaagtcatcggttggcttggtcttcttcgacttagctttcttctttggggctggagccgatgggtctatagtcgatgctctggtttttctctttttgccggcatcggttggttctctaatgagcccttggagaagacttgaagtcttgggggcatgatagccgatgacagggggagatggtccaccttcattgggaatgagacttggagcatattcgatgtatttgccactattgctcttgtgagggggagaggattctgttgtctgcaaaatagaagagaagattagtcaagttatgaatcggctgacaattgttcaaatagaattaatgaagtcaaggtgtacctaggggataacattggaaaagagatctgtcatgtacatagaagccgattgatggaacagatgcatcttccattcaccccaccatctgtcaaatgccccgctcctgaaggttgccagctctatattttcaatgctgcccaaaggaggtccttgaagattgagcaaccgatccatcattagggttgatgaaatttctcctcggcattggattttatcggcaaagaacaggccgattggtaattgacccatatcaaactgtctggcagaactcatcggatgataaaattcataacaaacttggatatttcttccttgatgaatgccgataggaaggatgcatgggctgattgcagccgagaagacttctctggacttttggtatctctcgtggttgatgtcttcaaatctaaagtctgatgggagctctagaagtggtgagtcctcataggggagggggggggggagggtgtttttgaaagccctcataaaagctgcagaaccaatctttgagcagctcagccgataactttgctccaacatcggctggtgtggatgcatattccccataagacatacatctgcgatgggtgcgttcttctccatcgtcttctataattggctctagtcttgggaattcggcttctgtcacagatggccgattgacaaatttcataaccatcagatttagccaagtctgcaatagccaccatggtccacctgttccaactactaagccgacagctattttggccgatgctttatttaacacttggtataggtagccgagaagaattttgcctaagggaaattgtttctttgattctagggcttcggctacaaattgccagttggttgtaggaccacaactggatccacagaaaaggaacttttctagccacatcagcaagaaagccacatgttcccgaggagtgacaggccctttgcccatgtatgccgctacatagccctacatagccagaccaaccacctatgcttttggtcctgaaatcaaattggttcttggtgttcatactcatagggttagctgatgaagttacgtctaatccggtaatcatggtgatgtcaatcaaagttggagtcatcggcccttggttgaacaggaaagcgttgatggtattggactagaaataggtggcggcggccattaaaggttcatctttagctgaattggctatggtaagggcaagcacttggccgattccgatttcgtcccagtgaactttcttgctagccgacatgcgcttgtaccatatagtccagctcttctcgggtgaagttttctcgagagatggccaagatttgaaggtattcttccagtgtcctagatctgggttggctaatctgaaaggaatcgtattggtttcaccgatgatgaacttagtaggatcaaggttgccgactgggccgagaaagtaatggttcttgtgagataggctcggaactgcgatcagattggaaagatgctacgaatccaaaagaacagggaagaagaaaacaaaagataaggaaagggaaaactaatctgatgcgaaaaaagaggatctagccgatgagaacttacctccacgtattcggctgatgatgtggcagacgggctagtggaggtcgacatcgctacaggcgaaaagttggccggacaagaaatcgcctgggaatcgccttgcgcaccgaggggatcgctggagaaagagaggacgaagtttggcttaagcggtgaaaacagaagtcacggtgtgaagattctcggggatgacggttagtatttaaagcactgtgtagatttctctcggaaaacggcaagtgcggatttctctcagagtcgacatgtagcaaatccgaaacattttccaatattccggacttggggggcatgtgttaacgaccaaatttggtaatctaagtattggagttggagttgagaccgaggtggaatttaagatggaatcgctcggggaacagagtagaatcggctgaagtccgaaacggcagcgactaggatcggcagagttcgagtcggacagggttagccgattgagccgaatccaacaatatgacacggcatacgttgtcgggttaggttgacgtgcttcatgatgattgccacgcgtggatggagtcctgagaaggcaattgtatctattaattaggatattttatgtaatttccttagagatatgtttaggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttcgggttgagctgcatcggtttcgatcttcaacaagaggtaaaacttgttatggcggcttgcattctcgggattagtgcttccatctttatgatactctaatcttgtttatgtgataaatcgaattatcatatatcttatataatctccggcaatatcgctatctaacctacaatcggctaacatcgatctgtcagtagaagacagccgactaggttaaataccgatgttgacttagattatataggatatccaccactctatgacacatccaacggcttaattgtctagatattgtcttttttttcatacttatagctgcatcagttggatttgatcttatgagtcgtgattagaatctcaatctctagcctgcctttggttgccaattagggtagcatcggggtttcagccgatcttacctgatttgaatatatttatcttatgtgcttgattgacatgttaaatccgccctttatgttaagatctcgtcgtatttaagtatattaagctttctgtttggtatattctacttgctttaatatctcaatataaaacggtatcggagtattagccgatacatgctagatctatctgatcggctatgctatgaacatatataatcttgttgttaatatatatttcggtctaagtgatttatactgtctcggcatggcgaccaatttatcccaatcacttgatttaagtatatatcgacataaggattatatattgttaatatcaacagctgatcaagtagatttagttctttcttacttattaatgtctgccgatcgatgcatatatgacatcggctcaaagatcaatgatatgtcatcggcatctagccgatcggctatcgtttatagatttaaccgcggtttctttgtctttgtctcttgttgattgcaggatcaaatcaactggcatgctcacacacccaaaggcaagttttggacctgcactggagttaagcagatctcccaggcctcatgtttttacatcaacaattctatactagaataggaagagagtagagtagaagaagttggaagaattccggagttgtcggtaatcttctcctatttcttttattctgtttattactctgaattcaatataatattcttcttgagta

SEQ ID NO: 40742 - DNA, 2735 bp, Oryza sativa
taaagtagatattaattgcttagacgtggtgtttaggtaattattatccagtaattgatgcgtgtcccacagtacgttgaggtaggtgtagaggtggtgacagccctcgagatcacttaagtccttcctgtccgggtacgtagtagagcgacatctgggaacagcgggttgccagtgcctgaagtattgtgttaggattaaagttaagctttccctagacactaattctcactagtaaatcctctctatccaagcctatcctttgcttggtgtccatggatgaaccggaggaagatctgaccatacacgttcccttggattcgatacccttgtaatactccataggggaagtgctacattggtatatccgtgcgcttgcgcattttatctgtaatcgtattaaataccaacagtggtcgaagtggagccacccaagacagacagcctggtgaaattcatgcaaattttcctggagaaggaaacatcgatgcccaggaaccgttattggaagacgccggtaaaaccacccatatcgccaagaagttagagcagccggctcagaagaagccgccgtccgcaccaaagccaaggaaggtgtggagggaaaagccaaagacgcccgctccatcacctccagagacgggtggaaaatctacgaactgaatcagaaggaggtacggtcttgcacgtcggactttaaatgacgcgaccttcgccaacaggtaaattggtatgtatctacatttttgctttcaacaatttggatttttgcatcagcacatggttgaatttcaaagttgcatttaggatttttgaattttgaggaaattcttccaatgaatttttcagagcaaaccaaaataaaacttccaacaaaaattcgcagtgccacgactacactgaccgttggaatccaacggtcgaaagtggggccgattgggcccaccaggggttcggccgaacacctggttcggccgaaccggccaggcaacggtcggctgcctccctctttgaggcaatggctagtgggccccacaggtcggttttgaccgttgtgggtgcactacttaagccaaccggccgggagagggaactccaccccatttcaacaaattttcattccctctccaaagtttgctctcaagttcattcaagctttgatagtttccctcaaattcaaatacttagttgcatatatacaagctgctttggtgaaactaatcggcgggtgaaattttttttattcctaacccccgccgagttagtccgttcttgctccattgtgcagaatgaggaggcgattgtctcgtctgttcaaggggtccagctcttcatcaagtcatcatgatgagtctagtactcgttcattagctaatgtctcgatggaagacgccgaagctccgcgatgactcctaaacgacaccgaccttgaccttgtcagtgatcgggaaagacaagcctactacatgttgagcgaccgggagtatgctcacacacgagaatactctccggagctgctaaaaaagataggtatggatgttgaatttcgttctatttggaaagtggttggttggcaaagatttgctgtggtagatgagcctggttctcgtttgcttactttgcaatttctgtgcactttgaaagaaatagaagatggaatttcctttcgctttttccataaggagtacacacttacatagaaaggcttaagtacacttcttggttttcacgattcctgtaaaatatatcttcagaaaggaatttctgggttcgagaaaaataggttttgggaagatatttctggtgctccaatttgcaagaaacctatgacgaatgatatccataatcctacacttaggctcatgcataaatggattgctatgactttgtttcctagaggtgatcttagacccattaggagggatgaattgattatcatgtttgccatggttagaaagatcaaaattgctcctgtgaaatgtatgataaggcaatggttagaaagtataaagttctctgctcctgttgagttcacttctcttattactcgaatagcaaaagggctaagggtcgttagcgactaaattgcttttatctcagccgctcgtccgtgtattgatgagacctatctagtgcaagggcatattctgaagcatggagtagatggatctttgatttactttttccccggttgtacaaatgaaatcccgttgccaaatgcggggtatcatttgtacaactgccatgaactaaccatttccctgcaaaccatagaagaatttcgtgtaggtggagcatacagggagacgcgcaacatgacaaggaatgaacgagagagttcatcatcctcaacacccgtacagatgtatgaagcaggttgggcaccagctggggatgcacccggatggacccaagctctacgccacagcatcggagtcttaacctgggcgagtgccagtgaggaccggtggcgtgcgcctcatgacatccaatggggggacaaccaaccttccagatcaagtggtgtgcctccattccttgatatgcagatgggggagatccagtacaacctcatggaacacatagctcaaacgcaagaatggcaacaatctgctgatgctcagttcgccaacttcaacaacatgatgctgcaacagcacgatgaccttcaagcgtacttccgttttcaggggttcaatccttatcaaggatcctgagcgaaagcaagcttgggg

SEQ ID NO: 40743 - DNA, 3016 bp, Oryza sativa
ccccccccccactgaggtaacttgtatcacattgcatatttccctttccaattgcatatttgctttccaattgcatcttataaaacttgaaaacaacataaaaatttgcaaaatagaaaatatcaaaaaaaaaggataggtttgagtcatgctaggtaagacaagctagttctctttgttgaaatgatgaatagttgctctgttttatatctcttatatatgggttcataggtaagtattctatcaaaggttaaatatgagtagccaacaattatccgggaacctaaggtaaatgggctgcacttgctgatctaagtctaagttattgcgagatatgagatagtaaataagaattgctatgatcctgatactagtttgacttgaattccggatgtttgtttttcaaaatgataaattgagagttcctcatttgatataaattcctaccaaagccaaaaatgtgctatcatgattaaaccatataaattttggttgcttgtcattccattgaactttgtcaaactcttgtaacttgtgtagatacttctcatgctctatgatcaagatcatacacccacatatatgcacatgctaaactcctacactgggagctaagcaatattccatattaccaccaaaaataaattctccatactttcatgtgctttcttctcctaaaaatgaaaatccttttgaaaaaaaaagagaaggagggaaaggcatggttgtgaaaaaataataataataaagttatgctccatcaagcatgagcatgatgttgaaaaaaaactgtagccatgccctctcctaatcaataaaagaaggatttttgggagaagaaagtaagcacaaaggagaagcatttttctttatttttcctcatgtaccactttcatcatacaccacacacacattttgcacgatcttgatcttgagtatgtttagttatctgctttagtctaagtttttgctttagtaataaatgtgaatgcaagtatgccatgtttgatccctaccaagctccacatatcaaaccttagagtaggaataaaaaaggaaaaactggtgaggaattcaaattgatacacttggagagaccgagtgaatcatttgaggaacttggttttctttttcaaaatcatttgaaaacttctggaataagagttgaatgaagattggatgattggtgctctaattgttgttctgtctttcaactgcccaaggcaaggagaagcagtgtctcgtggtaatcaggagtaagggtaagtcaccgtgtcaaagattatttaatctgagagagattacatataccctgcacctgtatctttgagatatgcagcatagtagcaactcctgatcaacaaccaagtctttgtttccttctgtccttcacttggaacgagcaaaggttcaagctttgggggttttgttgacggtcgttatcgatcagtttcgaccgtcaatattactaaaatagagaagaactagtgatacttgcaatgcatatatctgttagaataataatattccactagtattaggtatactaaccttttgcagagaatgacaataaagtggaggagaattgtcacgtcctgataaattcatcccgaaataaaaatcattccctaaaaggaataatagaattaattaaaattcaaaaagaaattggcaaacactaaaatacgtacaagaaaaattcgaatatggcccggagaatttttgttaaattctccttggtctaaaaggagccctcaaattttacttgaattttcagagcaccggaaataattattaagcaacaacaacatttatcaaagtttactaaaaagaaaaagctaaaaataaaccctccttcctcctttgggctgagcccagcccaaagtccttccctcctccctctctttttccatccctctctctctcttgggcctccccttccccttccggcccactccatactctcctcctccttctgggccgaccctcccctccctccttcccctcagcccagctccctcctcctccctctccctcccgggctgcctctccctcctctcctcctgggccgcctccgggcccaagccaagcggcgccctcctgcccgtgccacgcacgtgcgtgcgctgacggcgcgcccgcatgggtcccacgcgccgggtcgttgtcctcctcccgcccgacctcctctttctctcccggaaacctagcgccattcctccccaaaatccacgcgattcaaaccgggaattccaaaattgattagggggaattaatcccctttccttcctattcaattccccccaatttcccccttgattcgtgccctctaacgcccggaacagccgcgccattcccggccgccttccatggccaccggccacgaattccgccgccgttccccgcctctcccgtggccggctccctcccctcacctataaactggaaccccctcgctccgttctctcgttttagccttctcccgcacctccccgtgtgatatgaccatggctactacggatacatccgttgctcacatcatggatgaacaacaagatatcaagttcgagtcctccaagtgccggaatccgattcggccacctgctacactgctgacttcaaacggccgccgaatctgcatacgacctccgtttttggcccgtgaatacttgatggaaagctctcggagcgctctttccaacggatccagcctcatctccgaattccatctcgtgtggccggaatcacacacacaagttgctgcatcacctataatgggcctatgggcttgtaacttcatttgggatcccggcccaagtggggcccatgtggggtgcgccccagctaggtggagcacgaccttaggcacccctaggtcatcctcccacccctatttatatagctaggtacccattcagggtttcttgggttttgatagattgaagtttagccattgctacttgcttgcagcgcgcgtgaatgctagaccgcccgttgtcacgaccggaaataaccc

SEQ ID NO: 40744 - DNA, 16627 bp, Oryza sativa
gaccgtccgttgtcacgaccggaaataacccaacgggcgttccttacgtgcatgtattattccttgtcccaggaggcaaggtacaccaaaagttgatacatttcagagtttatcaagcggaagcgtaaataattaatttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgcactcaacaagacacacccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccgacccaaccccaactacggccggaacctccgggataggtaggcaggactgagcccctagcagtaggacaccggccctgtgccatgacatctcgactaccgggccgtagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccatagtgtccaggtgatgagaatattcccaaagtctagagttgtaaaaccacctaattttgcctaattaaccagcgaagcttctacctaaattcatactagtggttccatgagtagagtgtccactagttggggttttgtttaatctagggtgaacaaggtaataatatcaataacaataataataaggtcataacaaaggtaaataggcatggctaaataaaacagtgataacgcgggaatttaaataaagcgataatgcaataatttaaatcaaaataatgttataaaatgggaaccaatatgttcaaggatgatgtgacttgccttgctcgctttcccaaacgtcggcttcaacctccacgaagagcagatcttctgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacagtccacggtggaccaggtgcacccgggctcacaccggccggcgccgtgggccccacacgtcagccgcacccgagggcggccacgccggcgcggtcggcgggagacggcgcgcctgtgccccgatgatcgccgccggcgaccaccggcgcggcggagcggcggccgagagaggggagggaagggggaaaggaggcgacggtccacggctcaccccggggcgacggcggcgacggaggaggcggccggagcggagggaggcggtggcgcggctcaggtcgacggggacagcggcgctccggcggtcggcaaccgaaacagagaggtggacgaggtcggcgaggatgcggtgaagccgaaggaggcggcgccgaggtgggaggcggtccggggcgacgacggcggtgaaccggagctcggcggcgacggcggagagagaggcgatggcgcgagctcgattccggcgaggagaaggcacggcaaagggtggaaacgggcgaaggaagtgcggggagggtttaaatagggttggaagggggagagagcggccggaggggaaggaaaccggcgcgggaggtccggccgccatcaatggcgccggcgagatttgcgggggcaaatccgcccgtttgaacgcgagagagagagggaaaaatggggggaaagggagaggggatcacggggagttattccccccactttattgcacgcggggacggctggaggcggcaggatttgcagcggcggcggcgctagggcgcgggggaggcggcgggagcggcgggaggaaggggatgacgggtgggccccacccgtcagcgagggtggcgggcgggcccgcccgtcagcggcgcgcgcgcggggagaggccgagtgggcagcggggagaggagagagagagtggggggaggagagatgcgccgggccggcccaagggaaggaagggggacttttagggtttttctttttataaaactttttcaactttgtttatttcttaataattattatttgtgctctgaaaattccactaaaatttatttacacattttaggcttttaggaaatatacaaaaatcctctaagccttatttgacttttaactttgcacattttaattgttggaggctttcacatggattttaattattataggcataatttaaaggatatattttagagtcgttttggcacgtgacatctgtctgcttgttcttcggaaccccaacttatcattcgtatttaactcctatttgcaattcagattgcttttatcttgttcttgcttgtatcttcgatttgcttgtaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcagctcaccgaaagatcgggccaacaatagccttgagtgtctcgagtggaactcagggttcatcaggtgatatcagagctttcgttgctcggtgagtttttttttatctacctataaccagaaaatagccaaccaaaaaaaaaattgtatcttttacctagccatattgtgccattgcattgttcttttcagtttttgctttgttgaattttgtgttgcatcgtcatgtcgtgttgctggtcttagcgtctagttcgtttagagtttcgagttctggtcacattttgtaccacagtcgtcaccgcccccgtgtctctgttgtcgtcgggacctacgaaaacggaattggctcgctgccacggttctattttcgtagttttcagaagtttatgtcggttagtttttgagttcttgagttgcatagcttctgtttggtggctgtgccgtgatggtgcatgccgtgatggtgcacctgtgcatgcgcgtgtgagaaagatggaaggagaagattagattagattgactggtttggtttctatttagtgccgagtctgtttctatttatcacctggtacctttccaaaccgaagccgagtaggattccttcccttgcgtcatcttgtggccgagacttgtgagtcgactcacactccctcacgtttgtttctgtccggattggttaaacacttcggtgaaattttatttttggtgtcggattcaagatccgtttgcaaaaacggaaccgacataactttagcattccattgttgtataatttttaattttggtttggacttttacagttgagtccctgtaatttttatatttacgtttgagtccctgtaaccttacattgaggtccttgaatctgtttttgtaaaataaaatcaaaaaaaaagaaagaaaaaaaaaggcagaaaggtgcataaaaaaaagaaaagaaaagccgcacccaaaaaaaaagaaaagaaaaggaaaggaaagaaaagaagaaagaagaaagaaagaaaagagaaaatactgttatgtttgagctgaacttcatatatcagagttgtgcatgagttattcctagtgctatcttgtggcatcgtttgtgtctaggctcgcgtctctagtacgttctagcctaggaccagcacggtgcttgactttgaacaattattcaactttgcattctctgatttgagcatttgctattcctttgctacatatttaagcctacccagagctccacagatttgattgcagccgtacagcaagtattcaccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcattgccttatttcgagggaaactatgatcctcgtgcttacattaattgggagctagcggttgatagtgaatttcaaaagcatgtcttgtctgagaaacaaaaggttatgtgtgcctctagtgttttaattaaacatgcttctaatgattggaaacatctttgtaggcataacaaaataccacaatcttggaaatacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggctaaacaaagaaattcaggacatgcttgattgtcaaagatatacatctctttctcatttgttacaacttgcttgcaatgctgaaagtaaaatagaggagagagacatgaaagagccgccaatcccattgttcacactcaaagtcaaggcacctccatcatctgaagaggacatcaaaggtaaagtaaatggtattgaaattaatcatggtgagtgcattgttaacgaagtaaatttgtccacctttcatactaaagtagagcaaccgttagtggaatcaaatgctggaattcctttgtcacaagttgatttactcgctgttccttgtgataaagaagagttgtgtgataatgcttcacttatatccatgccacaactagtgaatgaacatgatatttctagagtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccatgtccaactaatgctatttttcatatcattggcaaatataatgatagaggaatatatttggtgcatagagttttcatttgttcggatgtagagaaacatgttattgctaatcacactacttcgagtttctcttgttttgattgaatgaaacaggttattttgaatggactatgtgaagaacaccatatggaaaaaccgaggacggttttccgtgaagaaggggaggatgatgtgaccatggctactacggatacatccgttgctcacatcatggatgaacaacaagatatcaagttcaagtcctccaagtgccggaatccgattcggccacctgctacactgctgacttcaaatggccgccgaatctgcatacgacctccgtttttggcccgtgaatacttgatggacagctctcggagcgctctttccaacggatccagcctcatctccgaattccatctcgtgtggccggaatcacacgcacaagttgctgcatcacctataatgggcctatgggcttgtaacttcatttgggatcccggcccaggtggggcccatgtggggtgcaccccagccaggtggagcacgaccctaggcacccctaggtcgtcctcccacccctatttatatagctaggtaccccttcaaggtttcttgggttttgatagattgaagtttagccattgctacttgcttgcagcgcgcgtgtcggctagaccgtccgtctgcttgttcttcggaaccacaacttatcattcgtatttaactcctatttgcaattcagattgcttttatcttgttcttgcttgtttcttcgatttgcttgcaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcaactcaccgaaagatcgggccaacaatagcctttagtgtctcgagtggaactcagggttcatcaccgtggccgcaccacctctccccgccttctccttctctctctccggcgccggccggcctccagccgcctctccctcctcgcccgagcgccgtccggtcgcgccgtcgccaccagcggcctcgcagccaccttctctcccccggtcagccctccgtttcgcggggaaaccaccggaggcgcatccccgccggcaaccggtggcattgccgctacccaccctccagccgcccctgccgcgccgctcaggtgcgggccggccgcgccgtctcctccctcggcgtcgccgcgtcgacctccaccccggcctgccctcggtttcgccggaacgccgtcgcccacgccggtctcgccctccacctcgccggagttccttcggcaaccccttccgccgtgcccgtgcatcggccgacgtcgccatctcctcctccggcatcgcagcggcaaggtcgccctcggcctcgcctcccctgcatccgaaccccgccggtgttcgttatcatcgtctccgttcatcctcatcgacgactcctccggtcggtcgttcgtcctcgccggctcgtcgtctcgcggcgccgcctccgtcgtcggattcgcagcggctgttccacgccgtcctcatctctgtgcagctactgctggctgccctcgtcgcctcctcgccggccccggtcgtcgtcatcgtcgtcctctcgtcgttcccggtcgtcgtggcgttcgtccctccgtcaagccattcgcgttcgtcgtccgcgttccgtcaagtgagccgctacagccccgtcatcgtctttgtcctcgtctccgcatcatcaagcctcgcgccggccgcgtctcaccttcgtccaaggatcgccgccaaagtcgttccctcaccgtccgtctccgccgcgcccgttcgtcgttgtcgttcccacgcctcgtcgcgtggtggtaagtatccctctccctcgctgctccgtcctcgtcctttcggtgtcgcctgtgcctgttgtgcggttgtcgaccccggtacccatgtaccggtgtcggtagtcgtttgtgtgtgcgtgtggtggccgtgtttgtgtgcgcgctcggtagccgcgtggtttccaagtgtgcagccctcgtggtgtctagtggagtccgtttgtcggccacttgcctcggttgacacacggggtccgcttccgtcgacccgtggactgtctctgtgtactcggtctaccatggtcccttaggttgacatgtggggtccgcatgtcaacagcgcagtcttcctgtcttttccaggctagcgcttacacatgttttatagttgtaaaacctaattacaataatccgcaaatctccatataacagcattaaacttcggatgaccatgtcttggtcatacgagctccgaatcgaaccgttcaagtctcctaatgtttgttataacctaaagaaccatgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaaattcccgcgttatcactgttttatttagccatgcctatttatctttgttatgaccttatcattgttgttattgttattattaccttgttcaccctaggataaacaaaaccccaactagtgggtactctattcatggttccactagtatgaatttaggtagatgcttcgctgattaattaggcaacattagatggttttataactttagactttgggaattctcatatcatttggacactatggaatggttggcttatgttggaattggacacacacctccccctctattcaaaacccccaaaatagttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctacctgcctgtcccggaggttccggccataggtggggttgggtcggtactcttgtttatggctaggatgggttgagaactatgtcacgtcttttggccgtatgccgtggtggtatgtggcacgtggttacacgtgaggaagatgtgtcttgtgggtaaagatgtacacctctgatcagagtataatctattcaaatagccgcgccctcggttatgggcaagcctagcaatgtacccaagttagtgttttaattcttaaaacctgcttaacaactaaaatgtgaaatggttggcctgggttggcttgggacgagctgggactcagggtcgggttgccagttcggtctgaatcatcgtaggccttgggttaaggcaggttcgtgtgggtctacggccttgattaataatattgtatagctctaggatcgtgtttacaaaatagctttgggcaactaagtgacttttaaatgctgtttactgcaaaacttaacccctatattattaccccttgtaccccttgcattaatcatgcatctgccggtgtggcttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttaattttgattgtcaggccttaagtgcctttgtaataatgtaaatattatcgatataataaagatgtgccttttgtatcatgtttgtgtggtgtaccccggcttttcctgggacggggattaatacactagcgttcgggaaatgcaaaatttctcagtcgcgacaagctggtatcagagccatctcaactgtaggataagccaagtggataaaacctaaggacatattttataaatgaaactatttgtgaaagttcctttttcctcctttccgtaatgctatttgcaaaatgtttattctcttcttcctccttcggatttttgactagtactagatggtcagctttgcgaagaagaagatgtcgccaattgtttgccgaagctccggaagaccacagggtccgctagcgaagcgaaggaagcagtgaagccagctgtgaagaagcagtgaagatcttggagaacccgtcgcagaacctaagccaccctctattgtttcgtttgtcgtgtgtttcctttgcttgtgtgtgtagcgcgtggtttgcatcggtgggttgtgatgtaaccatgctaggttgtttgcttaatctacttgcagaataagtaaaacaaacaacacatcaacaagaagagttagttcctttaaggtcctgtctctagttctggtctattctttcctggcttgtttcctctctcacctcaatccctgtcacagatgtttaacagagaaaaaggaaagaatgtcagcgggtatgcctccagtaactcaagttttcaactcaatccaccactagcaccactagcctcaagagagttaaaaagggcacacccttggtccattccaagcatgctgcttagttcacagctaccattggttggaagtcaagaccaaaatcagtatgtgtttgatcgagcatttgccacccaggtcaatgagcttccaatgccagaagagcatgtccccttttctcatgattgtagagaacaaggacactatgccctgaattgtccatgggtatatgccaaagaagccccttcctttggtttagcagggcagacatcgctaaatgtcacgaccggaaataaccaggaattgcaaaacacaggaaaaacacaagaatggtcgtttaattggagcgcagaaaaaacacaagaatcggatgagagagatagactcaaaggaaattttccaagaggttgaagctcttgctaaaaatttcctccaaaatccacatgcaatgtgccattctataggaattttataggatttggaaagcttcaatcatttgaatcaaagggccaaataggaaaattttctataggatttgaatcctatgaaattcctacataaatcctttgattcaaaggggcccttagtttagtaatatctagatggtggaataggaatagagtagaaatcaggagtccagaagccttcggaagagttcgggtatggctctagtagcttttctcttctcttttgtaagctttgtacctttattagaatactcttctacatacatttatggtattgaaatactttccgagtatatgaatgcctactttacattatgttcatgttatactgaatatacggctagcttatctgggagatgctttggtgtgggtataatgtttgcatatgcaattactttatgtcatgacgatgatattagagtagtatctggtagtttagatgtggtgtctagattacgggatatcattatttggggttatatattgcggatgagaggtgggccgctgatggtgacagctcagtacgggtattcctccgcgccggtatataatcctaagttaattccctggggagggtatttctccgtatttagccccggttgtatggtcatgacaggctgttgtaaggaactcggtagtcaggggtggcttctcgaagtatcagtagggcatcggatagagggtattagctagtatatcagttaactagaatgtatggatactatgtatgttagaagtataggaatagattatctttctcttttcttcccacttagcttagataatatattacgagaatgagtagttaatgcttgtgtatcactctacccttggattatttttgacccctgcttagaatatgattatcacaagtaatatataaattattagtcaagttctctctacatgatcttcttacggaataaaataaatacgatacacttggaatactctcgggtgaaatgctacaatggtatatccgtgcgcttgcggatgaactctgtaaccataatatactagaagtatttctgcgtcattgctgggacatatatttcttttaatgtcgttaagaaataccaacaatcatcccctctcatctcatccgtccatccaccatctcatctgatcttatccatccattcatcagtgatgagcgattctaccaattccgctcccacgcgatgactcagccgcagtgccacacaaatccccgctgcaatgactcctccccacgaatcccgctgcctcctcgcctgccatgatgacttctgcccacgaatcccagccgcttcctcgctcctcctcaatccgtgtgcatcctccgtcctcctcgcgacaggccagcgacgccgcactatcggagttgacgtcgtccccatctgccgccgccgtcgcagcatccccgaggtcgtccccttccgccaccgccgccgatttctccacccattccttgctccatcgcgatttctccgtcgtcgcgacctcgccccgccgatcgcgccctcatcactgtttcgcctgccatccactgctcctatagccacctccatcgcgtcgccggttcctcacgcatgttgctaagtccgacccgatccggttggttccgtcatcgaggttgccgcctccagggaggccaagctgatccggcatctgctccacctgctgccccctccccgtactctgctcctgttccccctaaaccctaaggtaataccaatttatcctattttacatttttttgtgttgtgtcaatttgtggatcaccatttgttttattgatcattcactatttgccaatcagaaattggccatggagtttgaagatcttaacgttttgtttcctccttgcctgatcatatatgtcttggatcaggagaagctcttccatgaattaggtaaccaaagtcgatgaataggctagccttaaggatggcggcttcggaaggcgtctgtccctattctccgttgatcctgcacagcccctatcaatggatttgcatcaattctttcttctgaactttacgaaggaaaattttgtctggttctatatttttttatttgtttggaggtaatgtgatgttttgagataggctctaaatttgcttgtaatacggatgattatcactaatcactgtgaagccatcctactgttctggttagtagttattgagaaatatataacatttgtcttgatcctcgagaatacccaacttcttaaagagaaatatatctatatatatatctatactaatataaaaagaggagttgccccctccaatgctacatgccaagtcatccggactaaacgcgtccatccgcgcgcttctcttcctccaccgcactatttcacagccgaggattccacgcgcgaagacatcgctcctccacccgcagccgcggagaccgcgcgcttctcttcctcgctcactcctcccagcgtcctcgcaggagcgactccccactgccgccgcagccatcctcctcgctcgctcctccttctccccgctgctgccgctacgccgcgccctagccggagccgccgcggccgtcctccttcttccccaccgccgcgccccgctcttccccacctccttcttcccagatcgtgcttctcccactcggatcagccgccgccggagccgactttggccccttctccgccgccggaaccaacatcgacctcagcccgcggccgtccttcttcttccccaccgccgcggctgtcctcctcacgggcttctcctctgccccgctgccggcgctacgccgcgtcctcgccggagccgccgccgtatcgttcttctcccactcggacccgtacgaatctccgtcctccaccttcgccgctcgcccctctctctctctcttcgcccgcgactccatcccctccctagccgctgccctcacggcctcgccatcgccaatccctccatgccttctcgggctcatggtggaggggcaggggctgccttcggtggagagttacagccgatcccccatcaacagcgcccgcgagtgaggatcaagccgccgttatcgagccaaatcaggcggacaagctgagctgacggtgtatacgggaggtagagatggacaccagcgacggcggtgcgttcgataagtgaccttgatagcatgtggcgggagaggatcggcggtggcgcctgagatgtcgacagggaacatgcttgcagatctcttttccatcaatggctaccacgagggtcttcccatggtgcttgcccacattgccacctacgccgcgcttgctcttcccccaactgtcgacgcccggcaccatagccgccgaggccaagaagatctggaccatctggtcatctttggcgccatgaatccggccacttccgccaacggggctgctgccatcatcgacccgccgtctagcacggttcaatgggcatcatcacacgcctatgcttcatgtccttctttactagcaggttaaaaaatccttaaggatttatttgctaatcatctttacctaatacatatctggtataattcttcgttgccttggttttattactgtatttttaggtcatcaggtggagaagccatccatatgctaaataggtctcaagataggagtgagcagcaagttcggttttcattgggccatactcctcatctgaacaaacaggtttacatagtttacatagttgttttacagcctataatatgaaaaaaattattggatagcttgttattgtgaggtgatcttgtttgttgttgaatgatattaattgattggttgttttattaggaattctcagcaggtgtgttgatttctattttgcttaattttgtttaattctgcagccatcatggcccagggagtataaagttgaatagagccaatggatgctgtggcggttgcgatgacggtagctcaacaatggcactgggcgtgcactgggaggtatgcttaaaggagagtgttgtagcatttgcatttttggcagttaagtttgagcactggatacaaatcattgatcttctagaagtaacattttgattcctgcaaactaatgcggcacctctgtctcaacactgtcatcaggtctgctccccagtttggcactccttgtggtaagggaaacgaggagaaagaaatgacgaccaacaggttgtgaaagacaccaacgacctgcatcacgcaaataaacaggtatttattattttggttagtttagtttgttgtgcagacattaattaaggctaggggtaggggttgaagacttatggatgaatccggtaccgtaaccttcacatttgaccgttcattagtagctaaatggacggctaccatgcatctgatacatcaatctgtaggctaatgacatatcttgagttatagcgatactttctttaaacaattgctatctttttatgtactgaaatttgcataatccttatgatgtgtttttctttaatcatctttatgtaattaatacatgtagaggataagaagagagatgattagcttctgcatttctgagatgtgaatatctaattaggtatccagatcctaagaaaaaatatcttcagagaatagtatcaagcaaatattaagagaaagcagtgagcccatttttttttgggtatttcataccattaatcgtagcattcggcagttctgcagttatgtatactttgcacttctattgtgcaaatgttatgttacaatatatatgctgttctgaaggtccatgacgaaattcttgctgcaatcagggaaaaagaggagggacctctccatttgaaatgctctaggctacataaaaaactgacctattcatatgaaaccttaagatagtacatattattattagacaatatgttggtcttttcttgctaaacctgaattgttctattggtgcatagtggaattagtaagattggtgtgactaagtagatatatttgaagtgtatacatttttattaagtcaatagacaatgtttcagcctgcagtgatcgacatattcaggtgtcagtaaagaggcacaacatttatttgcttactggattacttctagacaaggtttgcttcttgcttttctatgactgacatgttgtagctccgctaaatgaagtattattacaattttaatggagcattatgatattagttatgctgatttaaaatgcggtaatctattgctttagacatggtaacatacatgatgaattgacctcttgttatagttttagtttcatcatgattttttagaaatatatataatatatgaatattcacaatgcaacatcctctgccttttcttctttggatatatcacacggagataaaagggaattattaatatgttagattgtgctatcagtgttgatgtgaaacaaagttatcactggtattttttatcatggatttctattttctaatatccgtttcctatctaaccaaaggagggaacaacaatcggtgcatgatctctctacctgatttagacagataacactatcaaac

SEQ ID NO: 40745 - DNA, 2064 bp, Oryza sativa
gcaccggcattcttcaacccaaaagtcatgacaacccactcaaacaaaccaacatatcccgggcacctaaaagccgtcttgtacatatcctcttccgccataaagatttgattgtagccgacattatcatctaaaaagctaatcaccttatgacccgaggcatcattaatcatcatgtcggctataggcataggatattcatctttgggagtggctttatttaaatctctaaaatctatgcaaactctaatcttaccacttcccttcttctccaccgggactatgctagatacacactccgcataacgacatggcctaataaaccctaccttcaataaccgatcaatctcctctttgactcggtcatatagcaaaggattaaaacgacgaggtggttgcttataaggcctaaaacccggtttaattggaagccgatgctcaacaagctcacggctaagacctggcatctcatggtactcccatgcaaagtaatcaacatattctttaagtagctcgattactttaaccttgtaatcggctctcatatttttgtttacaaaagtcggcctcggtttagttccatcacctatgtctacttcttccaaaggatcggccgatgtaaacccttttccaagcttctctacttcttcaaaatcctcaacggtttcaccaatatcgttctttgtagaccgatattcttgcaccctcttttgtaaccactctaaattagcctctttactcattatacaaatttatgtggcttagccgtgctacactagccggctttacagagataggtacaaatttgccatcggagatactaataaaatcataactagaaagatctctccccgaaaagcattggatattcccatgacgccactcaaaagtaacatcggccattgcaacttcggccgatgtatccgcttgaacaatctcaacatcatcgccgtcccattgaattaaacattgatgcaaggtagaagacacacaaaaattggcatggatccaacaacgacccaaaataacattgtagttaccttgcacatcgacgatgaagaaagcagttggtagcgtcttgtttcccacggtgagctccgccgaaaagatacccctcgcctccgttggttcaccattgaagccattgagaatcatgttggtcttttttaactcatcatcctcacgccccaacttcttgaataacgaatacggcatcaagttccggcttcccatctacatggcctttgagataaagaggcttcatgtgacagtttgattcatcgggcttctcaaaaactgcatctttaggacctaattagaattgagcaacctcggcttcatccatagcacaaaactccataggcaacatacataccatgttgatatccatgtcttcttttggagataattcacttttatcaactgattgttcttccttctcctctacatcaatcggttttgccttctctatggatttaggcctccataccggtggtggtcgcaactcattgaaccttttatccctatgttcttcggcctttttctcccttagctcttgggcccgaagacgttgcaaccttctcttttgtgtagccgtcaaatccttaggcatctacctaggattcggctctgttccaggaggtagataatgtcctttattaactttgcttgaagacgatgaagccctcacattgccctttgcaatcctctcatcaaaccggcgctggagcccagtcagactggccatagaccaccggtcagaccggccagacgcgccggtcagaccgacgtgtggcacgcggttagaccggcctgaggcgtcggtcggatcactgtcgggtcgacggtcagaccggcctaatggcccggtcataccggcaacatggccgcggtcagaccggctagagggcctggtcagaccggccgactgcgaagagctggtaccggcttcggattttttgcttggggactttccaactccatctccagaaggtataggcacatcatggaaccccactttgatagtaattacttccgaagccctttcctccaccttgacgcgct

SEQ ID NO: 40746 - DNA, 5438 bp, Oryza sativa
ctcaccaccttgcctcttatatttctccaagagcatagtaaaaatcaccttggtcttcctaggggccttagaagttgaagctccacttttgttctccttccaaacgccaacctccggcttctttggcactatcatcttaggcctcggctcaccaatgaccacttccttttccttagtagattcgacttgcttcggccgaatcaacacctttttatcattgaaactaattgtattcaccggaaaaggatcatcatcaagcttcatcttggagccttggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatctaatttgtttctcttgcaaaagataatcaaaaatcttatcacacttggccacatcaaaactatatttaacctcactttggcgatctttgcgaggagtcggcattaagttagaacaaacaaaaggcttatttttattagtccatgaccattcggcaacataaatatcatgatcaccctcctcctcactatcactagcctcagggtaatcaactacattaacattaggctttttgtcaaatggtctagctaattttttattatccttaacccggctttcttgagccagagccctttgcatgagttgactaacatcaataaattgttggccttctagtctctctctaagaggaacaactaaaccattaaaagcaagaccggccaaatatctatcagttatattcaaagtataacattggtttctaacatctctaaatctcttaatataatcaatgacagattcattatacttttgcttaaccgatgttaaatcacataacctaagctcagtttctccagtatagaaataatcatgaaattgttcttctaattgagcccaagtatgaatagaatttgccagtaaagaagtaaaccatgtgaaagcattaccggataaagatagagaaaacaaacgcaatttaaaagtatcactattagcctcaccacattgcgccataaattgacctacatgctcccatgtggtcttaccatcctcaccactaaacttggcaaattcgggaactctataatttcgaggaaacgacacattatcataataatcaggatatggctttttgtaagttctagcacgattcctagtttcaatccagaatctattcctcataatatcactaatcatatcctccatgttattaggcccttgttgatttggcggtgggtttggtggcctaataggttgtgtttgtggcgcaatatgattatattggccttgtctagtatcgggaggatatcccctagaaacattattataagtattaggaacatgtgggggaacttggggattacttgtggcagtagatacagaaggatcaaatgttttaaagtgatacaaataactagcattagtcatcggatctattccctatatcataatatgcggtcggaccggcctgagagctggtctgaccgccggggtaatacttggtccgaccggccatttggccggtcagaccgatggctgtgtcgcggtctgaccagccaccaggcccggtcggaccggccgtgaacgccgttctgtcggttttactacccgtttgatctataggaggttgattagcagtggtataggctttatgctttaatgtgtaatcatccataaaagaaccaagcctactccttaaaaacccatcaactttatccttaaacattacatctaatcgatctttaaaattagccatagatgaatctattgtagatgcaatttgttgttggatagattgtgatacctcgtcattacttaccacgtcgggagcgagcttgggacgtggcccgggcttgatgatcacgccttgacgagtcctagtagttgctctcatcaacgcctcccgtgtgagctcgttgatgtactcctccatagctttacgatcttctccttcgaagtcatccgatgtgaccggcatcacattagatggctccacctccgtcttggatggcggcttcgtcatggcgaagtcgaagttgagttgacgatgaacggatctcctccccagcggagtagccaaaaatcgtgttggcaactttttgtgacaagttggcaagcacgatcgcagcaccttatgccttgcggtgatcctagagtcgccaaccacttagatgggttttgataactaaaccggctagcggagccgatttctagataactacccgtctcgtgggcaaaacggaaggttttcaggacaaacctacaaagaggtgttgcactctcgcagcggcggcgggcggtttacggcgcaaaccgacaaagatggacaaactaagagaaaactaaaagcaatatgaaaaacgattcgattgattgatagtagattggtcttttacaatgaaccggccatgtcccttatataggggttggtcttgccctctacaggccctcctccacgtccaactcgggatagaagccaaaggaaacccgaaacatgccttcccgagcaaggaaacctcgagacccgacgaaacagaatcggactcggtcctgccagttagaccggccacacaccgccggtctgaccggccctcaaccggcggtctgaccgcccaacacacagcggtcagaccggcccactcggaggaaaccggtagacttccaaattttggcaatctttcctattttaatcctaggtgccaaatttgggtgtaaacactatgtatgttagaagtataggaatagattatctttctctgttcttcccaattagcttagataatatattatgagaatgagtagttaatgcttgtgtgtcactctacccttggattatttttaacccctgcttagaatatgattatcacaagtaatatataaattattagtcaagttctctctacatgatcttcccacgggataaaataaatacgatacccttggaatactctcgggtgaaatgctacaatggtatatccgtgcacttgcggatgaactctgtaaccataatataccagaagtatttatgcgtcattgctgggaattatatttctagtaatgtcgttaagaaataccaacaaacatttctggcgccgttgccagggaagattcataatagagattacttgaactaatactttatatttatctctgtataatcattttcctttgcaggctaaccttggttgttttcactttttgttgtgaaaacagggtagtgcatgactggtttcaacttgccggaaaacttcaaagaaaatccagaagctttcttctggagcgtcaggccgcgagtcgttggtccgcagaaaactctaccgacaaagaaaccagccataccagcgccaccgaccttcaagactatggctaacaagactctccgcgagttcgctgctccctctgctgacaatgtggccattgggctgcagatcaacatggtaggtgtggatttcgacttgaagtccagcctcatcacgatggcgcaggcttagcccattctgtggcaagcctaatgaggatgccaatgctcatctgttacaattcttggagatctgtagcacgtacaccatcaagggcgtcagtcccgacaccgccaggctgcggctgtttccgttctcccttcttgggagagcgaagcagtggttctatgccaaccgtgttgctgtcaatacctgggacaaatgctctatggcattcctctcgaaattcttcccgatgggcaaaaccaatgcccttcgtggaaggatttcaagtttccagcagacaaggaatgagtctattccggaagcatgggaatgtatgtaggagtatgtggccgcctgtcctcatcatgggatggacaactggctgatcctgtagaacttttataatggactcaccccgatgtcccgcgatcacctggacgcggcagctggaggagctttcttctctaaaatggttcaaggagccgttgatttagtagagaagatggtctccaatatgggttggagcgaggaacaactccagacctgtcagcgaggcatgcacaccgtcaaagagacggaattacttgctgccaagctggacctcctcatgaaacgattggacaaccacgagaaaaggccacaaggcaccgtcaaggccttggactcacacgttacgtgtgaggtctgcagcagcacgggtcactctgggaatgactgcccggaaacccgtgaggaggcgatgtacatgggcaacaacaattggtaccgtccacaaggaggtcaggggtggagccaactacgcccatattatcaaggaggtaacaacaacggtaacttttctaaccagccctccttgaaggatctagttttttcgcaggctaaaaccactgatgcgctaagcaaaaagcttgcaaccaatgacaagatcctagaaaacaataatgtcaagttagatggctttgcttctgcttttcaaaatcagctgagctttaactaaatgataaaaacccagctagctcagttagcatccttagtccctgtaaatgaaactgggaggattccggggcaacccgactcctccattgaaaatgttaaggcgatcacgatgaggggaggtaagtccactcgtgatccgccgtatcctaaccctgcaggaactaacgagattgcaaaaaaagcgtcatctagtgactcggctgacaaggaagatcagccagaaaagaccgtgccgcaggagtactgtgacacatggttgctgttgtttcctcaacggatgaggaaaccattagtggacgagcaattcgctcgttttgttgaagtaatccagaagatccacattaacgtgccgttgttggacgctatgcaaatgccaacatacgcccgttatctcaaaggcatactcaacaacaagagaccgctcccaacaacggaggtggtcaagctgacggagcaatggagcaacgtgatactccacaagctcccggagaagaagaaagatccggggtgtccgacgatcacctgctcgatcggggcacaacagttcgaccaggccttgtgcgaccttggagccagtgtcagcgtcatgccaaaaaacgtcttcgacaagctcaacttcacgatgttggcaccaacaccgatgcaccttcaactggctgattcgtgagtccgttacccggcagggataacggaggatgtgccagtcaagatacgagattttttcatcccggttgactttgtggtgctggacatggacacgggaaaagagaccccgctcatcctagggcgcctgttccttagcaccgcaggagccaacattgacgtgggagcggggagtattgttggtatttcttacgaccacagataaatccgcaagcgcatggaatac

SEQ ID NO: 40747 - DNA, 20221 bp, Oryza sativa
  unsure (1)..(20221): unsure at all n locations
taagaaaggtaatttcctatctattgcttcgggcaccgacccctgctggtctgccagcctggttccggctatagctctatgatgtatccgaacgtggaggattactaggacggaattcagggctgtcaccacctgccgcctacctctgataaatccgtgggatacacaacaaacaaaggtaacgtctaacctagacaccacgtctaagttattaattactactctaatactcgcgcaggaacttccttctctatctggagtcctagtactagagcacttagtataaatactaaacaatgaacctgcaaagatggaaatatatcttactcagattaaataattaaataacataaaaaaggaatacaaatgcttactttatagaagaagttctccgaacccggagtagagtgtaccgatagctccggtactcctcccgaattccacctaggaaactacactcgtcgaggtagaagtcggatgagcaccatacttccgggcactcctccagagcttcatctcactctctaccttattctaatgtataaaagatacactagagcctcttgtaattcagctcaaagttgtgtgtgttggaatgagatgaagacctccttatataggctccaaatgatggttaggggcatgggaattgtccaaaacaccctgcaaccgcctctgggaaggaatccaagccatccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattctaaatggtttttattgacttatggggcctccaattcgtgtaaacgtgtcctgaatgtgcagaggtgcattttgtcgcatgacggatgtgttttctcctcaaaatacctgcatacacatatttcaccaacactagtggaaatgattagtaataatacctaccactaagttggataccatgttttatttcattatatgcaggtattgacggtcagatattatgatttaaggaccgtcaacaacacccccacacttaaccttttctcgtcccgagtgaaggctatgaactctacaacagagttatgacttccttactaataatcatgcaaacaaattattcaaagccatacctgtacttgtggatctttgtagtgtctaccatacaatcttggacaattgaggaatggaacaatctcgactcaagtcaccctaacttttcatgaagaacaacttggggtttttcatgtaacacaaaattataactttgctttactccctccattgattctctcgatcactcaaagtgtatgattcctaacaaaggcatatgattgtgccttttcttttcctaccatctaataaggcttatgtggagtttagggtatggaaaagagtagagcattgcttgcatcatatatattgcaaagtcaaataatggatccacggaaatacaagacatactttctggtcaagaatgtgcatgtgtatgtgtatggttaatttcgtgggtggaaaacggaaaaataaaaataactccttttgtatacctcctccttcatttatttttttttgaaatttgagagagtgcatggctatctttttttttcttttctttttttttcatcatcatgctccatacttgtattagcattttttttcttttgtttttgcatagccatgcttctctccctttttttttgaaagaactttggaggaagaggcataaatgacatggagtatttatttgatggatgaaatgaatgacaaatgggagatgctaacttctagtgtagaagtcaagcatatgtgcgtgtatgtgtgatgtgaccatggctaccacggatgcaaccattgctcacatcatagatgaacaagaagatatcaagatcaagtcctccaagtgctggactccgattcggcaacctgctacactgttgacttcaaacggccgtcaaatctccattcgagctccgtttcggcccgtgagtatttgatggaaagctctcggagtcctctttccaacggatctagcctcattgtgatattccatctcagtgagccgcaattgaagaaacaatgggctgcattgtctgtagtgggcctgtgggcttgtaacttcatttgggaccccggcccaggtggggcccatgtggggtgcgcaccaagctggtggagcacgaccctaggcacccctaggtcgtcctcccacccctatgtatagctagttaccccttcagggtttctcgggttttgatagattaaagtttagccattgctacttgcttgcagcgcgcgtgtcggctagaccgtccgtctgcttgttctttggaaccctaacttatcatttgtattaaattcctatttgcaatatcagattgcttttatcttgttcttgcttgtttcttcgatttgcttgcaggaataaggttgatctgcaccggcaagatcaacaacccacggagaggtgtatcgatcgctaaggcgcaacacaacgtctcatacggttgtagtcggatcgtcaacgtttctctcaaatcatagttatcacaactcaccgaaagatcgggccaacaacagccttgagtgtcgagaggaactcagggtccattaggtagtatcagagctttcgttgctcggtgagttttatctacccataaccagaaaattgccataaaaaaattgtcctgtacctagccatattgtgccattgcattgtttttatcagtttttgctttgttgagttttgtgttacatcgtcgagtcgagttgctggtgttagcgtctagttcgttttgagtttcgagttctggtcacgttttgtaccacagtcgtcgtcgcctccgtgtctctgttgtcgtcgggacctacaaaaacggaatcggcttgctgccacggttctatttttgtagttttcagaaatttttatcggtcagttttggagttgcatttaggatttgcttgagtttctggtttgcccgtgaatagatcggcctttgcttgttgccggtgtagagaggaggaagaagaatttccaaatctgtttttggaagtatgtgagtttaatctggaaagaaatagtagatcagattgattgaaatcagtttccttttttctctcaccatatccggactcctaggtagtgccgcatccttcctttcctcacccaccaccaccccgggtccgcgaccaggccgagtccgagtgtctcctctcggtcacggtttcaatctataccgtgatcttgcatactgcttggtgaaaatttttcgagtatcggattgaaaatccatttgcaaaaacagaacctacaggacgagaggattccatttttgtatagttctaattttgggtttgaacttttacatttgagtccctgtaatttttgtatttacgtttgagtccctgtaatcttacattgaggtccttgaatctatttttgtaaaataaaataaaaaaaaaggcagaaaggtgcaaaaaaaaaaagagaaaagaaaagccgcaccaaaaaaaaagaaaagaaaaggaaaggaaagaaaaaaaaagaaagaagaaaaagaaagaaaagagaaaatactgttatgtttgagctgaacttcatatatcagagttgtgcatgagttgttcctagtgctatcttgtggtatcatttgtgtctaggctcgcgtctctagtacgttctagcctaggaccagcacggtacttgactttgaaccattattcaactttctattctctgatttgagcatttgctatccctttgctacatatttaagcctacccagagctccacaggtctgattgcagccatacagcaagtgtttgccaagacatcgatacatccaacctccatttgggtgcttggttaagtcagtgtacatcaccattctgcttgcattggtaagatcttgtaagagcttggttaaaagcttgagtgtgtgtgatttttgagctgccactacctagtagttaataggaacgcacatatttttgtgtatgtttcttgtttgctactaaccatggcaggattgcgcacggggaaacgagatggtcatgctcaacgtcaacatcttcaccatcaacgagatatagcgacttcttcacgcatcacatatgaggtacatgataatgatcttgcaagggtagaatctaaattgcctggttttgatggtaagtatgattccgccgcttatgttaattgggagctagcagtagaaaaacaatttgatgagtatgatttttctaatgctcaaatgattaaggctgctagtaataagtgtaccggttctgcatctttttggtggcatactgtgggaaataagcttgaaacttgggatgaatgcaaaatactgatgagaaaaagatttgtgttttcatactatagacgtgctctccttgagaaatttgaacatctaaaacaaggtgacaaaatgtcactacgtcagaacctacattttgtaacacaattttgtaacacaaaaagacatgtgttacaagaacactctgtaggaacactttgctttgtgttacaagtacattgtaacatatattcagtgtgttacagttgtgttacatacagtaatgttatctatgtgttaccaacacctacagtaacacaatatatgaaaaaaataaaaataaatatattcaaccatagaacaaaaaaaggcacagggaacaactgaacatgcatgagaacactgatatggagcatttaggctatgaggtgagactttgttatttttcatttcagcaagacaactcattttttaacatggtttatatgaatgtatcatggaaattgcactaggtggatcataaccataaggaaataccaagccactacgactcatcatcactctctatgctcaggattttcgacaggaggtaattcttacccactaataaatttcctggataatcaatgtgttatgtctatatcaatgtgtgagatatgtgtaatgtacacatgctaagaaagatgatgctaacatttgtcaccactgaaaatctagtgctagtaatagttttagtatggatgtcatgctttcatgtaatgctgaaatctgattttagaccattgatatatcatttaatcctgactgacttttagtaaagaatattgtacattttagtaaagcaaggtatgtccatttttctcatgttttctgccgctttgttgctccaactttgtattttattgactattcaattgctcttagtgaatctgtgttcgaagttagaaactaaaagtgatgccaaaattaaagattttctaacctatatatttgattctacaaaaaacaatatagtttttatctagcaaaatcataggatgtaacaaaacttgtccatctgtaggtgaataaacaaaaacagcaaaaggtacaaaagactatgaagagtagagagaaaaaggatggtctgaacaggactacacatgttagggagtactttcatgattttaaaatttgtatcacttatagtgatttacaagaatctaatgagaacacaatgactagatttttcagagggcttaattccaatattcaagctgggcttgttaatgtgacatataatcatataggccaattgttcatgcttgcttgcaatgttgagcgcaaaattttggagaacccaacggagcaacaagctatgcttgtgcctcctatcattgatgttttgcaggaagttcagaacagtccccaaaatgagaagaacgatatgtttgagatgtcacttccatcactcatgaatgaggagaaggctgatgcacctaccttatctgaagagggcataaaaggtaaattaaatgttgcagaaattactcaaggtgagtatgcttctgatgaattacatttttccactttccatgctgacctagagcaaactttagtggaacctacttctgaattgcctttgtcacaagttgatttgcattatgttccttgtgataaagaagagttgtgcgatagtacttcatttatatccattccacaactagtgaatgaacatgctacttttaatcttgattctccatgtactgaatttaagtatgttattcacatgtccagcgagaatgatgaacttcaattgcaatcttctttaaatacattgggctatattatgtttgatgattcttgtgagctcaattgtttgaaggacaaaatatttgctcattctgatttgccatgttctcgtaatgttatatttcacatctttggcgaatataatgatcttggaatatattttgtgcatagagtttacatctgctcagatttaaaacttcctgtacatgtggataaaacatgcaagctagagaaaaatgttattgctaaccaaattgtctcgagtttgccttgttttgattggaagaaacagattgttgtaaatggactacgcaaagagcaccatatggaaaaaccgaggacggttttccatgcagaaggggacgatgatgtgaccatggctaccacggatgcaaccattgctcacatcatggatgaacaagaagatatcaagatcaagtcctccaagtgctggaatccgattcggccacctgctacattgctgacttcaaacggccgtcaaatctccattcgagctccgtttttggcccgtgagtacttgatggaaagctctcggagtcctctttccaacggatctagcctcattgtgatattccatctcagtgagccgcaattgaagaaccaatgggctgcattgtctgtaatgggcctatgggcttataacttcatttgggaccccggcccaggtggggcccatgtggggtgcgccccaagctggtggagcacgaccctaggcacccctaagtcgtcctctcacccctatatatagctagttaccccttcagggtttctcgggttttgatagattaaagtttagccattgctacttgcttgcagcgcgcgtgtcggctagaccgtccgtctgcttgttcttcggaaccccaacttatcatttgtattaaattcctatttgcaatatcaaattgcttttatcttgttcttgcttgtttcttcgatttgcttgcaggaataaggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggtccatcaatgtggaatgtgtgttcttgaccatgaaagtatgaaaagcgtttcactagtgtcacaaaacttgacaacgttcattgaaatgacaagcagcgtatgtagcgagctaatcatgaatgatcaaaccatggctctagtgggaataaaaatatcaatgaggagtttagcatcattaaatgttttttttctttttataaaattcccaagtgtgcaacatgaagagcaggatttctatcatcagaacatatctcattcatcaattacctagatagcatggggtccctattggatatatcaccacaagcaacaagtaatgagcaaagaataataggcatggatgtcattttcagggagaccatagactctaattgtaccatccctagcttgggttcaattatctttaatattttagaattgataatcaaattaaactcaagatagaatggatgtccaaaggaaaaattgtgcaaacctgcgctttgtataaaacagaggacgattcatggtagaggtggttcagccgaactggaggtttggctgactcctcattggttctgactgcatcagttttccttgtgtggttcgtcatggctcatcactactgggtgatcttgctttggttatggcgttgatgtgcaagatcacccccacacttgtctttgtatctgggaggctttattgaacacaaaaagaaaaacaaagacaaaagtgaagcgaaaaggactcacttggttggaagaccaaggagccaactttattttattttattttatttaatctttttccctttttattttaggcaccaatggaaatggtggatatcctggaaggatggagacatgagatgaggatgcacatggtgtatgatattcttaccagatagatcttaccaggcttagaactggatcaaatgtaacaaagttttgcatttgttctgcttggttccttgtgcatctctttcccatggaccaaggagcatgatataagtgtttgaagttattgtacattgctcattgatttgtctttttatttcctgcaaaaggttagtggacaacaaatactcgaagcactacaaagatttgaatgattttattgtagcctcaagattaattgttcacatccacgctaaaaaggaattggattcaaaacttaagaagcgtggatcccacaagtttgccaacattttattttatttttcgagagacagtccttttattctgaaacatttttttttcaaatttttattattcaccaaatttttgtttaagcacaattcatacagggctgaggtaaatttgcatgaacatgctaaaggagtgatcggtaatatacgcaccgtgcaccttgataggtgatatgtttctcctttgcatgttaccaattgatttgttcccggccctgacctacctccattatgaattgaacttgaggactcacccatgaatttgaacactttcctgtagggggttaatccacaaaagatatatatccaatgtctatgaacatattaactctgagattcattagtcaaactaaactccatgtccaatttgattaaagcagactattttaacctaagcgccatgcttaatttaaaaagcctatagatgtcttgcgcgaacacccaaaatagagcatatgcaaatagacacaagaaacataaccatgtaagatcaagtctcattcaaatgaagataagtatgagtaaaaggaatggtgaaccctgttttatttttcgcatacctgagtgtacttaccgccagcatgatgtatattttgaaatctctggggcagtggcatggtcacaaatgattgtcgatttctcctccacctccatgcagattgtaccggaggaagacgctttaaccatgccaactcaggcaagcaagttggtcatgcacacacatcaggtgcaagaaccttgtgccttgaaggcgtgatccattggcacaatgctgtagagacgtaggatacatttctttctgggcaaatgtgcaagtgccaactggagtggagcaggaaacacctagaaaagaagagggcatctcctcttgcttgtatgcgtgtaggtgttgcgggagcaagaagttacgcacagctaggagtggataaagtctaaaccaaggtggcacatgagctcgagagagggactaggtgtagccaggcagcatgattgctactagcgaggtgtatagccatatttcaaagacacgcacataatgcggtctttgatccaaatgtagctcgtcagctctcttgctcttttcttcttctcccattttttttcttttcttttgtctttcttttctcctctttttttttatcttcttttttttttcttttttttctagcaagctaggactaacaccaacttcaaaccaagatggccttggttgatggaactcgtcatgaaaagctcgtcgacctttcccccacacttggacttttgtgtcgcaagacatcaaaaaccaagtgtgtgatgtcggattctcctatcgagtgtgttccaatacccagggtcaccaaagtgtacaattgatgtagctacagtgttcttaggcatcgtatgaccctcgttcttaatctcaacctaaaatggttagtgaccaagaatacctgatggtgcatactatcctaaaaactggttcttgcttttattagaaagaaaacttaccatgataatccagggtatctcccggcagtgctttgtttatggtcacaagcttgaccaacgggacatcgctatgcaagattagtgccacaaacaaataggagatttgcagtatttatgataaatgtaagcatctacaaccatccttctaaacatgctagaaatgtggaccggaaggtggttgtggtcctcgcacagagacgcgacactaatcgaacaggactctagggattccttatgtgagcatgaatcctgggggattttgaaatagaaactttcatgctcatatgtggaatgttttctctcatcctccagagtcgatgtctcaagcttgtccgtggcctccttctcaagagatacatcgtgcaagaacctggttgtttcttgatgataaacaataacaacgctttgaggaccagagggacaaggcttaggcttgatcgagggtgatgagggtcgttccgtttcatgaagatggtcaataggttcagaagaaacgaacgaagatacaaacatcacctcctcgaacggctcatgcttgggatgagcctttgtattgctggaataattcagggtgtttccataatcttcataaagattaattactactactcgcgtaggaacttccttctctatccggagtcctagtactagagcacttagtataaatgctaaacaatgaacctgcaaagatggaaatatatcttactcagactaaataattaaataacataagaaaggaacatgaatgcttactttatagaagaagttctccgaacccggagcagagtataccgatagctccggtactcctcccgaattcctcctaggaagctacactcgtcgaggcagaagtcggatgagcgccaaacttctgggcactcctccagagcttcctctcactctctaccttattctaatgtataaaagatacaatagagcctcttgtaattcagctcaaagttgtgtgtgttggaatgagatgaagacctccttacataggctccaaatgacggttaggggcatgggaattgtccaaaacaccctgcaaccgcctctgggaaggaatccaagccgtccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattttaaatggtttttattgacttatggggcctccaattcgtgtaaacgtgtcctgaatgcgcagaggtgcattttgtcgcatgacggatgtgttttctcctcaaaatacctgcatacacatattcaccaaaactagtggaaatgattagtaataatacctaccactaagttggataccatgttttatttcattatatgtaggtattgacggtcagatattatgatttaaggaccgtcaacaagtatccgtttccacatcaacgggaaggaagagaagtttgagtttcaaccaaggacagaacaatgctccatggtcaggataaagtacgggccgaacccacagaatattcaagttgttgttggcggttgttaaatgccattctcataccgccaacatctgcataaagtcgagacaataaaacatccaacatagtaataggtgcttaatctcacatattccacaagtgttcgtgtatatttgtatgcagatgataaaccctgaagttgggaggaaaatcagactaaagtgaggagaattatgtatccatacaaggaggggttgtgaacttcattgaaacatcagtaaatcaacccaaaactccgagaaatggatagaggaaggcctaggaagtccaccaaccgaaggccagactaggagggcccagcccaggttcggccgaaccccctggttcggccaaacccttatgatcgccgttgatcccaggttttggcatggacgtcccagatcactccctgatggcggttgcggggcacttcaaacatttccccttcgccaaccgtcatacctacccctatataaagacatcatctcactcacttcaacacacacttccaagcttgagctgaattataagaggctctattgtactatattgtatactagaagaggaagagagtagagtagaagaagttggaagaattccggagttgtcggtaatattctcctatttcttttattatatttattactctgaattcaatataatattcttcttaagtaatttagatttatcttgtgagaattatctctttgttagttcctaaatagcatacgggattattgttcattataatcaactaaaatatagtgattgctttggtgagttataaacactaaagtagatattaattgcttagacgtggtgtttaggtaattattatccagtaattgctgcgtatcatacagtatgttgaggtaggtgtagaggtggtgatagccctcgagatcactgaagtccttcctgtccaggtacatagtagagcgacatctaggaacagcgggttgccaatgcctgaagaattgcgttaggattaaagttaagctttccctagacactgtttctcactagtaaatcctctctatcctggcctatcctttgcttggtgtccttggatgaaccggaggaagatctgaccacacacgttcccttggattcgatacccttggaatactacataggggaagtgctacatcggtatatccgtgcgcttgcggattttgtctgtaatcgtattaaataccaacaagcatttctggcgctgttgccgggggacggttgctgatcatttccgaacccagttcatcctcatatcctttttacttttttattctacctctacccctgctaacctggaaaagttgcgagacggattctgtcttgccttctttccagttactcgtattactgcccttcgagtagaaattctcagtttcaagcagatcgaaaacgaatcaatcggtgcagcttggtccagattcactaatttagtgcaatccggaccaaccctgcccttacccgagtatgtgcttctccaacatttccatacgggtttggataaggagtctgcattctatctggacataaccgctggaggatcgttcatgcacaaaacgtcgtcagaaggaagaacaattttgaatcgtattctagaaaatacttccttcatgacacaatccaatgaaccccagcaggaggcattcgtgtccaagatagaggaacctctaatgatcgagccacgcactgaaccatccacttcagctagctcgattgatgagaaagttcttgagcaaccgtccgtcgaggatgaagagattcagactccggattgtgccgcaattctgttcatggacggcttcgacgaagactacggcaataccctgaactattttagcaagaggaaaccactcgttcctttgccacctcccgatcctatggaactcgggttcctacgagaaactgtctgggtgttaacatccataatgagcgatgaatggctaagggaggcagagctttcatccgaagtaattcggataaataccgctccccgaatcattccttgctatatggaagggaacgacgtcggtattctctacagtccaattgtcggggccaacctcgtctctgagtcttttgcattcgcttatttaagcgataaggcagtgaccccaacaaacaaatttttcaaacatccgaacggaaatatcattggaggatttgggattgtacaagatgtacctgtctgctttgaagacagggaggcaatcttggatttccacatctttgaaatccaaggctttgacatcctaatcatattgcccattgagcaactcctaatcaacacaccccgattaggtagcctcaaaataacactgggagaaaatgtattctcaattccattctcacgggcaaggatcaccttgaccgaccctctcccagaaattgagtcagcggaagaggttaccgcagttccccttcatgagtctcccgaagcccttttggaagatgagttccccaattttatcaaagaagaagcagatcccggtgagactctcgacctgccaatcatggaaccgccacctcgacctccgcttgagcttaaacctctacctccaagcctacgatatgctttcctacataatggcagagaggcccctgtcataatcagtgacaagctctctgaagacgagactcaacgtcttctcgccgtattggaaaagtatcgttctattcttggctactcgcttcaagatcttagggggaacctcaacgatggctcaataatgcaatgcgagaagttgtaaagaaagaagtcttgaaactcctgcatgccgggattatttatcccgtaccatacagtgagtgggttagcccagtccaggtggtactaaagaagagaggaatgacggtcgttgcaaatgctcaaaataaactaattccgtaacgaaccgtaaccggatggaggatgtgtatcgattacaggaaacttaacaaggctacaaaaaaggatcatttcccgctacccttcattgatgaaatgttggaacggctggcaaatcattccttcttctatttcattgatgggtattccgggtatcatcaaattcctatccatccggaggaccaaagcaagactatgttcacatgttcgtatggcacctatgcataccgtaggatgtccttcggactatgtaacgctcctgcatctttccaaagatgtatgatgtatattttcttggacatgatcgaagacatcatggaagtcttcatggatgacttctcggtctatggaaagactttcggtcattgtctgcaaaatttagacaaagtcttacaacgatgccaagaaaaggacctggtgcttaattgggaaaagtgccacttcatagtccgtgaagggatagttcttgggcatcgagtgtccgaacgaggaattgaagttgatcgtgctaaaatagatgttatagatcagtttcctcctcctgtgaacatcaaaggaatctgcagcttcttgggacatgccggcttttatagaaggttcatcaaagacttctctacaatcgctaggctgctgagcaatttactagccaaggatgcgccctttgagttcgatgatgcgtgcctaaaatctttcgaaattctcaaaaaggtactcgtttttgctccaatcattcaacctcctgattggactctgcccttcgagattatgtgtgatgcaagtgatttcgccgttggtgcagtcttgggccaaaccaaggataaaaagcatcatgcaatctgttaggctagcaaaactctaaccggagctcagttgaattatgcaactactgaaaaagagctgctcgcggttgtttttgctatcggtaagtttagatcttacttagtgggagccaaggtgataatttatactgatcatgccgctttgaaatacctgctcactaagaaagatgctaaaccacgcctcttaagatggattttgctgctccaagaatttgacttagaaactaaagataaaaagggagtagaaaattctgtagcagatcatttgtctagactgcagatcactaacatgcaggaacaaccgataaatgatttcatgagagacgacatgctgatgacggttcgtgactctaacccgtggtatgctaacatagtaaactacatggtatccaagtacataccaccaggggaaaataaacgaaaactgaaatatgaaagtcgccgtcatatatgagatgagccatacctatatcgggtctgctctgatggcttactacgaagatgtgtgccaactgatgaaggacttaagatcatagaacgatgccacgcctcaccctacggtggccaatacggtgcattccgcacccaggccaagatttggcaaagtggtttcttctgaccaacaatgtacgaagactcaaaagaattcgtcagaagatgcacaagctaccagaggcaaggaggaatcactgctcgcgatgcaatgcccctcacatacaatttgcaaatcgagatatttgatgtgtgaggtatagacttcatgggacctttccctaagtctcgcaactgcgagtacattctggtggcagtcgactatgtctccaagtgggttgaggctataccgtgcaccgccacggatgcgaagcatgccaagaagatgttcacagaaattatcttcccaagatttggtaccccggaatggtcataagtgacggaggttctcacttcattgacaaaaccttcagagaccttctacgagaaatgggagccaaacacaacgtggccactccttaccatccacagaccagtggtcaagcagaaacatcgaacaaacaaatcaagaatattctgcaaaagacagtcaacaaaatgggaacaggatggaaggatagattgccggacgcactgtgggcttaccggacagcatacaagacacccattggaatgtccccatatcagatagtctacgggaagtcatgttgactacccgtagaacttgagcatagagcatactgggccatcaggaattggaacatggattttgagggagcaggagaatggagaaannnnnnnnnnnnnnnnnnnnaggaatggagagagaaggcttaccacaatgcgaagatatataaagaacggacgaagtgctggcatgacaaaagaattgaaatcaagaaattctagccaggagacaaagtgctaatgttcaactccagggtaaagctttttggccacggaaaattgcgcagcaaatgggaaggaccgttcaatgtcatcgacacctctttgcaaggggcaatcacactccgtgacgattcaggtaacatatttaaggtaaacagtcaacacttaaagattttccttgagccaaatgaaactttagaggaagaagtggatgttattgaattaattgtttatgaaccatggtgatctcatctaatgcatgcttaaaaccatgtatagttgttatttttgtgcttagcttagaaattagtggcaataggaagaaaggtggcggccagccgggcccaccagggcggccgaaccagggcagcacccgttcggccccatttttgaatgatagtctcccccgctagtcctgagtctattttgatgccagtttggaggtagaacgatcggatcacacccctgaagctagttcctctctttcttcctcccttgcaaaagcttctctattcaatctgccattcacccccaagaccttcgatccaaattctttgaacctctaatggctagcaaatccttgattccattcatcggctcttcatccaattccacatacaacctcaccggagagccgacactggcaaatcaattgattccggtggaagaatacacgatggaaggggcgaatgctgtatgggctcaacccctttagctgtgccaggctccccagcaattttggagccgattagcgagctccctggttcggccgaaccaggggttcggcccctcgttcagcagagcgatccctctcccctcgccatgtcacaaggacaaaaattcggggggattcgcctgcgcgatggccgacgacgggagagttcggcttgttaaaggcacgacgcctttccgaagatgacgggaaggccgcgccacgtcccgccgagcgttatgtgggcaccttgttcaccaaagcaggggatgaggtgctccacaagtataccacacccaccactactccatccactccgaaggaggagcgattccgtattcagggagtgcgaactcccggcggtgggtatggtaagggtttactccggccattgacggcgtcggaggagggggcagcggaatcccgtagccctccacctatgaaggtgaagcgtcatttgatgccccctccaattgtgagggctcccagccaatatcaagaagatgaggtgaagtcgctggagccctcgatccataagctcgccgcacatgtgaagaaactccgcaaggagaacatagagcttagggattgcaacgcggagctaggggtagagcttgctgaaattagaaacaatttcgacacccttagtctcggtttgtgcgcttaaatcaagcgtgcattcgtagagctgggaaaggaaaataagtattatgctaattagtcctttcccatgaataaaatggtagtaggtgcttggtttttattttccaatcatgtaagcacttgctatgaataatgtggcacattggtgttaaccccaatgtttgccaaggtttgtttttgttttatgtttaataaagattcaggttttgaataagtgtggggagatatcccagcttctgacgtgcatatgctctgaaaattgatgaaatctctgaacacctgaaagcactcaactctgcagaaaattgcaaagggattgggcaccagagtggttcggccgaaccaagactggccccaacctctcccaatttttacaggtaagcaggtgagcacgtcttttatctgtatatctccaccatggtatagtactagagctgaaaattcagaaaacaattggttcaagcataaatgaaagataaaacttccaactcatgaaattcttcatgtgattgatcttgtatattcattattcccagctgaacttgtgtttgtgaacaaccatccatgtttagggaaccttatgcatctaagtaattgctatatgagagatgattcgagatgaaaggaattcttgcaactcttgttatgactcttgggaatttgttttcaaaataaaattgttttaaaagctcaatcctctaattgacttcatcttatgcctaccaagaccatatgcaagtatatcattgatgaaccttatcatgcatatgactgcttgacattatattgagctttgtcaaattcgtgtgactcatgttagatatccttcatactctcatgatcaagtggtcaattccactttcatttccacatataaaattaagccaagcttctacactgaaagttggctttccacaaaaatatccattcaaataaactcctacattgaattatactttcttctccttgaaaagttcttggcaaaaagaaaatgataaaaggagggaaaggcatggctaaaaaaaagagaaggaaataaagcttgctctcaaaacattgagcaaagttggaaagaaaaatgtagccatgccccttccacaatcatgccaagagaaccaatttggagagaaagtataggaaaaagggataatcatttctttattccaccattccacaacatattttactttttcattttccaccataaataaagacccttgatctaggagtatgatgatcttcttgagtccatatttttggctttgcaatatatatgatgcaggtatgtcacagtttatccctaccaagctccacatattaaccttagaataggaatgaattatggcacattttgctttggtaaggatccaaaaagaaaatatacattcttgagagacaagagaggaagtcaataggagaagagcttatttgcgaaaatttataaaaaaatcccatgagtgtaacagagaagcaagaaggactagaatcaagatcgttccatttatcaattactcaagatggtaagatagccactgataaagttcacaggtgcaggtatggttgtgaatgatttatatgcttgattcatatcttgaagaaatttattctacactaacctttactcagggacgagcaaagggctaagtgtggggggttgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaacagcggaagactagggcgacgaccataggcgtttgacggcaggcacgagctagacaccaaagccttcatcttccaggggctcctcttctgggtttgggaaaaattgagcaagactgagtacaaccaccgtactcaacaagacacacccacaagtgcagaataaatgcaagggagtacaagggggttataatataaagggttagggtttgcagtaaacagcattaaaagacacttagttgctcaacgctattttgtaaacacgattctagagctatacaatattattaaacaaggccgtgaacccacacgaacctgccttaacccaagg

SEQ ID NO: 40748 - DNA, 1298 bp, Oryza sativa
gacatagtttccaacccatcctagccatagacaagagtaccgacccaaccccacctacggcgggaacctctgggacaggtaggcaggactgagcccctagtagcaggacaccggccctgtgccatgacatctcgactaccgggccgcagctcatgtagccttcatttgccctagagatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccaagcccagcctaaaaccattttgagggttttgaatagagggggaggtgtgaatccaattccacaataatccaaccattccatattgtccaggtgatgagaatattcccaaagtctagagttgtaaaaccacctaatgttgcctaattaaccagcgaagcatctacctaaaatcatactagtggtaccatgagtagagtgtctactagttggggttttgtttattctagggtgaacaaggaaatattaacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgaagagcggatcttccgaagctgcagcgtctacaagaccaacggaaaagaaaaggcttttactctaataaactccatataacaagcaggaacaaagcacaaaaatgggttcttgacttcttaaggaaaaattagaggcttgaacggtccaattccgagttcaaatggccaagttatggctatttgaagtttatatgctctttaagtgaatatttgcgaatttcttcatttaaattttaatttaaaaaaaagtttattgcgtcagccgaggggagggggcgcgcggaccgggtccacgggagtggggcccacgcggcagcctcacggtccacggtggaccaggtgcacccgggctcacaccggccgacgccgtgggccccacgcgtcagccgcaccagagggcgcgggcggctgacggccgggccccacgcggcagccgctcggtgcgcccgaaggcggccacggcggcgcggccggcgggaggcggcgcgcccgcgcccctatgg

SEQ ID NO: 40749 - DNA, 1659 bp, Oryza sativa
tcgatcgccataaccgcgggcacggctattcgaatagttttactctggccagaggtgcacaactgtacccacaagacacaacccaccgacatgtcaccgcgtcatcatgtgcccatgatgctcacgtcaccatgtcgagtgattgtgacgagacccttcgcataaccctcccctaaccatccacaccacgctaaggtttcacccccactcctcaaaaggcagtgggcggtcccctcttgcgccgcggtgaatccggcagctagacaaccggacaccccggccgacccaactccatcacgcccaccctcgccaccggtgcctaggaaagggtcgagctatacttcagatcaagcggttacccactcccgcttgtggcaagcgctgtaagacttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaaccctaaccccatgtaattagcaaaacatgcatgtttatttgcaaacagtaaaacatttataaattaggatcaacatgctcaaggggaatgtgtgacttgccttgcttcttcacttggatcttctgaactcttatcctcgcgaccgcgaacttccgaaacgacagattctacacgctggcacgcaaaacgaggaaaaactctaataaaaaccaaggaaacagtacataaaaactaaacaaacatgtagagctcaattttagatgaattttgcaagttgaatggctcaattcagagttcgaatgaattagatatgaattttagaagttttgagccatttaaatgagtttctagaattattaacgaattatgacgcaattattatttatttttccaaaggaaaagagggttgctgacgtcatcaaaggggaggggccgcgccggcaagcgggccccaccggtcagcgtcacaagggcgccggtccaccgtggaccgggaccaccgaggcggtccaccgccggtccacgggaaccgacggcccggattggcccaagccgatcggacggccacggggcgcgcggctggggcacggtcacggctcaaagccggccagccgagtgatggcgcacggcagcgcggccaccggcgacgacggccgacgacggcgcggggagcggcagcgcatgcgggcggtggcggcgcacgctagggagcggcggcgcggcgcggtaaggtgaggcggcagccggctgcccggcacagccggcagcggcgcggagcgcggcggcggcgacccggtcggatggccaccggcgacggcggcgcgtcccgagcaggcacaggaggtggccgaccaaggggaggaaggggagagggaggggagtgctcaccgagcggcacgaccgcaaacgggcggccgacggcaaggaacggcggcggcggggc

SEQ ID NO: 40750 - DNA, 1438 bp, Oryza sativa
gggagagcagtacagggcgcgagaagctcgggaaaattgggggaaatggaaaggggaggccggggatgctttttatgggcttggagtgacgggatcatgctcgagagaggtggcaaccggccggcgagatgggcggggcatcgtggggtggtggagaggttaaccggcggcgattttcatggggagagtggggaaaagggtggaggacgtggggcgacggggtcccacgaccggcgggcttgcgcgcggggtggatgaggtcggaaacggcggcgtcgtggggtggctcgggcggccctggcggttgcagccggccaaccagaggtaggaggaggagctgacaggtggggcctcgggtcccacctgtcggggagagagagaggggaaaacgggcgagggaggtaaagcagacttgagggagagagagagccgagcgggccgagggagaaggccggcccgagagggagagaaaaagggcgcgtgggccgcgggagggaaggaagacttgggccgaaaatggcccaaagagaggaagggggaattttatttgttttctttttattttaattgatgaaatgaaatttgtgctattaaaactatttctcgagctccgaaaattcacggaaaattccggagagtacattagggcacaaagaatattacaaaatattcccggccaatgatttttaaaggaaatttttaattccctcaataattcacttgattaagttgatttaacttttatttaatttctagaaaatgtattattaattgatttttattcccgaacgaaaatcggggcgttacagcttacaagttatggagatggtcggagctaaacatgtggaggcttttggtgattcggaattggtggtgcaacaagtcgccggagtctacaaatgcttggacggatcactaaataggtaccttgattaatgtttagatattattgccaattttgataattttgctattagacatattgctaggcatgataattctagagcaaatgacttggcacaacaagcatctggttataatatgaaaaagggataatttctggtattagtagagccggtgcttgattttaaatctttgtgcgatattggcaaaactggagaccaggggcggtctgaccggcgttgcacggccggtccgaccagtgaccaggggcggtctgaccggccgcatgtcgccggtctgaccggcgaccccgtgcggtctgaccggccctgtgtggccggtctgaccggttctggacagagcgctggggggcaagtttcaatcaatttggaagccgaattaattgtgaattcgtacatttgtgcctaggaaacagaagaagattggagaattcctttgattcaatatttgaaggatcccacacttaaggttaatcggaaaattcggcggcaagcgttcaaatacacattgcttg

SEQ ID NO: 40751 - DNA, 4050 bp, Oryza sativa
attgcaagcatcactagttctcctctattttagtaatattgacggtcgaaattgatcgataacgaccgtcaacaatgatttcaccggtaggattgcaagggggtaactcctcctttttatattagtatagatgcagctcgactgtgatcaattaaaaaatcaaactaaattcacagataattatgataccataacactgataattacttcattgccatagtttcgtgccaatataagcaaatgcacaagcttgatttctttacatgcatgtagtacaaggtgagtgttaggtcaacacaagaagcatactttattttacgtacatcgtacggtatattttctattgcataatttgttgaaacaataaatacacaacaaataatggaattacacgtgcaagtttgatgtggattagcaagttttcattattggtcattgtggtttcctgatttttctttacacatacaccaaaattattttttgacttaaagtattgccatggctttgcctcgcaatatgattttcatttaaagcaaaatatttacaaaacacatacaccaacatttattaaccatcttgaaattttgatattaaagcatataatttttttggttttcataattcttcacatacatttattctcacattgcaaatcatcttgatattttatttcagtttgaaatctatcattaacaaaacatttagagtaggttgtatatattaagtttattttttatgttatctaggccatttgtggattctgtacacacatttgtacaatatttgccgatttttattagcatatgctcacagttttgagtgattggtattcaactatctttgctgttccccattttactgcatgattgcattaaaacacatgccatacattgttaaaaaaagatactcctatgtagttactcctacttttgaatgaatagtacactatttggttggtacaaaatatacttgtgagtgaaataccataacaagagctatgcccccaatctaatacgagagatagtaactcaaatcaagaagaaaaccattgtgtaaaaattgtgtgtaggtacttttgatatgaaatgtatttgcatggtaaagtaaaattatacaactctataaaagatactcccactatcataagaattttatttacagagaaacacaaaatagccatgtagcaaatgcgtgggattacgtctagtatctcaaaatattcagtgacaagtttattgcaatactccatattccatcatgttattttaatatagttgaggacctacctatacaaatttggagttttcaattaattcaatgctaagagcatctccagtagaggtcctaaacacaacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagcccccatccgcggcagagacgcacgggcacttcttttttcgtgcgaaatatcctgctagcggcgcctccacggatctacgccgctcctcctggccggcgccctcctcccctgccggcgccctcatccttggtggcgccctcctccctgcccgtcacactcctccccggtaggcctcctccttcccaacgtcctcctccttgccggcgcggcggcaccctcctcccctgtaggcatcctccctggtgccctccttcctggccggccacctgcccacccagcaatatcctccctagatcctgacgcccttctccctggcgctagttgaaggtatcatgttttcatttttccagtggatttgtggattgagttatatggtagcacctagcgtgttcgagagaaaagttgtcagtacgaaaatgtatatttggagaagaaatgggtaggaactaaccttccacgatgagatggttttgtttttttattatgtgattttgttttcctcaaatttttgactattaattaatacaataattaatctcataatccatatgtaatacaaatccgagacgaactcgaatccaactctttccaaagcgatttagccaaagattccaaaggagaaaaggtagaggagatcccggagattgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcggctgcggcggactgggccggctgggccgaggagagagaagagaggttttgggccgaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagactttttaaaattatttctaaaaattccaattaaacaacaatttacatattttgaattttcagggtgtgacaaacctacccccctaaacagaatctcgtcctcgagattcagaagaactggcgaacagatgcggatgagctgacttcaattcatcttctcgttcccaagttgattcttcttccgagtgattactccactggactttgcaaaaacggataactcgatttctggttcttctctcacttgttgccaagatacggattggtttctcaacataggtcaaatcctcttggacttctatctgttcaagattagcttcttcggtaggtacccttaaacactttttcaattgcgacacatggaacacattatggactcctgccaaagattgaggtaactccaactgataagcaacctctcctcttctactgacaatcttatagggtcccacaaaacgcggtgccaattttcctttggtatgaaaacgatgaactcctcgaaaaggcgtgacacgaagatacacataatctccttcttcaaaactcaaatctctacggcgattgtcggcataactcttatgacgagattgagccactcgcaatctttcctgaattattttcaccttttcttctgcttcccttaggatatctgtcccgaaaacctgacgttctcccgtttgatcccacaaaagcggagtgcggcacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatctgatttaccctttcggtttgtccgtctgtctgcggatgataagcagtactaaaattcagcttagaaaccatctcttcctgaagcttcttccaaaagtttgaagtaaactgactgcctcgatcagacactatcttcttagggacgccatgcaaacacacaatccttgccatatacaattccgccaatcgacttccagaataagttgtctttaccggaatgaaatgagccactttggtaagtctgtcgactattacccaaatagagtcatggcctgatgacgttctgggtaaaccagtgataaaatccataccgatttcttcccacttccattcaggaatcttcaaaggctgcagcaaaccggcaggtttctgatgttctgccttgactcgctgacaaacatcacatactgctacgtattctgcgatttcacgcttcatacttgcccaccaaaatctttccttgagatcctggtacaccttagtactaccagggtgaatggagtataaagtatcatgagcttctttcagaattgcatcttttaaatctttgttgtcggggacgcaga

SEQ ID NO: 40752 - DNA, 6454 bp, Oryza sativa
cattgcaatagcctttcctgctaagagcgtctgctacaacattagcctttcccgggtgataatgaattcccatgtcataatccttaattaattccaaccatctcctttgtctcatgttcagatccggctgagtaaagatatactttaaactcttgtgatcggtatatacctctgtacgagtaccgaaaagataatgacaccaaatcttcaacgcatgaactactgcggctaactcaagatcatgagtagggtagttcttctcatgcggacgtaactgacgagatgcataggcaaccaccttcccatcttgcatcaaaacacaacctaacccaagtttggatgcatcgcaatacacttggaaacccttctttggatcaggtaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtcttcggttgtttccagttggttacggattccacattactaggatcaacggcaactcctcctgctgagatgacgtgaccaaggaacttcacttcagacaaccaaaattcacacttgctgaacttagcatacagttgatgctctcgtagcttctccaatgcaaggcgaagatgttcttcatgttcttctttggttcgagagtagataagaatgtcatcaataaagaccaccacgaacttgtctaggtattccataaacaccttattcatcaagttcatgaagaaagcgggggcattggtaagtccaaaagacataaccgtacattcgaacaatccatacctagtggtaaaagctgtcttaggtatatcttcctctttgattctcaactggtgataccctgatcgaagatctatcttggagaaaacggtagcacctttaagctgatcaaacaaatcatcaattctgggtaacgggtacttattcttgatagtcacatcatttaatgcacgatagtccacacacatcctctgggtatgatctttcttttccacaaaaataaccggagctccccatggtgatgaactcggtctgatgtatcctttctgaagcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcgggatactcccggactataggaatctcttccaaagttatttgattcagtcttgaccttaaagactcagaagacaatgcatgaacagttaccactcgaccatcattactggtgagagttacttttctgttggcacagtctatcacacctctatgtctggctaaccagtccatccctaggatgacatcaaggtctttggattctaacaagataagattggccacaaatggtactcctttaatttctattctgaccgaggggctacgctgcaaagagagtgcttgattacttggggtactaaccatcaaaggatgtctaagatcttctacttccatcccatgatttcccgcaaaactcatagataagaatgaatgtgtagcacctgaatcgaaaagtactgttgcaggaactgagttaacagggaacgtacccaaaatcacatctggagcatcttgagcttctgcagcagcgacatgattgacacgggcctttgatgctggtacagcagagttactctgggcagggacaaccttcacgcgacggggcttcggacacttgtcagcataatgtcctgggtctccacagttgaaacacaccacgggcttgctgccttgctccctcttggcaggctgttgctgtgttggagctgcaacaggacgtggagcttgattgcggatgttgttgccagcattgttgttgaagaactgacgctgcggacgaacaacagacgaagaacctccctgtggcatagactggggtcctaaagtaaagcgcggcttctgattactcccctgttgtgccttgaagtgagcaatccgacgtttcctctgctccatgcaattgtacttgtcctcctgacgtatagccttatccactaatttctggaaatcaggataatctccaaccatgagtgggtaagaaagctcgtcattaagtcctcccaaaaacttctcctggcgctcttcatcattgcgcacatcttccggagcataacgagcaagacgattgaactcgtgcagatactccgtaacagagcgagatccctgagtaagcgacctgaactccttcttcttgagagacactactcttgatggtatatgcgtcttccggaaagcagcagtgaattcaagccaagtgataggttcagcagtagtcctattcaggcggaagtgatcccaccattcagaggcagagccatgcaactgatgtgatgcaaaagataccttctcctgatcagtgcactgaagtaaatccaacttcttctctatggcatgcagccaatcaccagcttcaacaggattagtggtactagagaaaataggcggcctcacacgaagaaattctgctaacttgttctggggaggtgcatggttatttccttggttctgctgattctgaagttgctgcatcatcatgttcataagctgtgtctgttgagcaagaacttgggccagagttgggttctctccattgttattgttattggggttgttgggaccattcccgttgctgcgagtattcaccatctggcaggaacagggcacaagaagagaaaccgggggaaaactacttaggatagagaattactttaacttttattgatcttaactgagtttcattattacaaactgaagactctcacaccactaaactcaccaacttcctaacactcaaaagcaaacaaacgcatgcaattacatcccaccactgatgtaaatcacatgcgagccacacacaagcaaacctaaagcaaacaaactaacacaacgatctaagacaacgacttaacaagtcactctagttcttccaagcatcggaggtcgattgaaggctcgttcggctcgtcttcatcatcttgggttgctacccactcaatcttggaattggtgcgcttggattcttcttcttcatcacttatgatgatgaccggaggatccgcttgggatgggcaacttctttctccaccacacgaacctttggcgccaattgatagcgagggacgaatagagctctcttccttgcggtaagacgaatcctggccttctgcggtggtgcttctcccttcaatgcggctagctccttctccaaacgatccaccttgtcttctagcttgcaaatcttaccacgattccggtcttcacgatcttgagctgctaacacagtctccgcacgactttcatccatagcccacagcatctcaaccaaatgccttgtggtagcatcattctcaattccttcagtctcaaggtagctgccacggtcacttccctggggttgacgaggatggtagcgatactcagtgtcggccaactgatcactgtagctatcacggagttctcctatggcgatccttgccacttcctgacatgcatggacgtagtttcttcctccagcttcgaacatcactgaggggacctcttcactattgctgtttaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaggcttgtagcgcggcatctaaagacaagtgaaaggagagagttaagacatctatccaattaacagcacaagtttttggattaacttgaataaaatttgaaaatcaaagtaaaaggtaagtaaataaagtaaaccaaacttgcaagataatttgaaatagttgaaaacaaggttacaaattttgtactttttaacaacaagtttcaaaagaaataaaagaaagttataaaatcatcatgctaaatttattttattgcagcaagattaaataaaacaatattgtaaaacttttgctgataaatgagccattagtacagtaatggatgtacagtactaataacactggaataaattttgaatgagaactattaaaagagattatgaaatgcatgtgccattagtttggtttaattaaaagagaaagggaggagaacagttctacttttccaatatttttagagggcttctatgggtaaccatttggcataacctagggtcaaggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaataaaataaacggcgcagacggctccactccacaggcagcttgaccaaggctactcctaaacctccactccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaacaaaacagttaagtaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcacataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgtccatcgtgaactatcaataagccatcatgaaataatagtgaatcattagttatcccataagtgtgctaaggtttctaagcagggctaagcaattatatctaatatctagttgaaccaatataaataaagctcaactagtcaaattattataacccaaggtatcaaggaataaagtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagtacataaacaagcatgaacagtacatgtggatatttttaatgtgtagatctcaattttagaaaaatttagagacttgaaccaactaaatcggatctaagatgaattagttatgaattttttaaagatttaatcggattaaaacacttaaatcggttaaaattgaattatgacgcaataatgaattatttttgaaaaggaaaagagggtttattgcgtcagcggctagggttttggtggaccgagcgtacgggcggcggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggcggcgcatgctcgccggcgaacggcggcgcgaggacgcaaacggagggcaccagcacgtagaggacgacgcgacgaacacaccggtgaccaaaacggcggcgga

SEQ ID NO: 40753 - DNA, 2664 bp, Oryza sativa
aagaacaaatccgagatgaactcgaatccaactctttccaaagtgatttagccaaagattccaaaggagaaaaggtagaggagatcccggagattgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcagctgcggcggactgggccggctgggccaaggagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagactttttaaaattatttctaaaaattccaattaaacaacaatttacatattttgaattttcagggtgtgacagctaatatggttttgggaattgtaagttttggatagtgctatatggttttcagtgtggtttttaatatgcatgactttgagacactatgccagctgaaatcttgtgatcgtattctagagggtatgggtgtagtgctgcttaatttcctgagctacacaattttatttgtaccgacgttagttatatgcaggttcttcgagtagactgttaaaaaagagaaaaaaaataagctgctttggggtgctatatggttttctttttaattcaattttgtagagctctagcataacctgttctaaattctaatgattagaaaaatttgctaccattatgcattctaccaacatatattagctagtatctgccatttttcctgagattgattggagaagttgtcaatttatctacttattgcagtgactagattgtgatggcaaatgaatgtgattcctttgtgtgcatgatgtccgaagagacccatgttgaggcatattccttgccaatgcaaaatgaagaccttcatacttcaacaaatggtgcaaaaaggaagagccaaaagatcaagcaactttaatcgtaaggaggacattcaactgtgcatttcatggcaaagcattagctcggatcctattattggcaatgagcaaccagggaaggcatattggcaaaggattgcagagcactaccatgctaaccgtgattttgagtctgataggaatgcaaactctcttgagcatcattggggtaacattcaaaaggaagtaagcaagtttcagggctgctacgagcaaattgagcgtcgacatccaagtggcataccacatcaagagcttgtaagttaaattgttattcattattattaataacaatcttgtatgtatgtgaactaacacttgaattttgcttcaagttcttgaagccgaggcattgtattcatccaatgcaccgaagaatagggcatttcagtttaatcattgttggctcaagttgaggaattctccaaagtttcaaactctagaatcccacaagaggccaaggtctaggaagtcttcgaccctaattgagagtgctggtgaagaagatgaagaaggagatgatgctaggaagagtacaactcctgatttattacagccaagtgctaaaaaaagaccaatgggtaggaagcaagcaaaggagaagatgaagaatggagaagatggaccatacaaggaggcgatgaaagatttgcttgacgccaaagagaaagaagctaaagtgaaagaagagagatggaaggaaactaaggagattcaagagcgcaagctcttatttgctgagcgtaagttagtgtgggatcaagaatagaagatcatgttttgtgatgtttccatcttggaactagatgtgagaacatatgtgttggctatgaggacacaaattgcagcttcaaaggtggctgccctcaatggtggatttgatggtagtagtggctttggaggtgagtttggtggcagtaatggagaagtttgagcacttcaatggaataagttggatcgttttggatgatccatgtgtcctttgctagtaggatatgtcatttccacgattggttcttggagtccttttgtgttaatttctgcaattatctaagtgtcatttgctagtaggatatatactacttttagatttgctatttttatgaacgaaccattcattcttgtagggtgtgttatttttaaattatataatgcatctccgcaaaaaaaataatgcatcactgggttcacatagcctattgtggtgatatggagacagccaatgacatgttggtgagaaatttttgttttcattggtgaactataaattttggttgcatgttgttgtatatggcattctgcccacaccatatttacatgtttgaaaattttgattttggttctgaattgtggcgtttgaaattgtaaatttaactatgtttcaattatacgcgttagaaatatttatgtttaattattgtggtgttaaacatagtgtaaacaaggattgcatgttaaaataaaagagaaacatgagtaggggctaaaaa

SEQ ID NO: 40754 - DNA, 23990 bp, Oryza sativa
ttgttacggctaaaatataatgaatttgacgttaagattttaaccctaggtgtaatacaattgaaagtatgtgtatgattttttctagattttttggtgacattttttagttggtgtgcacgtgtgtacacgtgagggcatgtgtgcataggatacgctcccggctttaaaataaggtttattgctggagatgctctaaaacctcttgttttgtggttctaaattttgaatttttagttttataacaaacttgagctatggctagtttattatgaattttgtagtcttgtaaatcttcgtacataaggaagaagaaaaaaaagttgaaaatagatagcctaaataaaaagaaaagaagagaaatgacgtcggaaaaaagaacacaataaccgacggtggtccccgctggcagcctctcacaccgcctcctgtctcgcctccccaccttgggtttgacctggactggacgtgccaaagccaattccaacaccgccacgacgcgactcacgcctataacgatagcccccctctcttccctcccctctcctctcctctccgcttcctaattcccctctgcatcctcctgctcgacgaggtacggacaccccccgctcttcctccctccctccctcccccgcgcctcgcctcatcgaatcccctgtgtcccgcggggattcggcgccggcgtccgcccaattggtcggcctcggctcgggagaccaccgattcagcgcctcgacttggtcgggctccccgcgggatctttggtggttccttttttcgggggattgttctttcatgctggctgctcgattcgcctcttgggggtttcgatccgctagcgttagttgttcctagggtttcttgggcgatcgtctgggtcggtaggtggattcttcacctagggtttctagtgaaattgcgtttaggttttgggatgatgttgtgcgccggcgatgggtcgagcagctttttgggttgttacggtcgcggaagcttcatcccgtcgtggatgcagcgtagttcctcggttctgtttaggctatttcccccctttagcgcggtagttgagtgtggtgtctggtaggctttactttgtactactaagctgcatgtttttacctcttgagatttggtgttgacttcttgttaattcccctccgcagcgtagttgaccccatatgtgattgatggatgatgaccgttccgatggataaagctactgcttccccatcatcaagggagcttgcacagcggctcttaaagaaggtttgctcttttcaatgtttctgcaatctgcattgcctgtgagtttctgtagtagcatgcaaggaaaagattaatggtatatgtgtgaagttgtcatgaaccctcttcaaacagctaacatgcaactgtttttggcatactgtggtcctgtgagctgagttgcgcagatgatctcctgtcaccatccatctcattccatgtttacagtcatctctatgtgactgttccttctgtccttcgtcccagacattgcttactgagcgttgactttccctatctgtgtgtgctatcgctgtatacatcgcattgctttgtcttcctcgcaccagatcatacgatcctatctaatgctcactatttcatctatctgtaactgcaattgtctaattgtgtttgtcggtttgtccagggctgttatattttcttgtaaacaatgcaatagttacatctttggttattttctttctcctaaaaacatcttttgttacctgcctttgtcacctgttcatgcatgtgtgtaggacatttttctgtatgtacttttaccattagggaaaatgcagcagaactgtgcacattatgtcttgtcccctttgtgatatgcccttggttctggcttcttcccatttataccgcattcgtcccacggtgctagttagcttgcacattaatcgatagttgcacacacgtgcttgagttgtaactgaacttttgtgcccacaaatttccatcccctttaaacagtttcacttgaccaaatgaaccacattagcatggtcagcattacaatttgcttgattgaaaaatggaaatgttccaggtgatgaatttaaaacattcacttgtattaaagctaacagttttatgttcctgtgctttgtgatgtggcatttgctagctacagctagctgtgaagtggattaattatggggcaattatttagtcatattggtaaatagatatagagcaaatggggtggtagctatatattttatatttcatgtttgtaacatatgtattttgtggtatatatatgggttcctgtgttgatggggtaaactgtgtttcaaacaatgctgtatttttaattcatatttgttgaagccttgtggaaaaagcgccaagaagtgaaaaacctctgtataatctactactagttggcatactggaatgtgtattcgttttcctctctgtgggttaatgctatctgacgatgtccgagagaagtttatgaccataatcacgttgttcatggaactgagttaactttaaactagatgcagatttgaaatgtatgtgatctccaccaaatgaaaaagctgtccatggttttgtggaacagttgactgctcattgttcataatatgtatatagataggtcaccttttttggcttctgagttgagatgttaaagcttttagaattttgatgtccttgatctagctttggagtgcctatttccttttactatttattggatgcatatggcctatttccttttactatttattgaatgcttatgtctgttccttttaattccttcactaaaattctctcctggtgctttcacatggtgtttcttccacttctatagtttatttcaagacatgaaaccttatgttgaaatagatagtgtatacgagtgagtaatgataatgatgttacttctgcagaacgctgaacatgaaagtcgtctgcgaaggtcagcacagtccaaagtgccatcagatcctaacatatggtttcagatgcgtgagaactatgaaaagataatccttgcgtgatcatgacttctctgaaaaacgtgagatagaatatcttctgtggcagttgcactacaaaagaattgaggaattccgagctcatattgtctctgctgggaagaacaatgccaatcctgatcggatcaagaggatcagatcttctgttagaagtttcctctcagaagcaactggtttctatcatgacttgatgctgaaaattcgggctacttatgggcttccgttgggctacttctctgagggtcctgatagttctgttgttcctgataaagatgggaagaaagtggttggggtgaaaaaaggcttgttgtcatgctatcgctgtttgatatatttaggagatcttacccgatacaaaggtctgtatggggatgtggattatgcaagtcgtgaatatgctgcagcctctatctactacaaggaagcagcttcgctgtgcccttcgaatggcaacccacatcatcaggtatgcagcatgtcgctgtagtaattttctgcaccattagtacaaaacttgttttgtgtgcttgaatggcgatggtactgatgaaaaggtttttgtgttcttgctcagcttgcaatactggcatcatatgctggagatgaggtaacagctatctataggtacttccgtagcttagctgtggataatcctttttctgcagcgagggaaaacttgattctcgcatttgacaaggtattatgctaccttcatgatactactttagtatgatccttgttttccagtattgtgattgggtgttgaagctatttttccttggtgaaccttgaaatgatactgcatgattttatctagctaggagatagtcgatcttgttggattccgttgttcaacagtttgtacacagaaaattcgtatctttactggtgtttagcctattattatccacttgtggaattcttatttagactagaaaaaatgcccgtgtgttgcaacgggtgaaggctattttagtcttatttttattgttatacggtttatcttgggtgaaaatcattgtgggaattcgcttgtatatatatatttttagaaaatcatgagttgtaattaggagtctgactctcgtctcaagttagcatgcgagtttttttaaaatgatttcttatacgactccttttgtatttccaaaagcgtcccaagttagcatgcgagattttttaaagagatttcttataagatgtcttttgtatccaaaagcgaacgaacttaaaaaccgactcaaacacagatctgtatttctaaaagtgaacgaacttaaaaaccgactcaaatacgaatgacctaccaaaatactgataaaaacatcttcaatttttataatcttatttagattccataagataagaaatgttctgcagtttaccaactgggtcaataaaaacgttcttacttatattattattgtacagctgttctttcattgattgcagcgtgtctttcatacttcctccctagaaaactatagagtgtactccctccgtggggtggaggaagtataatattttgaaaaggtcactttttttttattttgaccaacggttgtcaaattataagtatatttagtgcatagaagttataccaatagattcatccttctaagagcttttataaaacattattagttttataagtattgtaaatatattttataataaaacacatcatataattttctcaaaagacttcttcaaataatatacaccctataattttttgagggagttctttatagtatctgatgcacataacacaagaatggagaaatgcaccgtttagccttgcagtagatttggaccagtgtgtacaagtgcctagggggtttctcctgtcagcttcttattatatttgatgagcaaattcagaatccgaattttgctgtgcggtggatctcaaacgcttatagtttcatatgcagaatcatgatatctatgctcagctatcaggtaatagcaaggttcccaacgctaagagcttgccatccagatcagttggtagggccagaggaaggggtgagacaagatttcagcccaaaggttctagtacagaagaaaattcaaaggagcgagagcacagtattcaagaaatactgaaggctttctatattcgatttgttcgcctcaatggaattcttttcacaaggacaaggtacttcgtaaaacacttctgtgactcatcttattctctctttctttgtctcctaaaatgtcttgcttttttcctctaatagcttggaaacatttggggagttgtctgctacagttatcagcgatttgcaaattcttctttcatctggtccttacgaggagcttaattttggtgttgaggctgctgaaaacgcgctttctgttgttaagcttattgctatccttatattcacagtgcacaatgcaaacaaagacgcagataatcaatcatatgctgaaattgtgcaacgcagagttcttcttcaaaatgcatttgctgcagcctttgaatttgttggataccttctcaaaagatgcgcagagcttcatgatgttgcatcaagtatctacttgccagctattttggtcttcattgaatggctggcgtgccatccagattttgtggctagttctgagatggatgaaaagcaagccgatgcaagatctttcttctggagtcaatgcgtgccatttatgaataagctcattttgactggtctcgcacatgtcgatggtgataatgatgaaacttgcttttttgacatgggcacatatgaggagggtgaaactgggaacaggcttgcgttgtgggaggatgttgagttaagagggttttcgcctttggtacctgctcaaggtatcttggacttctccaccaagcaaggttttggaagtgatggaggtaccaaggagaaaaaagcacgtgtagaaaggattcttgctgcagggaaggcgctgttaaatttcgttcaaattgatcagctgcgaatatattttgatgcatcctcaaaaaagttccttatggcttcagaacctcctcctcctgcttcttctgttcctcttgttgtatcttccaatgcgcagacaacaaatcacatacaacaggaacctgaagtctccagtaaaattggttctgtcgcagaagatctaggtgtgcttcagtcaaaggcacaactctttcttgatggagatgatgatgaagaaatagttttcaagcctccagtttctgaaaagcttccgagagttacttcagaacagactagtaatgagttattacagccagtggtggtgtctgatgtcaattggtcaaatgatggtgcaccaccaccaatgacatttcagagcaatggaccggttctgactcccaatgtttatgttcaatctctcccaatctcttctcttggttgggcagccaatgctgggcaacatgtgattcttgatgttggtgcaaggtcaacatctgatatttttgagtctctgaaagcacctgatcataactgggtaagcactggtgcaccacttgttggctcactggatacagtccctatggcgagcttttccaatataatttcggatcagcgtacacctccatcgtcactcggttgtttcagtaacccagataatacagccatactccctgggcaagattcattcttattgagtgcattaaacaatgttaacataggtgcaagtggatttctggatcaaagagtgaatggtggactcagtggattacagtctgtgggaaatgtgcctcaggtatctgctcaagctactatgaatagtacaaatccaatgattggtcagtataaacatactgaagttaccatcccttctgccttctattcagttctgccgtcagtagtatcttctgatggtgtatcaaagaaaaatcctgtcagccgtcctggaagacatgttggccctcctccaggatttaacaatgcccctccaaagcgacaggatgattccattttagctggcaatggccagcatgttcagaccaatgacggcatctggttggatggctacaggtcatcactggattatgtcaataatcagcgttttgcacattcaaatgttaccactgccagcagtactttcaccactccctttccttttcctggaaaacaagctttcagcatgcatcctagaggtagcgatgaaaaacagtggcaggatttccacctttttgggcccacaaagcaacttccagaacttaattttcagcaagggaaccagcaaaatggtccactggcggaacaattaccagcacaatctgcatggtctggcaattaccttgtgtgactagcttgtaccatgaaggttaattttttttcttgggtgcctcaattttgatagagtttttggatgcagaactcacctccttttgttgtacaaatacactgaaattctctggttcaaatgtattatattctcttttggtttcaggatttgctgagaatctgttgggagtaagtggcgaagattgacacttgaattcggccttgataagtacagccctgtcatgtaatgtttcttttggaagatgcttgtcttggaagcataacaagtgctacccttggaactggtaagttttgaatgcacttaattgtggtactccatttcattttgtaatgcttctattccttgttttgtcctcatttatcagtctctctcttacactaatatctcacctaatacacctcactaacaccatcatctctcctattaccaagaaatttaagtatagtatgggtagcatggtcattttactcctttttcgctttgtttcatactcttatgaatgagaagacgcataaactttatctagccctacctttgccccattagactgtttatctaagattatgtgtttcttgataaatgaataattgaattacatctccttgattcaatcatttatttccttgctaatattaggagttcatttgtaatcccctggagacgattgtctctgtcacaattctttaattgatttataccagctaaattaatagtgcagtttaattactttttagttttgatattttgttttttcctattaatttctgcctcatgatacgctagaatctgaagttattatcaaattttaacttgaaaatttgtctaatcttttaattgaacgtcagtccccaaataattcaactaccaaccacgtgctcagatgatgtaattatccagagaagattcttcaactaataaccaaacgtatcatctaaacaactaatgtatgctaaacaatcagattatgtcaattacagatgtttacctgttgacttactgatttacagggtatggcaggtcttccaggctatgaaggggattttagatgatcccttccattgtctgatgagaatatgtacggagagttctttaacttctcagacccagggttttgacctaatgagtaatctgcaattctgcatacgggcagttactgagatgcgtcaggtaagtccgtggattggttgctgccgtggaaactgaagccttcacgaacgaatggatgaaattctgtttttggtggtactcttgtcgatcagagctatgaataaagttggtgatgactgcttcatgcttgtggatgttctttccagctatattgttcatgtggtacattgttactgcaaagtcattaaatacacttaaggataaatcattatgcagttgctatcatatgatgtgctatggtagcaacgtttcgtgttggtatttgtgtgtgaaccaaatgtattatcagcttgatgagctgatcttttaaaacgtattgacttgtaatatgttgtacagaacgtcttgcttgttttaataccgaatgtcgtgcttgttttaatctctttggttagttgcttaaacaaataattgaaagggtcatttaggtttagaagggggttgttgtgaataggctaatttaaaaactcaattaggtgcggaagctgaaattttcgaatatatctgaaggaggttcggatatttctgaaaatggcagaacagcgacaaacgcaatagaaaattggatctagctagtcacaataaaaaatatcaagcacaaacaatagcaaagctagggaaaaggatatcactgaaatttgttccttggaagtttgaatccatgagggggttataattttctttgaggagctcacaaaaacctggtcttcactgaccttttcctcgagagcttatacaaagcattatttcttccattagtggtatctcttctctttcggaggtgagattcgaccttcataaacttcactatttttttccctagtgatatctctttcttttcggaggtaagattcggccttgacaaacttatgctagctaaccatacgtagattgatagctcaaaagtaacaactagtcttctagcacttcttaacctccaaaagtaaaggatggagcaagaatctcaatgggataaaatacgtcctcaataaatcttcacgaagtcaacacgaaacactcacacgaacttaaatccacaactttcacacaaacgcacacaaagtccgagtttgaagatcgatgcagaggagaaataagagagcaaggctcaaaagtggatctcaatgtaaatcaagccaaagacaataatgttcaatagcaccagcaaccttggcttggaaggggaatgggggtatttatagtcgcattctcagatctgcttgttggtgggtaaatattctctttttgtcatggtggccagatgatgggtgtcctacaaatcgacgccggcatgctgccgagctcgcctccatggatgctagcctcctgtgctcctggcgacgacgcttggtcccggagagccaccgtcatcgtgcctgtccctgcctcctgtcgctccagctcctgccgaaccctatcccctgttgcttttgctgtattgttgacggtgacgcaaggatcgtcgacggctcctacatggcgagacacggccccgccgccagcggcatcccccgcgtcaagctcggcggcacgtggtggagaaagccgccgctgacgactccgctcagcggaaagaggcgaagaaggccaccatggcggtgacaacgaggatgtggacggcggcattgcctccgtcgacgcgtcgccgaacctccttcgccctccggcctcctccccacccgtcggccgccctgccgcttgcccagtgagaacattgagagaaagaggatgaagggagaggaagggaaataaaagaggtgatgaagtgacatcctgacatgtggggcccacgtgggtcgctgatagccaccacgtcagacaaaaccggggtcaaaaccaccgaaggacctaaagtgaacgattctaagtggatggatgtcctatatctggtttttgcggttgggggatgattttgtaactcgatgataagttgagggactttcggtgtactttttccttaattgaaccccattacatttgtttgtttgttttgggtggcctgcaatcgaatacactgcaatcagatccgggcctagtacaaatccgttaccgctccaaaacgagtggtaaagcttaacgatacggagcggaagcaacgcttgtgttgtcgcgagtctcgtgacctagcctaagcgccgccgccgcttcgccttccccacgcgggtcgccggcgcccccagcctcaccggtgttgctccccctccacgcgctcgccaccaccgccgctccccgagtcccgtgcgcgccgctgtcgacaccggagcttggccacctcggcaaggccggtgacctccaccacctccagagtttcgtctctagtccattcatggattcgaccctaacaagcggcttgacttcgccatcttcaaggagactgacctcatcgttcatcgacatctcttcaaggaggccccgctcccctagcccctagccgaagatcctgaggtacacagagaaggtgcccaggaggttctcttaccatcaatcactatgttttcgtcgttttcacggtcaatcactactccttgttggtgagaacccctgctgaaaccatctttttttgtccaactctgcaacctctgaaattttctaataacatcttgggccaatccattcttttaatcagtagtgctcaagatttatgatgatatgctttaatttgatgcaattttcttgtgattgatcttgaagtaagaattaagggatggtttatttttagcaaaagttaatatgtactcttgttcatttgagtggcagcttgatgtattatgtgtgctaccgggatatattctggatataggtttaataattgttttgatttgtatttttttataaattactatggctcatcatcccttcccttaagtactaaaatctggagaagaaatgtaggacttagaaatatgatgattgatattaaatttagagtaaaatacagcagcggtccttaaacttgtcgtgaggtttcacttaggtccacgaacttgtaaaacgtacgtcgagatccctaaacttggtttattgtatcatcccggtccaaagtctcgtttgaccgtggtcttaccaacgtggcacgccacgtggacgatgacatggaattttttttctcccttcttctttttctctcccttcttctccttttttttctcccttcttcattttcttttctctccggcggccgctgcaccacgagctccacagccgggcctccatctccttttccatcagcctctactccactcgccgagccaccgtgccggaggcaagcacgcgacaggagggaggacagtggcgctgacgggagggaggggacggcggcgactcggggaggaggatggcggcgctgacgggagggagggggacggcggcgcatagatgtcctcctcgatctcctccggggtgagtgccaccaagaacggcgcgctttctagcgtcgggacgaggacggcacgggcaccgccgccgcccacaacatggagcggctgggcgccgccgtgtccactgtagcaggttccacggcctcgctgcaccgtccgcttgcggctgtggcagggcgagaagtggaggcggaggcagggccttgaactcgggctcggagtccatctctgcaggtaggctctcgggctttgtcgtcgtcagcggcagcggggggtggggggctaggctggggcacgcggagacggttggcggcgtctcgtaggtgacccatgagcttcacccaaagctcctcgatcccaccatcgaagggagttggcggcggcggctgcccccacggctcgaggtggtgcgtcgacgtcgcggcgggcggcttcgcccgcggatccgccgtcgccgctatggccagcttatcgtcagcagctacggtggcacggcgcggcgcggagaggcggcggtggcggcggccgagtcagcgaggaggagacgagcggcagaggagaggaggttttgaggccacagcgggtccaaaaaaaaagggagaagagaaaaattccatgtcatcgtccacgtggcgtgccacgtaggcaagaccacggtcaaacgcggctttggaccgggatgatacaataaactaagtttagagacctcgatgtgcactttgcaagttcgtggacctaagtgaaacctcctgacaagtttaaggaccgctggtgcattttactcttaaatttatgttttttcctgaagtggcgaggctgtaagtagacacttcaatttatttctcaaatgtaacaaacattttttatatttgtctgaattaattgtatggaatttctaattatttgcaaataagaactaaaaaaagaagtttgtttattaatgttagttttctgttgaatttctgttagttttctgttgaatttctaatattgcagtgttacggagcttccttaaagtctaggcattatgcgtggaagaggcaagaacaaaaggatttgaaggtattgtttgagctttctttggatccaaggtcgaaatcaaaagggggtttcaaaaatggataccgtcaagttctagagagcgtacttggtaagaggttgccaaattcttgccttactgctgttctgcacattgagtcatgagtgatgcactttaggaccaagtttggtgcaattgagtcaagatggtgcagtgcgagaaacaacaatatgatgatcatggcagagtaagtcattgaactaattattgatgattatggttgcatcattattctggctatttttatttcatgaattgatcccagtgacattagatttcatgccattctattaagtatttaacaattaactcactttattttcttatgttaagatttttttagtatcgcacgaaatctcactttcttttactcactttattgtactgcacatctacattgtcagtagatgactaaatgcatgagtattatgtaacctcgcaatatcttgcttttactaacttctgaaattttttattaccagatgaagcaatgaagaaaaattcatgtgatggctatatgtcatttaatctatcagatgctcattacgagattttgaattcgtaggtcatttgacttcgggattagaggcctgcctttatttttcatgagcatgttcattttcagtactttgaaattttataagcttgcactatgacagtttgtaatattgtgcagttggttaaaagacgataagactgctagctactatcataaacatgaatgtcacaaaatctggtactgttgtataaattgcgttcaacagcttggttgtcacaaaatgacttctaaaacagagaaatagaggatttaatttgtgttaggtgctttcaagcatgtgcaaattttaaagttgagaacttttcatatacctttgatgagttggagacattttacttgtttttatgcctatattcttgtgcaattagctatgtaaatcgcgtggtttactcacgtttgtttttttctttattacatgaagatgagatgttaatataatgatgcgtccaattctctgctttgtgatgcatggtgtccaatatttactcgagtctgaagtagatctacaagatcttgttcagagatcttccaggatatgatgctaggctgatattagatacaatttcatgacttctaactagctgctttcaaatatttgcatgccgaaatttgttgagcttctttatgtagcttttgatgtcagctgctattgatatagtactggagtgtatcttccgcgaatgtttcatagcatatgccatgcgcttaattgcatacttgtataccagcttcatttaatcagttatttgatcaatagttgtctggaagcaagcagttctccaagcaaatgatcttcccaaaagtttctgttccaaatttcgaatcgtgtcctgtggatcggcctcccgttccttggctgcaaccctcaaccaaacgccgtaatgtaaacaaatgatgttaccgtctgcaaccaaactaaccgtgtaatcggatacaatggtagctgttacggccggtggcaataccatgagagtttacgttaccacttccgaaccaaacaccaccctaaggtacttcagacagttcaccacccgccgtaagggtctataattgccgcttcttcctctgtggcctctttgctggggcagcacttcctcctttgtctgacgagcttttcgcctctgctggttgctttggatccctcctcttcccttgttccgcgaccaccttatcaactgcttcatcatcactgtcgtcgtcaccactaccctcagaagaatgatgagctttcttccacgagcccttcgatgtctttgctggttgcttccttcctctctttgattcttttgtatcttcctcatcctcttggatctcatgggttgccttcactaattgcttccttcccctcttggcaggtttagcctcttcctcatcatcgtccacttcacgagcagctttatttgatttgctctgttctttgcttattttcgctctgcttgctgttgcatcaatcccgtccagcttctgcaactctggcacatatgctgaagtctgaacaaacaagtgagaatgggatcagcgatcagcgcaacgcatgaaagatatattgagcttgatccaaatgggtaaaggacttaccctgccaccaactgtaatgaagtcaattttcttccctgcaagcaacaaaactcaatcttcaataatgctaagcatcacgaacacatgttttaccaaagaaaagatgatcagaccctccacaaaggccttgccgggtttcttctccctggagtgaaatatccagttttctggatactgactgctgttgcaaccaacttctaaggacttttcaatcacctagagtcatagacacaaaaataagattatcatacacagaaatggactccttatgccaataatgacattgcgatattattgggccagtaaagacattgcgatgaaaatactcaacaggtaaaccagattcctattgggcttaatatgccaatatgttgaaacatttctaatattcagttatattttcaatgtatatgctaacatgatacattatataagaggtgtttttcttgagttcaggcaagacacaaaaaacaactgtgcatatctagtattcagatatcagtatatgctaacatgatacattactcagatatcagtatctaattcgtatataaaatgcaatcatttttttatatatggttgaattgataaataaatagaaaatgcacccaagttcacaaatcaactagatgggtacccttcgtgttgccgtgggagaattgtgataaaatagtcgatatgagttataaaattttcttttttacttattataccattttctttcatttgcttatatattttgtacattaatcaattatccaaaggttataaatgattgagttgtatggtgtggcttgtggggaggagatgcaatttgcacccttgatgaaatcatctaaaggccaaaaacaattaaggtgatgtagcttcatgagagaagagagaatagcattaactaaacttagtggggatgaactttataaatatataggatgccacatgctatccattcctaaagaacaaccatgtgacacacatcacactaacctctataatgcactgatggagtgccttgcatttctccttagaaatcatcgatgctgtttgcattggatgaatccttgcctacgcatcaagcaagcaaaggatgaaacatgcctatgtttttttatgaaaagaataacacaaaaaataacctagtattatacaatttagatgcccaaagaaggttatgtctaaaacaaggccacatctttgttggttaaatggaagacaaattttactacaggatgctcaaaatttgtgtaatttgctggcagacatcgtaaaaacatgtcatggctgaaagacactaaaaaaactaggaatttgccggaggacactttcaaaaaggtgagaatgcccctaggccaaaaaacttctgacctgaggatgtcgtgaagatggaatatgatgtatgctagcaatgtagttggggtaacgacagatttacagttgcatagttttcaaatattcactccaacaccatgtttgaagcctatggctccaggggtattatcccctatttgaagaatttctcactccaattgagttgagaatgtcctccggcaagctaccgattttctagggtgtctttcagccgtgacatgtttttgcgatgtctaccagcaaattacacaattttttgggtgttctgtagaaaaaaatgcctaaatggggatacatgatattcccatagaagtagcactttatttgacacaatcacttaaaccaaagctaaatcccacatgttaggttcaacatcatatctcatctatggcctatatcatgaggattgggtacatggaagaaacaaatggctcaggattgatggcccggagaagagaatgtgttacgggcttaggtcatgggatggagaagagagaacgatatatgggtaaatatattattctatggtcaaacacttaaactcaaataaagctgcccattttatatgacgagacaagcccaaataagaatatctagccaaccagataactaagcaaataactaatctttagttaacaaattggagtactactactaaacatgtaattcatgcacaggtactgcaccatttccagcacagccgagctgcttgtgacatgtgccaattgggcctgctgccgtggcctccaaacaacctatgaagctaaggccctgtttggatcatttagtctctggactaaaattactaaattagtccgtagactaaaaactttaggcccctactgtttggattcagggactaaaagggactaaaggcacgtggaccgagggagagagaagagaggctgccactttagtccctataagttcctccaagagggactaatggaattttagtcccatatgcactttttagtcccttttagtcacccctgtttggattcttagggactaaaatggagggactaatggattagtcccatgaaccaaacagggcctaaattattttttacaacactggatacaatattcaaaattttgtgtgtttgggcagcgaaaagtttttggtcagcaaataaacatgtaatgtgtttgtacagtgacagttttctgtagtttcaagccaactctagggaaactgacctgataaagcacttcatctgcaatccaattgccaattcctgatataaagctctgaaaaacatgattcagaaaaacagtcttagaagctagcagaatcaaaagtgtagtatttactgtggtatttagactacatttgggtataaaattgtaatatcttaatttactagtcaaacacacaaattactgactttcaggttcactaaccaaatctgggcaacaattgacaaagacaactttttagttatttctgattcccacatatataagggaaaatttcgccttctgttactaagcatgcataatttcagatatccaattgttacactgcagatctttgatcagagaacggagcattaaagattgatacctgatcaagcaaaagggcttttattggagcttttttcctacttagtgactctacaaaatcatcaagatgaagaggttcaaataaggcatctggtccaagctcagaaattggtgggacagcttctggctattataacatgcagacaaaattccaaagtgaattactgcagcatactgaagctataaactttgaagtcaaataatcactagagagttacattgtcaagaaagcgaatttttgcaaaacgcctcttatcagtgaaggaaaactccaaaccatcatccatctgtgatgttgacagaaataaaaatgaacctgatgtaagttaaagtgttaaacggatcattagttgacgtctgcctcaggactgaactgcatggagtatcatgagggattagagcatttccaaacagaaagtaatattcttttcacaatatggagagaaggaaaaacaattaaacatgcaagcaaagtcaccaccaaaagtatgaattccaatataatatatttactagaatccttcaataaacttaagtgcaatgcataacatacatatttcaatcattaataaaattaaaaagactgaacaagataaatatgtccaagaagcagaacccagagacaggtcacaaatcacataatcctacatgaacaacccctataacactctcggtgttaacttaggtgctaggcactagatgggtggcttgctagcacctaatgcatttctgcacttctattaatggaataaattcagtttgacagcacacttcccacggtgaccttatctagaagtagataatatatgcaaaaagtacataaacctcacacaaacaatattgttatacttgcctttgaaagtattttcaaaacatgtggatttagctcctacaatttactagtacattactataaaatcaatgcagtcaaagtcttggattgaagaccacaaaaacacaaaataatctttatttggatatggaaggagtatttcaaattcatcagtgaactggcggatgcattaaaaaaataggtgtggaatagaagattagaatccatactacaacaagcagcttggaatacttcaaaggccattcctcagtcgggctcactgcagacctatatcaaatgccacacgaaaaatatgctaaatattttagttgaactagccaaagtgtccgtgcattgcaatgggaagaaaatggaacaaattgtgtacatggagagagagcatgatcggcaaacaaccaagtaagatggcaatgtggaaggagagatagagcggttgttctacggtaatgaaggcgacatatgctagagcaagaggggatgggattttgtttagataaaagaactgaatttctagcataataagccgattatgaactaataaacaaaactttcaatctttttatgttcttttatacggtacatacatcaattagtctgccccatgagtagtacactattcaaatcatgcccaccttcctaacaaaaaattatacaaggaattttcattataaatactgactagccaaaaaattgataaccggcacaggcaccaaccctaaaaatatgtatgtcaacccctatatttatgtgaaacaataagaacttaattttattttaatatacggtttgagtcctttttttgtcattcggataatttaattcgtttctaaaaaaagataattcaactcgtatttttttcatttaccaattgaccatgcgatgggtcctccagggaaaaaaggaaattgtttcttgcacactgcgggcctaccttggagaggcagcccacagcatggcttgcaagcagcagcacctcaccgagtcctatacggacggcaacaaaaatacttcaaatggaagccagctagctatgggcctagcccaggcaacaacacgggccatacgcaccgacggcagaggacaagagtgcacaacgcatgcaccaaatgggaacacatatacaacacggacgacgtaccaaacgtttggcaaaaacatttacagttcttataatagtagagataaactacaactattccaaccaatttaatagacctaacggacacttattaacacttagcagacacaaaattctagtggatatatattatatagacatgatcacatattgaaattctacaagactgttgaagtattgtcacagaggctggtccactggacataactagattgccgctcaaatgatttttttttttggtttatgcaagcatattgctttaataatatcccaaataactcttatcacgaaataacatccacccatacaacccaaggaaggcatattcacattatgttttctctagtatcaatgaaaaatagaaaaaagtatatgaaaacgttgaccatctatctactaaactatttgtcgtcatagcttttcacagatttttctgacatttctaaaaaaattacgacaaaaaccataacagaatagaatcagcacagggtgtaattaacagtgtaaccaaactatgtatttgattgtgtctctccagttatgtcaattggaatcataacactttcctgaaagtggagtaaaatcatctattcgccaaatatagggcttcctaaggttccacgatttcatggaatacaccaatagatgaaaattttcttttgcagaatcaccaacaggcatcaagaacattaggcggctgcaaatgtttcagtacaaattgattgtatctgctaatgaagaaaagcatgcagaatagtcctaaatagttaaatataaagctaatacttaatattgtatgattgataagccatttcattgtcttgtttaataaattatgtgccactgaccttttgtatttgctcagttccacacccttgatgtaaatagctccagccattcctgtaacagaaactaacaattaggtactgtttgtaactttgtatacttagaacttaaaagggttaatgcactaaatgacccctgaaattgacagtggcctcaaattggtccttcaactattaaaatgtccaaaagcagccctctaaacatcaaatttggcccattttaatgtcaatgctggcacactgagttagtgccattgcacttttgctgagtcagaatcacacatggcggaaagactgaattgtaactcggcaaaaactgtaaaatcaagatttttttttctctcgaaaacgcagttgagctgcgtttcatttcattaataaggaagaaaacgtatttacaaagaaaaggggcaaagagaaactgtaatcaagattttggtggaattttcactagtcaaaaactgcactgaaggttccagtacaaattttactcaccggagttccttaacctgaactttagctagtcacacctctccttcagtatttgttcaccttcatttcttttttattgttttttagctattgcgtacttaattttgtgtttccgtttctttaggtaagacacgaatactaagatccagatagctgtagcacgtggagaaagactagaagtgtagttgttgattgacaaatatgttgtgatcaaatgctccaagaaagttgacataacacaaaaaaaatgaggtgcctatgataatgccggattaccaaaacaaccattgtgcttaggcactccatttagcactccaagagttgcgcatttagtttaatagtaattaattaccttataggcattctgtacaaaagaaaacctacagatatatatttacactactaccagaactaaaataagggactcgctaagagcagcgtcaacgaaacatgaaaaatccacaagaacagcatgacacaagattccaaaatgtcacaaataaaaaacaactcaagaaaaaccctaaacctcctgaagaacggttctatcttaaaaaataatagtaataaaaagaaaagcaataaatggtccattgcggaaaggaagggaaatgtgactatagagagggtgtggagatccacggaccgaactggaaggaagggaagggcggagaatcaagcgcaagccacagattcttgcccttgcggcgagcagcggagatggtcctcccgacaagcgctgcctccagccgcggcggggcgacgccgtcgatgaccttggtgtcatctgcagccgagcaccgcacgatcctcttcccgacgcagtgctcctccagcgcccgtcgcgccacctccacctccggcagctccggcatctctcctcaacctctccctcgttgggtatatcctcctcttctcttatttttgcaccggttggatcccagaatccccagattccccactttagagcctgtttgggagagtttgtccccgctgcagctttttccaaaagccgcttctgctagaagctgcctcaagcagtccatagcttctgagaatatgtagttacagattctaaaaaatgaactaagaagccagaagctagagaagctgggttttagagcttttccagattctcggaagctggctaccaaacagctgtttctcagaatctaaacctcccccaaacacctcccccaaacagacccttaccccagtctgaaaaggttaatttgaaaaggtaggagacccctcctcttaccgcttctttgacaagaggattgtaagggcaaaagcaatgtgtcatccatttattcagccccggaggaccaaatagatttaagtcctttaaaagtctcaggatccacaatgcaatatggcctcaaacaagatccaaacctatctatagccacacatggggatacacagcccacagtggacgtgaccaagcccacatagccaaagcgatacgagctaaggcgaaatgacctgggtaccctcaaaaccgtgccctttgactcggtctcgtgagtggggacgaacgcatcgcctcttctcctccgtcgatgcatcgcctcctctcctcctcacgcacctcccatgagccgtctgacgtcgccgacatgaagctccggagtggcttcgtgcacgaccggacatggccatgggctattgtcccagtggtgcgggtcaatttgttgctgtttgaaggtggagagccggcggagagctcggacttgtcggtggagatgtggaccgaagatggcgacgacgtccaggtttatccagatggtgccacttcccgacgtatggcgccgccactttccccaaggaagccccaccaggacgtggtctaggttccatccctctctaggtcgtcgcggctttccccaatgacacttgccccacagcgcgcgtgtcacgccctgaagttttccttcctagcaaaaattcaattgataaattgttttaagaaattatttgtttaaaggcaagagagaaaccctaaattaataaatacagttaataatcggaatcggcgtgtggaatttttcttggattctacgtgtcaaaatatgctaataggatttttaatggaattttcagagccttggaaataattttaactaattaaaaatgagcatgtgtaatatttaaatcctaggaaaaatcttttttcctttttcttcttttctttttccctttttcctttgttgggccgtcggcccactcctcccgcacgcccgccctcctctcagctgggccggcccaagccgcctccctcctctccccgggtcaccgacaggtggggcccacctgtcgcccccgtcttcaacctctgacaaccgcagccgccgccgaaaccgcccacgccgccgccgtttcccgcccttcccgcgcccactcctccccactccgtgccgcgcccacgtcgtcaccccctctccgctcctcccgccctcgcgcgcccgagaatgggcgggattcgtttcgaatcccccaaactctctctccccactcccccacgtcgccggccaaatcggggggtttccctgccgtgtccgcccctctcgagcccctataaggcttccccgcactcccc

SEQ ID NO: 40755 - DNA, 20685 bp, Oryza sativa
  unsure (1)..(20685): unsure at all n locations
cgccgtcgtcgtcttcaggttcacatggccgagggctacctcgtccacccctcctccatcgaattccgccatcggaggccgctgttcgccgcgcgccggtgagcccttccatagccgccaccgtcggccatggctctcgctcgccgtggactccctctctccctctaagctctctcatttcctctcttagggtgtcctggagctcggccactgttcgccgtcgccctccggtcgctcaccgtcgccgttcgtcgtcgtctcctcccgcgccggctgaaccccggtgagaactccctcctcttctcttcctctcgcgcgcgccgccgttcccatatgcgcgtcaccgcgatgcgccgtcgcccgcgtcgccggccaccgccgtcttctcgccggccgccgccgtcttctcgcctgtcgccgccatcggtggacgcttgccgccgccgccgtcggtggtcgcttgccgccgccgccctcgccataaccggccggccggcttgaagctgagccgaccaaggccgtcttcctcctcccctttaagccaccacctggtggggcccacccgccaggtcaccaccctctctcttgtgccgctgacccgtgggccccgcctgtcggcgccgccccaccccttggatgacgtcagccctgggacatattgcgcaataaatacattaaggcttttctttattagtaaaaatacagataatcttctaaaattcatatctaattcatccgagctccgttttagtccattcaagtctcagtaaattcgtaaaaatgtatagaatccattaaaaatggttttgtctcctgtttcagtagacttatagcatgttttgcttgtgtgctttgtttttcgcgtagatttcggtcgtttcgtcgatccgtggctcctcgaagacgttgctatggtctcatcagtggaagagcaaggcaagtcatgtattacaattgatcagattgtacccaatttacaaatgtcccgcatttctattaaatgttgcattgttttacaatatcatgtgggatgggtcctactactcagccatatattgtttaccttatgccatcgataacttgggtatcaaaatgattagatgttggtttagggaacgcttagccatgcttagttcaactagtacacaaaggggaatcacattaatgcatagactttgattattggcatagctttggattagtgccaccgcaatggtgttagttaattaaaatacactacatggtgggctgtgggtgcatggttttgctagttgtgcccatggcgattaaggaccggttcgcgggaaaccctggaagaatttatcgtgcttaccacaagccagcgtgggcaacgactgggcttgtagtatagcttccctctagccgacgtacccaggcgagggtgggtgtgatggtgttgggtcggccggggtgtccggttgatcggcttccggattcaccgcggcacgaaaggggggctgcccgttgcccgctggggacgggggcgaaccctaaggtgtggtgcgatcggttagagggggttatgcgaagggtcctgtcacggcctcttttcagtatgtcgtggtggcatgtcggcgcacggaaacgtgtcgtggggctgtgtcttgtgggtacagttgtacacctctgatcagagtaaaactattcgaatagtcgtgcccgcggttatgggcggtcgaccagatttaccgtaattagtctcacccctagttagctaatggaactggttagttcaggtggtggtttgggcctgtcttaacgtggtgtagcgttgagcagtgattggttaatattgattaattactgcaactgttttactgctttcaactactgcttttaaatgctagctttatgcaaaagaacctttagcctcccttggatatatcctgcatcatacctcctcttctggtatgacttgctgagtacagtgggtagtactcagtcttgctctctttttcccccacaccagagttgaagttcttctcagttggtgatgtctcgaagaggttggtttcgtcgctaccgtcaaggattgcctgtggaatggagtcgcccgctgcaggagtcaagtcttcaggcttatctcgtttttttcttttccactgcatttgtaatcttttatatttttgtaagacgtagatttgtatgtcaacaattgtcgtttgtgtaccctggctggtcctggacaggggtttaatgcacattcagcttagaaattctggttcgtgaatttttgggcgtgacaagttgttatcagagccgaccttgaccgtaggacaagccaactggaaaccctaagagccctctgaaaccttttcatctgcacatgccttttgcacttggatttgttttgggaaaattttggggtttgctcttttgattcgtgggaaaaatcttgatcgctatttcaattggatttatcgactaggaatagtatggtgttttagaaaaacattatttggaatttatttggcagtcagtcgggaatttgttaggtgatatgcactaagtcgtgtctaggttcgatgggcaattttatgtgtgtattatagctatgcatctattttgtgcattaatttatcgtttagtcagttgcattagtatctttgtctgggttcatgaaaaatgttccacgcataaaaatcatcatgctcggcgagttacttgagtcatttgttgctttatttaatttggttttgagcatgtgttggttcctatccttctgtcctctttagatgttagacctgttcctcgttcgcaagcgacgctccaagcttcagagtcgtcgcctttagccttatcatcttcttagttttgattgcttgctagtttctgtgtttaggtttgttgcttgtgggttagtcggcggtcgatatcaagtgccagtggtatggctgccttaattaggagttgtttgcttccttttcagttttttaatcaagattaagataattgcacttaaatttacaagaaagattagttgccgagccatctgttttattcctttctcttatttctacctatcctcgtccagatggtgaagacaaggaacgatccccgtgactccaacgatgccagtggcagcgaagagcagaccgatggagctcataccagtggtgcatctagcagcagtccatctccaccgcccgagaacccaatggtcactcagatgatgacaatgatgatgcaacagatgcaacaacattaccatcagatgttgcagcaggcgcaacagaaccaacagtttggtcccccaccatcccacttgtccaaactgttagactttctccgcatcaagccacccactttctcaagcaccaccaacccaatggaggccaacgaccggctccgtgctattgagaagaagctgaaccttttgcaatgcaacgaccaggagaaggttgctttttctacacatcagttgcaagggcctgcttctgcctggtgggacaactatgtggtaacccgtccagatgcaacggaagttacttgggcagagttttgtcaaagcttcaggaaggcacagatccccgaggggattatggcacaaaggaagagagagttctgtcacgaccggaattaacccaacgggcgttccttacgtgcgtgtattattccttgtcccaggaggcaaggtacaacaaaagttgatacatttcagagtttatcaagcggaagcgtaaatagttaatttattacatgggcggcgaaggcccagcacacacaaagacaaacgagaaacagcggaagactagggcgatgaccataggcgcttgacggcaggcacgagctagacaccaaagccttcatcttccaggggctcctcttctgggtttgggaaaaattgagcaagactgagtacaaccaccgtactcaacaagacacacccacaagtgcagaataaatgcaagggagtacaagggggttataatataaagggttagggtttgcagtaaacagcattaaaagacacttagttgctcaacgctattttgtaaacacgattctagagctatacaatattattaaacaaggccgtgaacccacacgaacctgccttaacccaaggcctacgatgattcagaccgaactggcaacccgaccctgggtcccagctcgtcccaagccaacccaggccaactattccacattttagttgttaagcaggttttaagaattaaaacactaacttgggtacattgctaggcatgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcatgtagccttcatttgtcctagagatgtccatcgacccccgacttcatccatctccatccgtgtacttttttttataaccagattgagccacaaactaagccttacccactagacatgtggaagtacggtagtgctttgcaacagaggccccgaagaccggtccttatatggccgaggtgctactatcaaaaccatgcaccccgagcccagcctaaaaccattttgagggttttgaatagagggggaggtgtgaatccaattccacaataatccaaccattccatattgtccaggtgatgagaatattcccaaagtctagagttgtaaaaccacctaatgttgcctaattaaccagcgaagcatctacctaaaatcatactagtggtaccatgagtagagtgtctactagttggggttttgtttattctagggtgaacaaggaaatattaacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaacctccacgaagagcggatcttccgaagctgcaacgtctacacgaccaatggaaaataaaagggcgtttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagggggcgcgcggacggggtccacgagagtggggcccacgcggcagcctcacggtccacggtggaccgggcgcacccgggctcacaccggccggcgccgtgggtcccacgcgtcagccgcacccgagggcgcgggcggctgacggccgggccccacgcggtagccactcggcgcgcccgagggcggccatgccggcacggtcggcgggagacggcgtgctcgcgacccgatggtcgccgccggcgaccaccggcgcggcggagcggcggccgagagaggggtgggaagggggaaaggaggcgatggtccacggctcaccccggggcgatggcggcgacggaggagcggcccggancgaaggnagcggncggcgcggctcgggtcgacggggtcgacggcgttcggcgggtcggcgacggaaacggagaggtggacgaggttggcgaggatgcggcgaacccgaagaaggcggcgccgaggtgggaggtggtccggggcgacgacggcggcggaccggagctcggcggcgacggcggagagagagagcgacggcgcgagctcgaatctgcgaggagaaagggcggcgagaggcggaaacgaatggaggaggtgcggggagggtttatatagggttggaagggggagagggcggccggaggggaaggaaaccggcgcggcgctctcgggctccatcaatggcgccggcgggattaggggagggtttccaaatgaatccaagggagagagggagggaaaattggggggaaagggagagggaatcacggggaataattcccccctattgattgcacgcggggaggacgggggcggcgggattcgcggcggcggcggcgctagggcgcgggcgaggcggcgggagcggcgggaggaaggggatgacgggtgggccccacccgtcagcgaggttggcgggcgggcccgcccgtcagcggcgcgtgcgcgggcagaggccggatgggccgcgtggagagcagagggagggggagggagatgggccgagccggcccaagagggggagggagggaaaggggacttttagggtttttcttttttaaaaccttttcaactttgtttatttcttaataattattatttgtgctctgaaaattccactaaaatttatttacgcattttaggctttttaggaaatatacaaaaatcctctaagccttgtttgacttttaactttgcacattttaattgttggaggctttcacacagattttaattattctaggcatcatttagaggatatattttagggtcgttttgggacgtgacaagttccgtgcactccagcaaggaaccatgtcagttacagagtacatgcacgagttcaaccgccttgcgcgctacgctcccgaggacgtgcgcaccgatgctgagaagcaagagaggtttttgtttggtcttgatgatgaattgaccaaccagctgatctccggagtctatgatgattttgagaagcttgtggacaaggctatccgtcaggaagaacaacgtaacaaaatggaccgaaaaagaaaggcagctcagatcagctttcctcaggggaacaatcagaagcctcgcttcatgacgggacagttaggtgagccttccaccctgatcgtccgtcagcaccgtccttaccactcgagtaacttcaacaacgactacaatagtggctgtcacggcagcagtaagcagcacaaccacaactcgactccacccccattaatggcaccaactcagtcagatccgccagctatgtcagctcagtcagaacaactcaagaaggagtctgcaggaaagccaagaccctgcttcaactgtggcaagcacggccactttgctggcaagtatccgaagccgaagcgcgctggacctaggttcgtccaggcctgcgtcaatcatgcgtctgcagaggaggcacaggcagcaccagaggtcgtgctgggcacgtttccagtgaattcatttccggcaacagtactttttgattcgggtgcctcgcattctttcatttccaagagaattgctgggacacatggattatcggtagtggaacttaaaatactgatgcgggttcatacccctggaaatgacatgaacaccacacactactgcccctcagtgaccatagagatcaaaaggtcaccgttcctatccaacctcatccttctcgaatccaaagacctagatgtcattctcggaatggattggttgaccagacacaagggggtgattgactgcgcaagccgcaccatcaccctaaccaacgacaaaggggagaagatcaccttccgttctccagtgccacagaagtccgtagcaagtctgaatcaggctactatcgaggatcagacagaaatagcggagaaaaatcccaagaaattggaggatatacctatagtacaagagtatcctgaggtgttcctagaagacctcactacaatgccaccgaagagagaaatcgagttccggattgatctggcacccggaactgctgcaatctacaaaaggtcgtacagaatggcagctaatgagctagcagaggtcaagaagcaggttgatgaacagctgcagaaagggtacatccaaccgagtatttcaccttggggtgctccggttatctttgtggagaagaaagacaagaccaagaggatgtgcgttgattatcacgcccttaatgaggtcacaatcaagaacaaatatcccttgcccagaattgatgacctgtttgatcagttaaaaggggctaaggtgttttccaagatagacctgcgatcaggctatcaccagttgagaattcgggaagaggatattcccaagacagccttcactactcggtatgggttgtttgagtgcacggttatgtcatttggactcaccaatgcaccggctttcttcatgaacttgatgaacaaagtgtttatggagtttcttgacaagtttgtcgtggtgttcattgacgacatacttatttattcaaaatcagaagaggaacatgagcaacatctccgtctggtactcgagaaattgaaggagcaccagttatatgccaagttcagtaagtgtgacttctggttgtcggaagtcaaatttctgggtcacgtcattactgctcaaggtgtggcagtggatccatcaaatgtggagtcagttacaaagtggaccccaccaaagacagtttctcagattcggagttttcttggacttgcgggctattaccgtcggttcatcgaaaatttctctaagattgccagacccatgacacaattgctaaagaaagatgaaaaattcaagtggtcagttgagtgcaatcaaagttttgaagaactcaagaagaagttagtatctgcaccagttctgattctgccggatcagacgaaagactttcaggtctactgtgatgcatctctcaagggctgggatgtgtgctgatgcaggaaggcagagtggtcgcatatgcttcgcgacagttgcgtccacatgagagcaattatcctactcatgatcttgagttggcagcagtggttcatgctctgaaaatctggcggcactatcttattggcaaccgctgtgaagtctacactgatcacaagagtctgaagtacatcttcacgcagcctgacttgaatatccgacagtgaagatggctggagttaattaaagattatgacatagggatacactatcatgcaggcaaagcaaatgtggtagcagatgcttttagcagaaagagccattgcaatacagtatataccgaaggcatgtgtgacaaattgcaacaagatctagagcacctaaatttgggcatcgtggaacacgggtacgtagctgctctagaggcacgccctacgctcgtggatcaagtcagagatgctcaggtaaatgatcctgaaatagctgagctgaaaaagaatatgaggattggaaaagcccgagattttcatgaggatgggcatggcacaatctggttgggagaaagattgtgtgtacctgacgacaaagaactgaaggatctgatactcactgaagctcatcaaactcagtattcaattcatcccggtagtactaaaatgtaccaggacctcaaagaaaaattctggtgggctagcatgagaagagaaatagctgaattcgtcgcactctgcgatgtttgccagagggtaaaggcagaacatcaaaggcccgcaggattgttacaacctcttcagatcccggaatggaaatgggaagagattggaatggatttcataacaggtttgcccaggacatcatcgaggcacgattcaatctgggtagtcgtggatcgactcaccaaagttgctcatttcattccagtgcacactacctatacggggaaaaggttggcagagttgtacttagcaaggatcatgtgtttgcatggggtacctaagaagatagtatctgatcgagggagtcagttcacttcaaaattttggcagaagttgcaagaagaattggggactcatttgaatttcagcatagcttatcatccacaaactaatggtcagaccgagcgagtcaatcaaatattggaagatatgttgagagcttgtgcacttgactttggcggagcttgggataaaagtctgccttatgcggaattctcttacaacaacagttatcaggccagtctgcaaatggcaccgtttgaagcattgtccggatggaagtgccgcacttcgctcttctgggatcaaacaggtgagcgccaactgtttgggacagaggtgctaaccgaggcagaggaaaaagtcaggaccatcagggaaagattgagaatcgcccagtctcggcagaagagttatgctgacaaccgccgaagggagcttatttttgaagcaggggattatgtgtaccttcgtatcactccgcttcggggagtccaccgcttccagactaaaggaaagttggcaccacgctttgtgggaccatacaggatcctggaacgcagaggtgaagttgcttaccaccttgagcttccatctaatatggctggtatccacgatgtgtttcatgtatctcaactgaagaagtgtttgagagtacctgaggaacaagctagctcagagcacatagacatttaggaagatctgacatatgtggagaaaccgattcgtatcctcgaaaccagtgagagaaggaccagaaacaaggtgatcaagttttgcaaagttcagtggagccaccactcagaagaagaggccacctgggaaagagaagatgagttgaaggccgcccatccgcacctcttcgccagctcttccgaatctcagggtcgagattctgtttaaggggggtaggtttgtcacgccctgaagttcttctccctagcaaaaattcaattgataaattgttttaagaaattatttgtttaaaggcaagagagaaaccctaaattaataaatacagttaataatcagaatcggcgtgtggaatttttcttggattctacgtgtcaaaatatgctaacaggatttttagtggaattttcagagccttggaaataattttaaccaattaaaaatgagcatgtgcaatatttaaatcccaggaaaaatcttttttcctttttcttcttttctttttcccattttcctttgttgggctgtcggcccactcctcccgcgcgcccgccctcctctccgctgggccggcctaagccgcctccctcctctccccgggtcaccgataggtggggcccacctgtcggccccgtcttcaacctccgacaacggcagccgccgccgaaaccgcccatgccggtgccgtttcccgcccttcccgcgcccactcctccccactccgtgccgtgcccacgtcgtcgccccctatccgctcctcccaccctcgagcgcgcccgagaatgggcgggattcatttcgaatccccccccccaactctctctccccattcccccacgtcgccggccaaatcggggggtttcccggccgtgtccgcccctctcgagcccctataaggctcaccgccgccgccttctccacgcctccggccgccactagcgccgccgccgagccgcgccgtcgtcgtcttcgggttcgcacggccgagggctacctcgtccacccctccgtcgaattccgccatcggaggccaccgttcgccgcgcaccggtgagcccttccatagccgtcgccgtcggccatggttctcgctcgccgtggactccctctctccctctaacatctctcatttcctctcttagggtgtcctggagctcggtcgccgttcgccgtcgccctccggtcgctcaccgtcgccgttcgtcgtcgtctcctcccatgccggccgaaccacggtgagaactccctccccttctcttcctctcgcgcgcgccgccgctcccggcatgcgtgtcgccgcgatgcgccgtcgtccgcgtcgccggccgccgccgtcttctcgccggtcgccgccgtctatggccgcttgccgccgccgccctcgccataaccggctggccggcttgaagccgagccgagccaggccgccttcctcctcctctttgagccaccgcctagtggggcccacccgccaggtcacctccctctctcttgtgccgctgacccgtgggccccgcctgtcggcgcagccctaccccttggatgatgtcagccctgggacatattgcgcaataaatacattaaggcttttctttattagtaaaaacacagataatcttctaaaattcatatctaattcatccgagctccgttttagtccattcaagtctcagtaaattcgtaaaaatgtatagaatccaattaaaatggttttgtttcctgtttcagtagacttatagcatgttttgcttgtgtgctttgtttgtcgcgtagatttcggtcgtttcgtcgatccgtggctcctcgaagacattgtcgtggtctcatcagtgcgagagcaaggcaagtcatgcattacaattgatcatattgtacccaatttacaaatgtcccgtatttctattaaatgttgcattgttttacaatatcatgtgggatgggtcctactactcagccatatattgtttaccttatgccatcgataacttgggtatcaaaatgattagatgttggtttagggaacgcttagccatgcttagttcaactagtacacaaaggggaatcacattaatgcatggactttgattattggcatagctttggattagtgccaccgcaatggtgttagttaattaaagtacactacatggtgggctgtgggtgcatggttttgctagttgtgcccatggtgattaaggaccggttcgctggaaaccctggaagaatttatcgtgcttaccacaagccagcgtgggcaacgattgggcttgtagtgtagcttccctctagccgacgtacccaggcgagggtgggcgtgatggagttgggtcggccggggtgtccggttgatcggcttccggattcaccgcggcacgaaaggggggctgcccgttgcccgctggggacgggggcgaaccctaaggtgtggtgcgatcggttagagggggttatgcgaagggtcctgtcacggcctcttttcggtatgtcgtggtggcatgtcagtgcacggaaacgtgtcgtggggctgtgtcttgtggatacagttgtacacctctgatcagagtaaaactattcgaatagtcatgcccgcggttatgggcggtcgaccagattcaccgtaattagtctcacccctagttaactaatggaactagttagttcaggtggtggtttgggcctgtctcaacgtggtgtagcattgagcaatgattggttaatattgattaattactgcaactgttttactgctttcaactactgcttttaaatgctagctttatgcaaaagaacctttagcctcccttggatatatcctgcatcatacctcctcttccgatatgacttactgagtacagtgggtagtactcagtcttgctctctttttcccccacaccagagttgaagttcttctctgttggtgatgtcttgaagaggttggtttcgtcactgccgtcaaggattgcctgtggaatggagttgcccgctgcaggagtcaattcttcaggcttatctcgtttttttcttttccgctgcatttgtaatcttttatatttttgtaagacgtggatctgtatgtcaacaattgtcgtttgtgtgccctggctggacgaacgcatcgcctcttctcctcctccgtcgatgcatcgcctcctctcctcctcacgcacctcccatgagctgtctgacgtcgccgacatgaagctccggagtggcttcgtgtacgaccggacatggccatgggctattgtcctagtggtgcgggtcaatttgttgctgtttggaggcagagagccggcggagagctcggactcgttggtggagatgtggaccgaagatggcgacggcgtccaggtttatccagatggtgccacttcccgacgtatagcgccgccactttccccaaggaagccgcaccaggacgtggtctaggttccatccccctctaggtcgtcacggctttccccaatgacacttgccccacagcgcgcccgcgaccacgtctcctagccgcgcgcggcttcgcctccgcccaagaacacgttgcttgagttggacgcacggtcttccttttggtgggcccagttgcaatggtggcacctaattctctcgaattgacgacatgtccgcccaggcagaatgccacggtggagcattgtaaaggctgtaaaagggtgagtttgaggagaaggggatagagaatattggaaagatacgcaaaacgaggtgagctattagtacatgattaattgagtattaatttttttaaatttcaaaaatggattaatatgattttttaaagcaacttccctatagaatgtttttgcaaaaaatataatgtttagtagttcgggaagcatgtgcgtgaaaaacgaaacaatctcactatttgctgctgccgaacgcagtgtaggctgtgttcgggagaaggggttgggaacccctcctccccggcacgcgaaacgaaccttgtattattgcatgattaattaaatattaactatttttttaaaaaatggattaatataattttttaaacaactttcatatataatttttttttataaataacaccatttagcagtttgaaaagcgtgcgcgcggaaaacgagagaggtgggttgggaaaatgggggaagaacacaggcttagagaagagaacaagatgattggaagtttagataagacaattgtaatgacgagattattatgaggatttgatttttttagtcttattttttttttggtatagatgtgaaaattgacaggaagttcagatatatgaaaaataataactaagatttgtttaggtaaagtaaagtagaaattctctctcaattaccacttcctaccaggtattgaaaaggcaattacctcttcctaccagatattgaaaaggagggagttcctctctcatttcccattccatcacatcccatcaaaactcatttgccttctacctgtatatatccaatggtaaattgtatcttattgttcacatccaacggctaatattatttaaatgacgtggcacattcacgtcacatcatgtgattcacttttccatagttaagatgtaggtaaggatgttattgcacagagatgcaactggggttggagtagaactagctcccttttaaccatctttcgtgctcgtcgatgatgtgtgcccccaactcttgggcataaactacacgaagtaggaagctcaggaccacatgtcacgcccggaacttctatccaaaattccaaacgcttacatgtgtgtgaaccctcgtccaggaatcagccgatgcacacaataacaaattgataatagagtacaaatattactctaattaataagcgaataaaatgtcattacagaggtagatagttcctctcaatcaataaagttctaagcagcggaaaaaaaataaacggcgcaggcggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatctgttactatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataagtgtaataatgtttctaagcagggctaagcaattatatctaatatctagttgaaccaatataaataaagctcaactagtcaaattataataacccaaggtatcaaggaataaggtaatcaagaacaaaagggccataacaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaaagtgtaggtctcaattttagaaaaatttagagacttgaaccaactaaatcggagctaagatgaattagttatgaatttttaaagattaaatcggattaaaacacttaaatcggttaaaattgaattatgacgcaataataaattatttttgaaaaggaaaaggggatttattgcgtcagcgggctagggtttggtggaccgggcgcacgggcgacggttcacgcgaacggacggccgagattgatccgatccaaaacggacggccaagatcgatcggtctacgaccggctcacagcgaacggccccgatgacgccagcgatgacgtcaccgacggcggcggcggctcggcagctgggtcggctcgggcggcgcacgctcgccggcgaacggcggcgcgaggacgctaacaaagggcaccaacgggtagcggacggcacggcgaactcaccgacgaccaaaacgacggcggagaagcaacggacggcgacggcgacgaggaaggagcggcggctaccttcgggttgacgacggcgacgatgctccggcggtctccgacggcagcgaaggggcggacgaggacggcggcgacttggcgagcacgacggcggtcttcccgagcggcggcgacagctggagcgacggcggagcacggctgaagcggcggcggcgaaggcaaagctagggcacacggcgctagggctactccggcgacgagaggcgaaggcgagggtggcggcgagaagagaagagcacggggatccttttaaaggggctcggaggcggcggcgaaggcccacggcgacggcaacggcgaaggaaactcgcggcttggaaagagggaacccgatccgaatcgaacttgattccaccgctttccaaagcgatttagccgatgattccaaagagaaaaaggtagaggagatcccggagattgtttcccctcaaccaatttggccggagaaggaaagaggcggccggattggaaggaaacagcggcggcggctcggcggcggcgcgctagggtttcggcccgaggaagacgacgggcctgacaggtgggacccacctgtcagcggctgcgagggcgcgcgcgcgcgcgggcggctgcggactgggccggctgggccgagaagagagagaaggcggttttgggccgactttcggcccaaagccaaaagaagactttttaaaaccttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacttagattttcttttcaagacttttaaaataaattctagaaattccatttaaacaacaatttatatattttgaattttcagggtgtgacaccacagtagggaaggattcgtctccctctaactaagggatgaatcaacgtggtggccttcaccagtttgggtctagccatcttcttgttgtcggggcatcatatggtgattgtgccatgtgaggatgaaggagtagaacgcagttaaggtgaaggcttggttcacgcttcttgccatcctcttgttgctcaaccatcttctttagcttgtcgacctcccgcaatgcaggtgtctagctttgtcagcttagacatgttgaagaagtggtggccatcgcctcatcggtgcttggccttgaaaatatttccaccttgttggtgtcgaacagatgatttccattgcttttgccttgtctgtgcccaacaatggaaattgatttgcatcatgagagttttcaagtcgatgaagtggcttcgccttgtcgaagcgtagccttgaaggtcccccttatcggtgtcggatagatgatttattttgactttgccttgtcagtgctcgacaatgtaaagagcttgagtcgtcgatgtagtcgataatgagtcggaatatcatcggcgatgtagaagaggtgggatgttgtgcatattgctcccgatgtctcctatgatgatagctggattgtcatcagctacgtagaaggacatagggataccctagtgttgttgatgtagttgacaacgcgcttgaatggcaacgtcgcgtaagggaataaggaggtcatatagcccccaatgctagtgtagttcgtgatgcgtcaggatgaaagacgtgggtctgtgtagtccccggtcttgttgaagtagatgatgaagtactggaagccatcggcagtgtagatggaagacgggtcgatgatgtcatactgagatatcgtcagtattgtagatagaagagagggttggtgttgccccctaccatgaatatgatgatgttgtgtcaagataacattggcggcacataaggttgtgaaggcttcaagtgaccttcttatgatcaatgttggtggaggatgctccgaagtagacaacgatgcatgggtcacatttttttagtgcccattggccgccttgatgtgcagactttgcatcacccgtatatctttatcacatcagactcgatcagctctagggcctctttcaattgaatcatttgcatctaggcaacaccaactactccttcatatagagattagtgccactcctgaagactgtcgaagaagagagtgactcaaattaggtcacttgcagcgtttaggagtagctggtttagaaagatccaacatagattcggatcttacatgaccaccgctcttattgaaaatcatcatgcatcatcatgttgtttataggttggaggagttgacgaagatatagacgatgaccactaaagcacagcaaagatgggaggataaccaggtcccactgggcgtgccaatttgtttaggacagaacaaataacaacgataacgatatgcgagggcgtgtcagtgtaactaagtacacaaaataaacaaagaacatagggaacatgtgttttattaatctcaaggatcataaatacaaattcccaatgtaacatgtatatatgtgtgttggtggctgttaaatgctaattttacgccgccaatacctgcgtaaatcaaggaaataaaacatccaacatagtaatagggtttaattctaacatattccactagtgttggtgtatatttgaatacaggtaataaaccgccaaagttggatgaaattcagacttaagtgaagacgaagccctatctatacaaagagtgggctagaaactacacagtaatatgcttaaaagggccttctactcgtagaaatggatactaaaggaggaggagaagcaacatgctgctgaagtgtgggcctgttgggccaggcaatggttcggccgaacccatggttcggacgaaccaccagctgcactgtcggatccatgttttggcgtggacagtccagatctcctcctaatggtggttgaagggctaaaaggacatttcgcgttttcctaaccatcatacctaccctatataaggacttcaccttttcacttcactcacacactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40756 - DNA, 734 bp, Oryza sativa
tcattgctcaatgctacaccacgttgagacaggcccaaaccaccacctgaactaactagttccattagttaactaggggtgagactaattacggtgaatctggtcgaccgcccataaccgcgggcatgactattcgaatagttttactctgatcagaggtgtacaactgtatccacaagacacagccccacgacacgtttccgtgcactgacatgccaccacgacataccgaaaagaggccgtgacaggacccttcgcataaccccctctaaccgatcgcaccacaccttagggttcgcccccgtccccagcgggcaacgggcagcccccctttcgtgccgcggtgaatccggaagccgatcaaccggacaccccggccgacccaactccatcacgcccaccctcgcctgggtacgtcggctagagggaagctacactacaagcccaatcgttgcccacgctggcttgtggtaagcacgataaattcttccagggtttccagcgaaccggtccttaatcaccatgggcacaactagcaaaaccatgcacccacagcccaccatgtagtgtactttaattaactaacaccattgcggtggcactaatccaaagctatgccaataatcaaagtccatgcattaatgtgattcccctttgtgtactagttgaactaagcatggctaagcgttccctaaaccaacatctaatcattttgatacccaagttatcgatgg

SEQ ID NO: 40757 - DNA, 1197 bp, Oryza sativa
atcctaggtgccaaatttgggtgtaaacacatgcccccctgcctttttgatgaacaacgtgaatctaaaagcatagcatatgtttttggtcttaggacgataatctaattaccggccatagtacctcctaagtgtcttgccaaacgctcgggaagtatttcttcaagtacttcccgttgattgctcgctgaaaacgctccccttggagtgtctccaaaaaatacgcgttccctcgaacaatgccgcatacttgataaggaccctcccaactaggagaccacttaccgaactccttggatcgagtacccaaaggcaaaattgtcttccaaaccaagtctccaatttgaaacaactttgctttcacccttttgttgtatgccttggccaccctcttcttctctttctctatctcctccaatgccctcaagcgctcgtcgatgactccatcaagattatctcccatcaacgtcttgtaatcttcacttgacaaatcatcttgcttgatataacgaagagaactaagatttacctctaccggtaaaacgacttcttgaccataaaccaactcaaaaggagtgactttagtggcaccatgtttagatatcctatgagcccacaatgcttcggaaagcacctcataccacctctttgggtgttcctcaatcttcttttttactagcttcaacaatgtcttattactcgactcggtttgtccattagcctgagcgtagtaaggagaagaactcaacaatttaatactataagattcggtaaaactcttcacttccttagacataaaaaagcaccttggtccgtagttaatgtttgcggaataccgaatctatgaataatatacttcaaaataaagtcaattaccttcgtatgagtcatattcttcaaaggcacggcttcggcccacttggtgaagtaatccgtagcaactagcacgaacctatgcccccttgatgacgaaggataaatttgaccaacgaaatctaaagcccaccctcggaacggccatggtttgattatgggattcaacacggtggcaggcaccaattgaacattgccgaaccgttgacaagcctcacatcccctataatatttgaagcaatcattaatcatcttcggccaatagaatcctgccctcctaagcaaccaatttatcttgtgggccgattgatgagttccacaaat

SEQ ID NO: 40758 - DNA, 992 bp, Oryza sativa
  unsure (1)..(992): unsure at all n locations
accattttcctggcagcgcaagaataagttgtaaatgaattagtttattttatccataaagtggtaagaacatatatgcggagcattttgagtgcaatgcaacatctctgtctcaacatgcagatccaagaggataaacacaagactcattggcaagaggacactgagaaaaaatggatatctcatatgtatagtatttattgatgttataatagttaagaattgccatttcaggcatcatccttcgcagaaataaaataaagactagtgagtcatagagggacaaaaagagcaaacaatcagcttgcatgatgttagttgcataaaatcatgacatggcattgggagagcaatgagaaagatacactaacttgatatgatttccatataaccaacagaatgtcaccactgtacagagagctaatacaacagagagcaaagcacaacctattacatagaccagaagttaaaagtaactagatgactgcctggaccaacaagctaggtacccagtaacagcacaagatatctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40759 - DNA, 1553 bp, Oryza sativa
gattgtggttgcaattatttgggatgcgttgtgaattgagttgcattgcggttgtcttgaatgaatggactgaagtttacctctttggcttgcttttgcggtgtcttagagatgaatacagtaccctataacaataccaacctcttagttaatagttctccatgatctccattagtctggggacaactggaggttgaaacatttgttgtttatggagcatagatcatgttatatagtgtgatgtctgaaatggttttatcgattttatatgttctcagttacctgcttacacatgacatattctttttttctgttgtacatatgtgcaaaatacggtgcatttaactcaggctgtatttgtattttgatgtgtggtccttgttattgtgtttgttgcttgttgatattagttaagaaagttaaatgcaaacttcccttgaacttaaatttctcgagttgaatgaatttgcagttataacatgtaggaaatttcagataggttgtgttgtggtttctgattgtgacatcaatcacatcttttttatgtttagggaagctgattatccttgcaaacaactgccctccactcaggaagtctgagattgagtattacgccatgttgggaaaagttagcgttcaccatttccatggaagtaagtttgtttcatccttccgaaccatttatgttttgtgtgatagcatctgtattcatctacatgtcacggtttttccgtgatatagtttggtactgtatgtcttactgtgccttcgctttcagacaatgttgatcttggaactgcctgcggcaagtactaccgggtgtgctgcctcagcatcatcgaccctggttcgtcgctaccgacatcacttacatatattttcctctatggcaccctcagaagtactgaatatatttgcctctttccctgtttcaggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggtgtgattcgctgattgccgttttggtttctgctcctggagaatctggaaacgtagtgtggcttccacgtttgcttgtcgatttgattatcgccgtttagcagctgctgttttgtttatgcttttctatattccgtgacgtaataatgcctatctcccagattgtaaggttcatccgtttgtgatacgagcgtacttaatgctaggagtacgtgtgtatttattaggttaatttaagtg

SEQ ID NO: 40760 - DNA, 3301 bp, Oryza sativa
cacattcccaaaaccaaaacataaatatagcacaaaaaattgacaaattttatggaatatatgaagtagagcaaccattatacgagtttaattgccataataatacgcaatacccaaatatagcggctccctaatctcctctcataattgccggtgcgtgatgcgggagttggttcgaccagcccaaccgcttcccacccgaacccgacctgccacgtcggaccaagtccaacgcatttccgccccctccacccaatcccgcgccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggagatggaggggttcctgcagaagctgaaggggctggacgcgtaccccaaggtgaacgaggacttctacaagcggacgctctccggcggcgtcgtcacggtcgtcgcctccgtcgtcatgctgctgctgttcgtctccgagacccgtaagtgtgtgtgcgcgaagcagccgccgccgcgcggatgttgtgtgctgttcgcgtactctcccatccgtggccgtaatggctcgatgtggtttggaattcgaggagttggttcttgccaacaagatcaaagtcggatttcgagttgtcgatggggatggggatttagagtaagatttgaattcaatgatgcggtgggcgtgttcctgctgctgctgcatgcttgaatgtttggaatatttccaggggcacctgaccgcgctcttggtaatttctagaagaaggtgcccttttaggtagacaggttttgcggtgtgtcagggtaacgaactaaagatgggcatgttgcgatgggcattgacgctaatggtgatgtatgctgcgcgcgatttttcttttctttttctttttccttttcgggtgtgagattcctgaaaagttcaggaatgcttttggctgagttcctgcgtctctgaggaagataaattagtttatttttttctgctattacttggatttatgtgctgctatcactgttggttcgtgaagggtaagtttttgtgttgttggctctgcatgttggatcatgcgtgcaaaattaggtcgtcacaaggattatgccgttttcaagttaccttttgagtaaagtctgttgttgcaaaggttctgttttatttggccagcatggccttacattactttggagtttggagaacaagaggttacaagttgtcgaatttttatgctctttttgtttggtgcaatttgttagtgtttatttttttaaaaaaattctggtagtgagaaggttctttcataaaatgtttttgcagggtcatatttttattcagcaacagagactaagctagtggttgacacatcaagaggggaaaggctacgagttaatgttagtatttatttgattgttaaactagattcatgtcatatgttgtacttctattgtttctagtataaaatgcatactcttttgtatgctattcacttacaatctgttgggaactaggtgtgaatatttcctgttaacttctaatgctaaaactgttttgcagtttgacgtaacttttccgagtgttccctgcacccttctcagtgttgataccatggatattagtggagagcagcatcatgacattgtacgcacttatgctatatcatcttctaattcttagtatgtgttgatttgtccatcttattattccattgtttgttgtagaggcatgatatagaaaagaggcgattagacgcacatggtaatgtcattgaggctagaaaagaaggcattggtggagcaaaggttggtgatcactgctttagttacactttgaggttgagctcattaataaactaagtgattccccgcgctttgctgcgggaattaccaaacaattctcaatatatatttttcgacaatcaagatagcagtaaaaaggaaaaaaataatgaaacatcagggtttatcggtacttatcatgaaacaaacaaatgatatccgcgctttaatgtgaaacatataacatattataaaaatgatagatagatttgttaaactattgtgcaaatgatgtgaggggtggtgattagatatgcttgcatgttgatttgtagaattaaataaattgcagatgatgttgtatgcttgcatgtcttaaatatgtaataattgctagtgggtgatgatgtgacattgttgcatgttgagctttagacttagtgagctataactttatagaaagtatagatttaaaatatcgaactagagtcgtctgtacaaattattcttggtgacctagtatatttccctacgatgtacagcattgtagttgttggaaaacaagtggaaatttaagtacttaaatatttttattgtcaataccttattttttacatgaggacataacgtgagcatagcatgtataatattacagattagaatataaccgtttgtggactgtccatatgctgaaaacatactccagtatccacttaaaacatttccttcttgctgccttgtatagatagagagtccattgcaaaaacatggaggaagactcagcaaaggtgaagaatactgtggcacgtgttatggtgctgaggaggtatgcacaatcttttctaatgggaatgtattttgtttatacctcttattatttcagctttctgaacttaccttgttctttgttacattctaactccggatggctttctggacttcagtcggatgaacaatgctgtaattcttgtgaagaagttagggaagcatataagaagaaaggatgggcccttacaaatcctgatctgattgaccaggtatattagttattttggcatggtttacctagatatatccattgtttagatttccgttgagttctcttgggcttagtttaagtttggaaaatatatgtatggcaaataatgttgaagattgcaagataattaatatagtctatatagaggtagtatctcttaagaagccactattactggaagtccctgagaaatgattttattcctcagtcccatatctgccttgtttctctccactaaccaatagaacaacaaaaatggcctactcctgacgtagtggcataccgtatag

SEQ ID NO: 40761 - DNA, 12833 bp, Oryza sativa
atcatcttttgcaaagtggcatcacttgtgggagcgcaggcagttgtaaagactgatcctggtagcagttctagaattgtaagttgcatatgacctggaactttctgatctatctttcaacctcttcaattgagttgcctctgcatctgcaagcatgccttgcctgttcaacagtaggattgcagtgagttgtttgtatgagctaacaatgcagagtcaacaccccagggtataggtgtctcttaattgttattatgatcaggtcaatagaaaaaaagggataagagtttcttgttgttcttttttttttgtttgtttatgtaagatggatgtttttttttcttctattaattttttgtggtaaataaggaaacagttttatttttagaatctttcaattgtcaataatattggacccttttaattttctgaccctttttgctgagaagagttccttttccaatcttcttgatcatcctttgtaaattggtcattggtaccatacaaagcaaagtacaaatccggttggaaccaagccatcccagttgcatgggttacttatcttgtaaatgtaggttctttgtccaggcaccatgagcttagtgaatgaagggattcttgtgctcaagcaatctcctcagcatcaattctttcttgttgtccttggcatctgtgttcatcttcaagttgccctgcagccctgcacaatacaattttctttctcatcaatgctcttagatgcccagttctcgtcttttttctgatgcgccttgccggcatcctaatctcaatattccttgcgcagcacagaagctttcagtagctttcacagaatatatgctgcctgagcgtgcaaataaactatacgtagcgacgactatcttgcgcttagtgatagttactgttcagggatgctttcttgatcaactagtctggtctagtggttatgtgatgctcttgtagttcatgggcactgggggtttggggaagcacctgaaggattcattcctgatatggtatctaatgccaaatttgcactctatatgttttaccttgtttatgactgcgggtgtagtaatgttctctgatgccatgtggtagtagctagatttgtttgaacgtaatctaaggttatataagattacactgaggcaatgaggggggcatctttgatatttcttccttgggagtatcgttggagcatatggaatttctactcctggtcagtgcttttgggcttcctcactttttcatattccaatgatcagattagcattagtcgttgtcatgagaaatattcctcttagaatgtgagcagttgtgccacatttcgcttcctggtttatcgcaggattggaggtgcactctctccatgttaccaaccacctgctgaaaacttcgtttgtgctatttcgccacattgcaaatgtgcaaatcacttggtacgggtggcagaaatttcatcagtcaacagtcgtaattagatcgaaccttgtgtcatatgcttagtccttctgcctcatttgtttcactgtacttgtattaacagcatagcttgtggcctatggacaactttttgcagccgttttcatcaattgaactgaagaatggactcaagccatccaggattccagtcccagatgatgctggtggagcaaagtcaagaggtctcagtaaggaatgctttctttgccttcccattccatctctgatcaagtgaccatttgatatgatccactgagaaaaccaccacattcttgtaaactaaacagtatcacacttatgcaactcaaatcttcttcgcaggatgatttttttgcgctggtgaaccggttgccggagaggggcagccgaatcttttgccgccgacctgactgacggtgcaaatccccggtgcgggatacggtggaaggcgatcggccgaacccggtctgctccacggctcaattcattcattgtcaatgcgcgcatctactgaagaagctgataagctgtctggctgggctaaccgaaagtcgtgtgcaaatgcaatggcatcgtcagctcgtcgcggtcgtggatggcgagttggcgacgcgttggtgcgtggccgtgcgtctgtcttttgcttcgcacgatcatcagttttgcagttgccttcatcgtggctttatttgaccatgagctccggccatctgaatccccaggagcccattgatacgtgcacctaattaagagccacatttgcatgaagcattggagggggcaaatcctgaagctttcgtttttgcagtggtataaagcagctaagggcctgtttggtagagttccaacttctaaatttaacttcaggagttgggtctggagtagagttgtggagctgcctaaacccagctccacttctctagttcattttgtgagagagtttcatccagctccactctcattttaggtggagctgaaactgtttggctgggttctagctccaggagatgtggagctggagctgaggctctatctcttgttttttttcttcttttggaaagctaaattccctattgtaaaaatgtgagttttctaactgccaacaattatagttaactacagtaacatatttcaaaattgaatgttcttctaacatattgacgggtaagccttcttgtgaaaacatatataggccttgtttagttacaaactttttcttcaaacttctaacttttctatcacattaaaactttcctacatatataaacttccaactttttcatcacatcgttccaatttcaattaaactttcaattttggcgtgaactaaacacacccatatatgtttgagctttctgactatcggcagagcccctcagtaccgctgttacaattagttcagttttcacaacttccctattggtttttccggtgcatatctttcttcggagaaaacattccttcccaagtttcaacttctgtatgggttggttttaaatcttaccgtagattatttgaactgagatttctcgctttctactccacgtggatcaaatttcaacacaaaaactcgctcatcgtaatacatactcagtttttgtgctgaaaactgagtaactttgatccacgtggaaaactgaactcagttataactcatcgtagctttgatgtattacgatgagttataaccaaaagtataactttcagctcaaacttatttggactaaaaatgtagactaggtttctttgggccaacagtgactacgctttcaggagtggtaatcctcctgagggcactattgaggtacccctcctctctcagcaaggagttctgggtgaaaaccttgtccagtctttggatggacgacgacggcgtcattcggcgtcgcgaccttcgtgagggcgtcgttttttagagtctccgctccgtggtagtgttgttggctcggtggcgatcggtctcgcatagcgacgaccggttcggtgctcgacttccctctctgtggcgtgtgtttgggcggttggcacttggttcgggacgtgtgctgtggtgcacatccttcctcgacagccagttatcgatgtaaaacttctcttggaacattttctctttatcttaataatattggatgacctccttcggtcattccgaaaaaaaaaaagttcagttcggatcccataactttcaaccaaaagatgaatagagttctctgtacatgaaaacccgaaaactctcaatcatgatgatcaaagacttctctgtaccaaacgagcttaaagaaaggtaggagctcttgccaatcatccaagaatcaaaataatctacattatcttctctaaattaatacccataccaataccaattaatttatatcaaactatgcctgagcacctcgtacattcgtaacgaataataacaggatgaataatgcaaagccagcattgatcccagagacactaaactcggttcttttgatcacaaccacggaccattgccaagtccagagttcaattaaggattgctgcatggtaaaagttgaaccggatttagatgcgatctcctaagatgtcgtatcatttatatataaaccgcctaataaaccaggggctagatgatagattattaataaacttgcggctgttgttacaagtaagcagacaaacagaacatctcatgaagcagaaaaacaaattattccagtccacaaaggttcatctcaacatctcaggaaatttaatcactttcgaagaaaggataagtagtgttagccatggcagattatcacaatttacataatcttagcatgaagtagctccatatatagaagaaattccatcaaaacaacgttgtaaaactaccagagctgtagactttttacccacatgtttaaatttcggcaacacttcaactgcttcaaaaactcagtcttagctgcacttccctactcatgaatttttacaagaatctgtaacgccttgtttgtaataaataatgaagttgatttatggctgatggttggcaattagctaacaccatcacttcctgaatatgccaatcatgacacatgagtggtgtgccattctcagagccaagacgaaatcaatgtcccaacatgcagaaccgactttagctgcagtaagctgaagcaaagcaaatgagcacagatgatatgacaatgcctggcaagctttctatgctgtgatccatccaagggagatgataggtatggaaaacaacagttctaccaatctgggtcacttgtactatcattattcacaaatcgcaacagcagcagaaatcaactgtgccctgcatttgggttggttccagaagtgtgcggtgattgttgatccgtagaaacacctccagcattctgtgcctcacgagttgagaatagctcattcaaccaaggaacaatagcccagggtctgttactgctctcgctgacgtttccagggccatcagctctgacttcctcatggctgtcctccactctaccaatgttgctaggctcgttcaagtcttttgtctcctcagaaggcagctcaaaccggcaaaccgggcaggaactatgtaattcaagccatggcaggatacaagaagaatgaaacttatgttcacatggcatttgtttagcctgggaccccacctcaagatcatcaaggcagactgaacagctgacaacctcttcgattttcacagtgggcagcgcttcaaccgcctctttctttgcaggaggggtaccattccgacttgggtcgctctcagccaaatgttgaagcagcaggctcagacctgctccgaggacatactcctccagtaagccatcatcatttgttgaaccgccttggtcaccttggccctcatcaggatcaagcactgagccttgcagagcgagggcttggttgaaggcgttgatcagaatggaactgtccctttcttggtcatctgcaaggtcatcatggatgctgtcaagcacgcgtcgtagagttgatgcccgtcgatgcctcctgataaaaccctcaaactcacgacctaaatcattatcttcatcgtcgctgtccatcgtttctcctggatgctcaatagggttccattgcgagaaacccggctctggctgcctgttggtcagtctctcaatctcctcatcggtcatctcttcaacgaacccgccaccacaggatgggcacttgatctcatccaccatggcctcctcaatggcctgctcgcattcatggcaccagtaccttgtgattgcagcttctgccatcttgcaaatccttcggttgacggcaccacgatcaaaacgcaaatctgtgaaccgggcaccataataagttaataatccgtaagattcccaagcaaacaaccacgacatacacattttttatcatctacacgagagagtccagcatcttgccagaagtttaatcaagaagaactgaaacaagatgaacactacggcatccatccgtgactggatttcacaaagacaattgctggcatacagatctcacaacagatcagcatcaagaacaaagaacaagggttagctttgcatccaacacacgaaataaattagccttttttgggttcttcatcaacaggggcagcaagctgtcccagagaaaagacccacttgggggggatgaggcacagcactgacagatagatctttgcgaaggggaaggcagagatcaagagccaagattccctctccaagaatcaggtgctcgattccaattctttcagagaacacgatgctatcccccccgaaagaggaataaaaacgcagcagaagtctttggtttgggggttagaagaacaagaaaccggattccggcactgctcaagattcacgccattgcaccccgtataatttcgtcgcaggactcatcttcccccaccaaaatttcctctttttttaaagagaaaaatctctagattaacatacaagcgatcaaagggggaaagatagaaatcgtctccatgatttcgaacactggaacgaaaataaaaagaatccccttttgtatcaaactaagcagaaggaaaattcaaatcaagaagtgactaacctttcgattggactgggatattggattggatagaggcggtcgtcttgttctcgtttgcttcgggcgaagtgtgagacgaagaacaagaagttcagagggcaggtggctgcaaagctggatactttactccatccctagaggttatcgtactactaccaattttttttctctcgttcttgaataagataaagttttttttatatgatcctagcgcaaatctccaaccaataaagttttgttatgactaagcatacaaatcacgcaaatccgctgatcatcttgggagattttttaatatctgtaaattggagtttggctgataagaactcgttttcatccaaaagcaaaactacctaccagactagtatgctgttggcttctcccttgtattattggcgtgttaatttctataaaccattttcaatttattagaaaaatcttgttataatcttttttttacgaaataataagatatgaaatgtcaaagatataaatgattttgtcaaaatattttgtttctgatacttttcagcgaaactgtcgacgatggtatttgtgatacttttcagctaggcagcgagggccttatcttttcgcttatacttatatttatcagccaaagattaaaattttaacattaaatttgaagccaattttaaggtttttttatcgaagtttatttttcagctttgctcttagatcgctaagaacacatataaagttttattcacaaattactttcgtttgcaaatatgttattttgcttattcctgcaggttaacagcactgttcaggccttgctaaatgatcctgtctaaaaaaatcgtttctttaaaaggagatttgtaatttggccaaacatgagtagatgttgtttacttcttctttttttcatatatgccatgtgtatgacatgtggctttggtgatgatttcccaggtgtagcaaatgaacactaatcactcaattatggggcaaaagagcacaattttcttcttttaaaccacttagtgtttcaaatacaagaaccgttaggatttcttttttaaaaaatattttaaccttttaaattttttaaaaataaaccatcccaaacttattactaaatctaaaccttgacagcagtgccatgtccaatgtttatcacatgttttgttacgccaaatggagtgccatttttaaaatgttcaaataatttttagatagtttctttttgaaaaacaaaaaattaaaaggttaaaaaaatattgaaatgccaagaggggcaaaggcaaccatatggtttacttggtcaacctaaatctgcttccaaaaggttaattaacctctaccgtaattgggtaacttaatcacgacgtactccacctgcctgtcaatgtcatactttacacctgattagtactcctacttactatacttattttggaactggacctatctaatttctcctagtcagaaccaaattttctcctcagaaagatcccatttttttctcatagaatattcacaagctggtacttctagaagataaagaaatgttaaatccggaccgacgatctggtggtctactcgccgatgtcaacgtgccacctgcactttttgggcctaaaatgggccatacatgggccggaacccggcccatacaggtccgtgtgaaccaggccggatactgcggcccacactacacggcctggcccatgaatgatcggagatgagagcaagggtgacgtcagccatggcggagaagccaatccacctcctccctcccctccacctcgccgccgccgccgccgccgcatctgccgaaggcgggagccgtgaggggaaggacctgtggcacgaggtggtggcggcatggagttcctgcaggggcagagcacggagaccgccgtggccgtggcggtggccgtcgtcgccgtggccgccggcgccgccttcctcctcctcctcctccgcagcagcaagaagcccaagggtatgcacccgcgagatctctcttcactcgacgacgctgcagcttccactgccactgaccactgtgatacaccgacactgatttagtggtcatttacctagcgatgtcttcggccttagccatcggttgcttgcatctgttctgcagcatttagagaatggttttgtgattgttaatgtcttcttgaagtaagctagtatcatctttggttcatagctcatcctgaatggttgtgctgtgatttgttccattaggctgcttggaccctgagaacttcaaggagtttaagcttgtggagaagaggcagatcagtcataatgtggccaagttcagatttgctctaccaacccctgcttctgtgctggggcttccaattggccaacatatcagttgcaggttgggggttatatcatatgtcttcttgcttctctcatatcttttgtttctcttttacaaagaattgtgttaaatgttatctcctgttcttgcagagggcaggatgctactggcgaggaagtaatcaagccttatactccaactacgctggattctgatcttggacggtttgagcttgttattaaggtaaaatttcacaaatatgttccattttgaatttgttagtcttgtctcgctagctttgtgcgtaatgtaaagctatagtccgtcagaaatgcaattatgtcaattcatccccctttcctggtttcccccctaatttttccttctcattttgaagatgtatccccaaggaagaatgtctcatcattttcatgagatgaaagttggtgactatttatctgtgagaggacctaaggtatggctttatttctgttgtaagtaatacagaaattttccatgctgtatttggccattcttgtgatgtataattttttctctgacttggttataaatctttgtgcctgtataaatttgtctgtgacttagggtcgcttcaaataccaacctgggcaagtaagagcatttggaatgttagctggaggatcaggcattaccccaatgttccaagtaagaccctttccaacaccaattttttttatggcatttaatatgtgagacacctgtgttcttcaattcattgtcctcccttactgtaggtcacaagagcaattcttgaaaacccaagtgacaatacgaaagtgcacttaatctatgccaatgtcacatatgatgacattcttctaaaggtatgatcttgttgaaagaattgctgtagttctccaccagtgattaaccttactggtgtttgttatatttaaagtcgcttcaattcatgggtgcctattagacttggatactatatgctctatccgttcagcttatgatattaagaataagaatctggtatgtctggtttttgaataaagggtagtttgtctagttgtagtgcaaagttagcaggttataccacagaaaccttgaaaatatcatacaggacatgtactttgttaccagataaccagaattccatatatgtcgtctcgataatcttcttccttaataatctggtaacagcccactttttaattgaaagtcaaagatgatatgcaaactatctctcagtggcctaaccatgaacacaatcaaccttgtattgtagcttgttttgctatgtagagtcctttctctttagatctgttggagaaaagtaaggttccattgttgaagtaatgcttcatatgtgcttttcgataactgaatgagactactgcatagtttctgtaagatgaacgtggttcaatatgtagtacgatgttgtgcttgaaagctgatgtttgctaattgctgctgctcatttacttgtcgctttgatttatgcaggaagaattggatagtatggttgaaacctatcccgatcgcttcaagatatactatgtattaaatcaggtttgttttctgttctgaggtctagtactttgtactgtggtgtgcaataatttcatgcctgaactgtctactttggtagtcccatcttctactacttactgctaatactactatattatggcttgcattaaattcctaccatgcaccttacaccatcagctttgttttcatgagcagcctccagaaatctggaatggtggtgttgggtttgtgtcaatggaaatgatccaaacccattgcccggcacctgctgctgacattcaggtaggtgtcacattgtgatgtcttctgtggtagcgtgccttctggaacttggaaccgacaattgctaagagaatagttgaagtgtattccatctaccaagcaggacatctgtgtgacaatgtatggttgctcctttcagatattgagatgcggacctcctcccatgaacaaagccatggctgaacacctggagaatcttggctacacgaaggaaatgcagttccaattctaagcctccacagtggaacaataccgaaataacagcgatggacaacattttcgttcaccttcagtagaaattgtctgaccctagtgccatttaatcaagatataggcgaactttaaacccgataaaagtagaatgtcaggtcagcatattttgagtgaaagcaaaaaacaacacctacttgagttggggtcagaagttcctgtagcccatcatttttgtgccaatgctgttcaattccagacagacagaatgaaactaattatttttttttcaatcagaattttggacacaaggttggaacgttcattgctccagctaactcgttgctcaggtgattaaagaatgaccaacttgtaccatttgattatgagaagaaaaccaactactgtacgtgccatttatgtctgtccatagatgcaaaaacctgtgacagcgaagctgttgtctgttcttttccagctcctgtcctgtacagccaaaacagtgcatcaattcatccgcttgtttatgcacaagattgcaaatctttgacagcaaagcaatcgccttttcttttcagcagctccaattgatttggtattacatacatacaaaaatgcattgtgtcttgtacgttactgtacgtatgtgctggcttcctaggagacatcagcgaggagattacgtccgcctgctgggcacacaagcattcggttccattttttaaagtaaatttcgggacattaaaactattttatcaaaactatcatgttgctgcaactttagttagtcatttaggcttcacctctcgtgcatgcaaaacagagcgacgtattttcttaattttaatatatttatatgatttttttaaaagtagcttttgtatagaaaacttttgtaaaaaacacaccgtttatcaatttaaaaagcgtacgtatggaacacgagagaggcgagttggaaaatgtgggaaagaacacagccttagagaactgtgtagaactatgttttatagaaaactatagttttatttgtctgataagtttagagcccttattacacacatggaatattgaagctattgtaatttaggcccacatgtcgtatgtagtgtacaaagttgtagttttctgataaaattgtttactattgttgtaattttgtgaattatcaattccataatttgcttgttagcttatcaaccacaatcaaaatttgaattttaaaacgcaattttagagtggttttgagttttttttatcgtagtgtatttgtccagtattgccttttaatatgttaaggtcatacatataaaggttttacccataaattatttttattgcttcatttatttatttttcacggctcatcagttgtacattaagggtctgttcggttcagctgggctgtggcgctgcagctcccctagcataatcttgcttgctgagtcctgtagctgcagtgctgctgctgccacagccagctcttccgaattcactctaagcaatgagagacctggttgaagttgtaacaaggtgatagttatcaccaaatagttgtagttttgtgaaatctactttttttaaaaaaaaaactacaaacacacattatattatatatatatatatatgccaaaataaattctacagatgtactactacttttgtcaaaacattttgttaactcagaacaaatgatggcagtgatcaacacagagctgtaatttggggagaagcactgagctggtgctataattagaatcttcgaggttaagttatctcaagctaaatgtggctaaagtagaagggacattgttttcagataagaccaagctttgatgtgtaccttaaaggttattatgtagtaggcctccccctacttctacttatttctttgggttgcacatatatgactttcttctcttgattgcccctccct

SEQ ID NO: 40762 - DNA, 18739 bp, Oryza sativa
tttgtcaaactataaatgaattaattattgttcgtctatttttttcattggttaaaacaactggatttggaatgaatttaaatgcaaacatatatgattatatttaaacttgtctaaagtttgtctagtaaaaatttcactagtactatctatgtttttaagtaattgttagtggcgattattattgctttattttgaccgcaaaataccattaaatggttaggctaggatgtgcggaagcgttatgattatgtttaggatgcaatacatccgtaagtaattgtttctctaatgaaaatgagttgtcgaggtttaaagatgaaaaagtggatttccccgtgcaaagctacataaaaagtacaattggattggatttcatatacgattatgttttttatataaaactggtaatagaattaatattcacatataggagtatctccctacgtacggttgtaatttgtatacagtaaatttaaaaaagtagaattacatctgatataccggtcttacgctcttagattttacatttttatgtgtttcatatcaaccatatcgaccaatctacactggtatagtttgaaaccatgttaaatttagtaagaactttaccaaaatcagttcaatcaacaaaaacagttaagtaaatttcacagaactacggatattccgactaatctatcgcaaaactaaaatatcgtatcacaaaactataaatttagcggtaaatttactataaaactacatattatatattgaagttatcacaaaactacataattaatattgaagttatcacaaaaccgcaaattctagagtctaaatccctagtactaacgttatattagagctatataaatgttgtagttctatgataaattagcactgtagttttgtgatatatttgctacttaaccttttttttttttgacactccattcaacatgtagttttgtgatataagattttaaatttgtagttttatgaaatttacttaaaaagatgttcccatatttatcattgcattattctgtctggctgtctgccatcaagcaaaatagtcttgactcttgagaaggatgttgccttgagaaagatggtgcttcaagccttcgactcatcatggattagttgagttgaccaccaccaccaccaccacaccacgacagacgggccaatccacccaaccgtctccacttccctccccaccgcgccaaattcccaccccctcctccgccgccgccgccgccgcacgtgcgcctccacctcctctccattgccgccgccgcggcacggtcaaccacccccacccttcggcggagtcgcggaggaatgcggggggggcaatagaaaattcgctcgctagcagttggcatggcggattagtttaatcttgaagtccttggtggtggtggtgaggaggagggggaggaggaggggattgggctggctaatggccgggtcctcctcctcgtttggctcgcagagcagaccgcgacccgggtttgaggggggagcagctccgcgccgcgctcgcggttgctggctgaggccgccgccgccttctcgggttgggggagtggttggggagccgttgggttcttcgctgctggggttttagggatcctaggctggcttgcttgcttgctcttggaggaggaggaagatcgtgggggtggagggtttcttgcgggggttggccggattttgattcgtcgcccgagcgggtgggttcctgtttcatcctgctgctggaaatctgtagaattgaatttttgttttctgattccatatgctcgatttctctttgttcctgttcgcaacttgtagaaattatggtggaagaattctttggtttgagaaggataatgagttgtgagaaaggagatttttggcatgaaaactactttttcttttggtatttgttggcgttgtggcgcgggaaatgtttgatttattacttggaatctcttacagtatttacaggcatgtaattcatgagagaccgcattgataatatttcatgagacttactaggtagtggatttttgtacgtcaactgttgctcgaaatggcactgtcataattttagtataattatgatgaatagttgacgatacttaattctgttaaatttttgttcaggcttgatactggaaaaaggagaagcttccatttttttttctctgacttgaaaggggatggccttcccagatgatgatgaaaagatgaaggtttgtgcttttcgctttacatcattcatataacattacaatacactcacaaaaataaaacatagcagcataattctattctcagatccactgtgctctatttgcatgttttggccctaatattttttttttcatactgaacttaaatcaaagtatttactttgtaattggttgtatactatagggttgccggccaaaactttttggaacaaaagataagaaagttgtgaagagggcagattaccaaagctgttctgcaggttagtttttctttctttttgaattgtgcatctagactgaattggtgtcttgtaggatagtgataaattgaaacgaagatgagcataatttatcaaatttcagctcatctagttgaatcaggggaattgctcaagtcagttgggcaatcagccaactacattcataaggtcaactgaacctcgtttcattgtgtataatgagaaatatatgaggagacagccagttcaaatatgtttaagaagatgctaggattcatttattctctagtttcatacttgataacttcgtgtcagaaatttcacattttgcccgaattgcttcaatacaattacgttgatttggcctaatgacaataatatagcgtaatagcaactaaatgtttccatgttttcctgtcaaatgcagttaagtccgggccaagttcctcaaagtcacaatcttcttcccccttcagaacacttacaggtggccttctgtttagcatttttgccacattgcctcactctattcatgtgctgatttgttttgattggattattttttggttctttggactgaaaggaagtttttgcagaagttaggagcatacgcctcagccatttacttggtcactcttcaagtactactaaaactgaacctttcaggtcaaacagctaaacttgcatgttgagtcatactttatgccgtcggtttgtcatactttacattcttagatcggactaggtcgtctttaattttttaattcattatataggatatttgtatctacatggaatgtcggaggaaacacgcctactgctgaattaaacctggatgacttccttcctgctgatgacaattcagatatttatgttttagggtaagttatttcaccaatttttcaccatcttacatatttttcatatttcagttagtgagtgatatgaaaaataaaaatagctccttttaatttgtttcctagtgatttcaggatgttactaacttgcttgctttgccacgatgagctaattttccttagtgttcatttgtttcattcagtgaaccgaagacgctgtttccatctgtctcttttctaatttttttttgacacattctcttatgatattatgcagttttcaggaaattgtccctctcaatgctggtaatgtgcttgtcgtagaagacaatgaaccagctgcaaggtggcttgctcttataaaccgaacgctaaacaaaccagttgacagtaatgctgatatcttccagcacaagccatcttcttcccttgattcaacctcgtctctgtcttcatcaaaccttgatgcctcattctccagccgcacaagaacagctagtggtagttctgcaatcttccagaagtcctccttgaagtctatcaggaagccttacatgccaacccagagaaaactgctcaaactctgcaattgctcagttgagatgactaggaagtcctacaaagatgcttgctttggatgtccacaagcatatgctaatgagacggactcttcagaagatgatacagatgatagatcgaatgatccttgtggttatatagttgatggaatgaattctgctgcctctgcctccagggatcagctaaaatacaacctcgtatcgtgcaaacgaatggttgggatttttatcacggtgtgggcaaagaaagaacttgtgcatcatataggccatgtgagaacgtcttgtataggtcgtggaataatgggctatctgggaaacaaggtaagaattaaatcaaagttcagaagtattatcttcataaccttgtaatgggatgtcattgttaattaaagcattacaatggtcacaattatattaataagtacagatttagcctgacatgttttttgataatgtttaatagccggaagtcatccttctgttctttctttttttttttttggagaaagagagggggacctctcccatttcattaatgaaatgatagtagttctacaagcattccaggttccaacttacacacaaagtctcagactactcctgaccttcagaattacaccagacagactaacagagcaacacagatgctaaagcaaacatttcagctccttccattctttttagtgtgacatagtaatgagggttcttcacaattctcatgtgtagattacatatttatgccacacttgcttttggcttcagggatgtatatcagtgagcatgacggtgcaccagacaagtttctgcttcatctgtagccatttggcttcaggtgagaaagagggtgatgagctgaggcggaatttagatgttttagagatactgagactcacgcaatttcaaaggatttgtagagctgggcgaagaattcctgagaaaattcttgaccacgagtaagtcatgcactcatgctacacatgctgcgaaggatttgttcattgtcaatcatcatttactaattattgtgatttctcttattttgttagtcgagtgatatggctgggagatctaaactaccgtatttccttgagctatgaagataccaagaaacttcttactgaaaataactgggatgccctttttgaaaaggaccaggtaaacttctcaaaagatgcactgttttttgaaacttcctctcagaaggaaaggactaaagtaataaacgataaaaccaaactttcaagaacttctactgtgtatgtgtgctctatgttctaattatatctagccaggctataatctacttatatcttgtgaaattttggttaacatgcatggttgccttctctttttcagcttaacatcgagcgcaagtctggaagggtgttcaagggttggagtgaggagaagatatattttgctcccacatacaagtattctagtaactcagattcttatgctggagagactgcaacatcaaagaaaaagaggagaacccccgcctggtatgtaccgtgttcatattagttagttttactataaaaatgtattcccactgtgtcaggttacaactttattggtaagttagtaccatttaattatcattataatttgtccacatgcttgtgtgcaacttcagtaatccaacattatcatcttatattaccatagaagaggaacatcttttgggtttcttgacgtgaaacagtgcgcatttggacaaatgttggttgaagtcgtagaaatagaaaacgatgaaatcattcacatgaacaaatattgcatcatactaacaaatatatatcagacaaatggcttggtgtactggctgtgtgcattgcactactgctgcacattttgcatttcaaatgttaatagtttcaacttgttcaggtgtgacagaatactatggcatggagatggcattgtgcagttgtcctacttccgtggggagtccaaattttcggatcaccgtcctgtctgtggaacatttattgttgatgttgaaatacaagagagcagatcaaagaggcgatcatctaataccaacatcagaataggtgctgaagaactcttaccaactagtaagagtaaggctaataaaaataagggcaataaaggtatgcagcttcttgactcttgatttaaatttaccataaaaacaacataatttccagtatatgcatggacaaaactaatttgtatgggcattgcacaggttctgggacctaaaccctattggaaattaaattggtagcaacagcaacttgtactaagatactgaagaatatttccatcggcacctgtaggtatttattccaaagcagattatttttttgtgacaggggaaaggtgattaccaagtcgtacagaaaatgtagtgcatatatactttccaaagggaaaggtgattatattatactcgaacaattttccacattctttttgttcttttgggtagaacaagtgtgcctatgcatagctatccagaatccattgacccccttgtattattgtgtctgtctgatcagtttgaacttttctgtaacaaaattgtactgagaacgaggcattattccaaaatgtacattatgttatctatctatctatctatctatctcataattgtctttgatttgccgattattatgtgactatctcatggataaacacaaattaagtatgattacaatgtacagtggatgtttcacctgagctacgtctgtaaattttcctttttgttcagtataattttggtcacctggccaagtgcaccatggtcttcttgtctggcttcgatcgacttctttctcacgaatgagtacaaacttttgtgattttcagctgaatttcattccttcaatcacattaagaacatttatgcaaacctattttatatctgaattctgctcaccttgaagttcaacggtagagccttagagggttctgcaactggaagccagaaatgcaaacttaacaagaaaggtcagcatttctggtttccctgacaaatgagtgcagttgttagtgcacgaagcttattctgcagaggaactgtacatcaccacatctttatttggcttcaacaattagccttatctgttacctgatttgtttcttatcactgaacaaaatcagctagtagtagaaaatatgttgtcctttctttcctcaactactgttttgacaatgttatgcgagggaatgatgtgttaacatgagacagcatgatgaacttgatgcccctgttttaatccaagtagaagtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgattaaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctcctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgccatggctccggtgcggctcggggctcccacttccggcgccctgctgcttcttgtcctcctcctcatctgcggcggcggcggaggcggtggcgttgctgccgggggtggaggcggaggtggaggcgggaaggggagctcggtgtacccggcgcccgtggtgtacccgcaccactcccgccagatctcctggaagcccaggttcactttctctcgctcgcgcgggcgccgccatcggttggttcttggtttcgtctcgatctcgacattggatggactgactgatgcgtgatccatggcagggtgttcctctaccagcatttcctcagcgacgacgaggccaaccacctcgtctccctcgtcagtgcccaccacctccccaatccaacaaattttcatttcttttctctgcatgaatcgggagttcttgtggatgcttgaactctgtatgcccaggattcattgagtttttagaggatttatgtttttttttaggcgagaacggagctcaagaggtcagcggtggctgataacctgtccggcaagagcgagctcagcgacgcccgcaccagctccggcaccttcatccgcaagagccaggttaggtcttgattaacgtttttttttctttgaattatttgttcatccggagtgtgagttcatcttttttattgaaaagtatctttgaataaagggggtcttttagtgtatgaagatagatgtgcaatataacttaaagtagttcttggctaaatgagaggattcttcctcccaattttgagaattttcctttaaatttacataattcttatgtaatgaacaatcatgtccaaatttgtaggatccaattgttgctggtatagaggaaaaaattgctgcgtggacatttcttcctaaaggtatttgactccattaagacaataacaatgcactttactattcatgcaattcttagatgttctatataattcataacttacacatgtgagatattgtcattttacacctaataatcaacctccctctgggcctttgttttcgttcctgtacctatgggcagtcttgaagtgaaagcctctaaaatagttatgctccacttggcatttcatttctaaaataaacaaagtaaagcctttaatgttgagcctccttacctgactttggggctaattcatccaaaggttagtttcaagcagtatgtcattgaaaaccacgctcaataattgttttttttttcctttttctttttgggtggggattgatagtagggattcttttttatgtgtcctcatgttgtcttccttcatacataatccaaatttatgttaactttatgtgtttttattttttttcttgtacatattatgtgataataatcagagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatccaattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaagatgtgcagtcggtcggtgcgttgtgtccacattcacaaccgccttcattcattcattcattcacttctatgtgcatcatgctggcaaaggcatttgtcattctgttttaactactttgctgtgagattttcttttttgccgtgaattgtgtcacctgtaactttgcaaccatgaacagataatctgcagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtaactaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatatgaacaagataagtatatacgtccttgcaaggacaaatgtcatggaatccagcaagttttacatcaaaaggaattttatagttacttaatacgtctttaaataaaaaggaatttgattatgatcagcaaggaccatacaaacaaacagccacatcacccccagaaaatgatagctagttgagcggatcaatcaaacgattctaaacatcccggcgacgacgacggcggcggcggcaatggcgacgccgacggcgacgaggtggtcgccggagcggccggcggcggcggcgttggtggacggcgtcgccgtcgacggcggcgaggcgaacggtgaggtccctgcagatgaagttattaaggtcacatgaactcgaatttagcggccgtataaatacgtgacaggcacatgaacctaacggtacggcacgtcagtgtttactgtcgagcaattaattgccatcataaactgtatatgatgcttttgtacatgtagccgattaaatgtttattcctctatgatagcatcatcacaaattgtatgaacaacaaccataacgattccctcttcttttttcttttcttttttttgcgtgtataaggcaaagcatattagacaatgtgagttaggagacgtatttactggtgtagtatgcattagtagtgatgtgttcatcagcatcttttttatacagcgtgaaaaaagattatttgaaaaaaaaaatccggctggaaacacaaatctctggttaaaattagatgcttccctaaatctttgctggtatgtgacgtgtgtattactcagcttttatatgttggaatttcaaaaaaaaaaaaggtgggcaatttcagatatttcaaacgctaaaagggactgatttactgaactagaacaatatctttgccaaactaaatcaaactaaaatatctatagccggaggctcctcatacattaaattcctaatacttcatttcaaaattgtgaacctcctgccttagccatcactgacaaacaatcaaaattaaactacggatatttcatatttctacaattctactcaacaaaagctatggcgaatgatcaagctaattaataactccagttttcttaaaagtacaaaacgaacaacataattagtgagagcaagtacatgcttaccagggaactgtgggccctcaccggagggcgagacggctgccggcgaaggcgacggcgttgggcccattggaacattgaatccaaaggctgcaaaattaattatttcccaaacttaattagcccataatatgcttactaatcaaaagcaaataccctcaccaaaagtatagagctattacttttatcattaagacctatatatcctgcatataacaaaaaccaaaccaattctagcaatcatttgctcgattctgtcaaatcaatttcactcgtatgctcaatatgcatatgccaaaagatgagtagcatcgaaatcaaataataaatctgaaaccattttacctaatatagtagtatattagtatgcatataacaaaaacaaagaaacatatctctatatgcaaccaataataagtaattaagatataaatctagtttaactttttttttatggagagagtgctgctgctactgctactagaagtgattaaagtgataattgggggagattaataagattaaagattagggaggtgattgattgcctgcgcaggtggagacgggaggggtggagacgcggcagatggcggggagggcgagggcgcgggagtagtcgacggcgatgccgtaggagtcgccggcgccggagaggagctcgcagaggcacaccgggttggactccaccagcccggccagctccgggcagcacggcttgtccggccgccgcgccctgctcccgttctgcacgtacgtcaggcagtccgacatgttcagcagcgccgtcaggcacgcctggtccagcaccggccccgctggccccggcgccgccgccggcgccgactgcgcctccgccgtcgtcgccgccgacgccgccagtagtactactacggcgactgccaccgccgccagcgtcgacgtcggccaccgccgctgcgccgccatggcgcgctctctgggggctttgatggcgagtggttcgttaggcggtggaaggagaggagaggagaggaatcgaaaatgaattcggaggcgtcgtgtgacactggcttgtcctgcagggtacacacgtatatatagagtgatgcgtctttttttctaaaaaaaaattcaggttacacaccaccgcgtccaccttgccagatataaatgtgttcacttagggtgtgtttagttgaggaaataaaaatttttgggtgccatattggacgtttgaccggatgtcggaaggggttttcagacacgaataaaaaaactaatttcataactcgtctagaaaccgcgagacgaatattttgagcctaattaacccgtcattagcacatgtgagttactgtagcacttatagttaatcatgaactaattagacttaaaagattcgtctcgcgatttcctccctaactgtgtaattagtttttcatttatctacatctaatgcttcatgcatgtgtctaaagattcaatgtgatgtttttcggaaaaatatttggggaactaaacgggctttaatacacgctcaacgaacgtacaagtagtacgtcataaataaaatctatatatcttgcgaaattcatattcgaacaccatggtggtgtttgaaattcatatatagataaggatgaagattaagattaaggttgtgtatagattccaactttttttcatcgaacttctaattttttcgtcacatcaaatatttagacacatgtatggagcatcaaatgtggacaaaaacaaaaactaattgcacagtccggctgtaaatcacgagatgaatcttttgagcctaattacgtcatgattagcacataggctaaaaagattcgtctcacagtttatagtcggaacctataatttgttttgttattagtttacattattaatacttcaaatgtatatccgtatacgtcaaaaaaaattggccaattttttacagcatctaaacacggcctaagtgttttacgcaaaacgatatggtatcaacgtatgattaattttttaattgacttttagttatttattttgtaaaatatccaaactttagagcaacttttatataggaagttttcgcacgaaacatatcgtttagtaatttttaaaaagcatgtcacgcatatccaaactttggtccagtttttgttgaagaaataaataaatctatacatcttgcgaaattcatatttgagcactatatgtatcccgagtcatgacgtttggtgcaagagcattttatccatgtctatctacaacaacaataatatatatggagtataagttttcaagaaaacagcaataatatatcgaacgcaattcaaggatgatggcatatgcatgcatgccgcatgaaggatatgagttgtggctatctagctagctagctcacattaatgcaccttgttgtaggagtaggatgcgtagttcttaaaaaaaataaaaaaagaaagaaaaatgtgtaggatgtgtacaccctccgtccgtccgataaaaaacgaatttagaatcggatgtgacatattctagtacgataaatctgaatatatatatgtctaaattcgtagtaataaaatgtggcacatataatactagattggttttttttaatagaacggagtacatgtgaaacaagaaactgcccgtgattaaatcctgtatctatacagtcgacacgcatgcattgcggctccggttctcgcggcagggattaaatcctgccgtccatcttcagctcgattcatcactgtccatcaggtcaaatttgcgcagttcacacacgccggccgcccgggccgaccctcgcgttgcatgatcgaataatatgattacggcgagctgttctgttcttcggttcatatgcatgatccgatgatcgatcgatcatgaggtgccagtcttttgcattgattggatcaaacataattctccctctgtctcaaaaataaataaacacatgtgatatgtaacatattttaatactacaaatctacttataaaatagaacttatattaaagagacaatccattatatgccactgagtttgtcacatctttacgatttgccactgactttaccacgttttataatataccatcgatttttacttaacttttatgatttaccatcgccgtccagttagtctccgttagtactgtacaattttgttcaaatgaccaaaatacccctgtgataaaacttccaaaatgtggacaaaaattccgaaataccatattataaacataagatagtaaacattcaaaatttgtccaaaaacttaaagtctgatatttcagaatttttatccaaaatttgaaagtttttgtctcaggggtattttggtcatttggacgaaagtgtacagcaccaacggagactaactggacggcgatggtaaatcgtagaagttaagcaaaaatcgatggtatattatagaacgtgacaaagtcagtggcaaattatagacccatgacaaactcagtggcatacaatggattatctctatattaaatttgtttattttggaatcgaagaaaatacgaataaccaagcaaagcttgtcaagtgccttcctcacatatatggttgtgtttagttcacgccaaaattggaagtttggttgaaattggaacgatgtgacggaaaagttgaaagtttatgtgtgtaggaaagttttaatgtgacgaaaaaattagaagtttgaagaaatattttgaagagtaaagtgcaccagcggtcctcaaacttgtaagggtgtgtcatctaggtccccaaactctcaaatcgtatttacaggtccctaaacttgcttagccgtacattgcctgtccaaaccccatttgactcggtctgctcgctgacgtggcttgccaacgtggaggggaggagacagccggggtggtgcattatgcattaagccccttattttttcgccagccctcagacgataaatcccccactcttttttttcctcggcgcgggaaggacgaaatccccgactcctcgttatcctcggtgtgggaagggcgaagtgggtgacgcaagcgagaggaggtggtgatcgccggtgatcgccgacaaccaacgccaatcgatcataggattggtagagagggtgggggagcgattctgtctgcacccatcgacggacgcgacggcagagaatggtggcaagattgcgtcgactaggtggagacgcgcctgtgtacggtgagtaaaatcaagccctaatccttgtatgctagcaggtttagatcgataataggcagtaatgtaccttgctgttggtagaaaatttggaatttgctggctcggttcgatgcatgttttgccgtacggcaaagctagggttttttgtttgcacaagtttacatgctgtatcgtggattgaaggatttgtttcttccttactaggtgatgggtcagatgagttcacagtgaaggttcaccagggggttttttcgttgggcatgg

SEQ ID NO: 40763 - DNA, 8573 bp, Oryza sativa
ccacaggcagagaagtaagaaatttcccatgtactttataattgtaatccatctgaatagtgaagtaatagtcccttttattgggtgcaagaactattcaaatcggtgaagcactacagatgcaaattgaggtgcagaggcagctaaatgaacaacttgaggtgaggtactgaccctgtttgcataataagatcttaacccacgataggcccatagagtagatggacatgacataagataaaaaaaaattcgagcatccagtcagcatgcccacataccaactaagagcataagaaaactgctatgaatgctgtatcatcttttttgtatccttcacaacagtgattcccaccaggaatgacccccaagataactttctccctctagtaaaagttaagcgatgttcagaatacatccagccaaacctttagaattcggtaccagtatctttatgaataagattggacatatgtaattgatcgggtagatctaccccaaaaattcctttcataacactattttctaactatattctcaaatcattgtacaatagaatagacagtattatgtaaagattagagaacttggatactctcctccagtttggcagcaaactatttttagaaaacagctaagattaatataatgcatatagtatcaacaatatgaattggctcaatggttctaacctgaagctaatttggtatcaggtacaacggcatctacagctgcggatagaagcccaagggaagtatctgcaggcagttcttgagcaagctcaagagacccttgggaagcagaacttgggccctgcaagcctggaagatgcaaaaataaaaatatcagaactggtctcacaagtttcaaatgaatgtctcagcaacgcagttacagaaataagagaaagttcaagtatacacagactagagccaaggcaaatccagtttgttgaaagttcagccaataactgtttgactgcagctgaaggattcaaggagcataggctacaaaaccacggggtactcaaagcatatgatgatagtacattattttgccgaaaacagtcccaagatcaagaatctcaatattcccttaacagaagcttaagtgagcgtagaatgggtcatctgtatagcggtaaacagtatcacaaatcagagggaagtgacagtgatacagaggttctacatgagtatatcacgcctcaaaagaatggcggaggcagcacaaccagttcaacatcaggaagcaaagaaataaatgtagagaagctatatcttgatgaaccaagctgcaaaagacaaacagttgactatcaaagagaaagcaagctactagattttgatcaacaaagttcagggaagaatcttgatctaaatactcacaatatagatgataacgatcaaggttatagacattttgacttgaacggcttcagctggagttgattagctgacaatatgtaatacaatcaaggagaagaaatgagcttacaaataatttcttccaaagttataactactttaattctgtaaatacattatgtaggccgggaaagattgtagctatctagagttgtaccataggttataaataattcaatgatgtatgaacaagctattgcaaatgttgagttgtaccacaggataactaacggaagacagcatattaattatggcactctcaatatgaatacaacggaaagcacgcggatatattagagaacagaaatgcaacaagataagcatagaaaagtacaattaacaaactgagaaatacccattcacataaaagaggcagatttgatgatgtgccactcttcagattgaagcttgccaccccatggcaattacatgtggggtcctctgagtcaatgatgtgtgcgccaagatggcaaatcatcataacagaaatctaaagagtggaaaattatcaaatctcaccagaacctaagcagtaagggggggaaaacaccagaaaccttaccgtctaaataacaccatcacctcaatttaataacataacgtagaagttattcatgccaccatgaagctgacatttcaggtttagtggtcagcaccaacatatcaggtttagagcttagtgctgcttgaaacaaaaaagaatgaaaaaaggacaaaagggaataactcatatattggtggactattgcaaatactgttagcaaacatttttcaaaatgtaagtgcaacagcaatgggattgcttcctccagaaaaccatccatgttacatagtactccatagcacaaataacagccagagtataaattgacaggtctggtcatcaacaaggtatatacgagttatcagatagaagtctatccaccacgcttatttatatacccaagaggaaatggccacttattgcataataatccaattaacagctgccaaccaaggagcaggctacttttgatttggcgaccgatcataataagttcataagacatgtatctaccacttttatttctctccttatgctcaattatactagctacaagagcagagcactgtgatagtattgctatgtatgtaacagcaagttcttatgatgaagcagtaacagcaatagccaaacagttcatggccatgggagtaagcggctgcctacttcttgatccggcgcaccttcttggcgccccagacctccatcctccccttggggcacccgcacggcgagcggaagatgagcacggtgcggccgttgggcggcgccatcttcctgagctccgcctcgagctcgcggtgcgcgtcgccgagctggacggggcgcgccccggcggccgcgagaagcgcggcgcgtcccccggggagcgggagcaggcgctgctgctggccgcggacgcactcctccgtctcgagctggatgtcgaactccaccgccttgcgcagcccgcggcaccggggcttcccgcacctccgcgcccggtgccccacggcgtcccacgccaccacacccgccacggccgcgatcgccgccccggcgcccgccgcggcgaacggcgcgtagtacgacgacgccacccccgccgcgtcgaggtcggacaccaggcccccgacctcggccgccaccatcctgacgtagggcgtgacgaggaacgcgagcgcggagacgacggccagcagcgccaccgcgtcgaccgccgccatcgcggagtggtcgcagagggacgtgaacagcctccgcctccccctccgcggcgacgacccgcggcgggggcgggcgggcgcggtgccgcaggcggcggagtccgtggaggcggcggcggcgtggtggcggtggcggtgctcgaaggcgcggaggaactcgatgaggctgcggcaatccgccatggcgaggaggaggaggggagggcgtggcggcctggcgggtggtatcgaattgggaattggggtggaggaatcgatcggtatcttgatcagatgggtcggtgggtggtgtggggtggtgcggtggccgcctgcgaccgcgagccggtcggtcggtcggtcggttgggatgggggtgcgggccgcgtgcgtggtgggtttcacgttggtcgcctcatattttcggttaaatgaagtactccatcaatatgaattaaaacaaggcatgatttcattttttttctttgttacattttggatgattggatggaagtgtttgggcaaaatctccacccaaaaccgctaaactgtttgtatgtcgaatgcaggctggtagcagataacatgtcctgagtgtgcggtctaatgcttcaaagcaatacttatgattaacatgagattcatcccaaacaatgagagatgtttttgcatcatgtaacatcctcaaattttaaactaaaattaactgcatcatgctggcttttgattaaatttgtttggttcaaaaatctatttgattttttatttaaaattggttcaagtattagagcccaaccaatttactctaacttattccctttattctaaaccctagtgaatttgagcaatttctctcaaattcaaaccatagattatttccttagcttatcccaatattagtggagatttactatactctaaaccctagtgaaacctttccaaactcttagtttgaattcaaatcttttctagggaaatattcaaaaattctgatttttactgttcattacactcaaggtgctcgacaaaatgcccagcccaactagagcagcccaccttcaacccaatcttgtgcaaagtctaggtttggtcctaggggatcacaacccactcaaaaaccgtggtttagttggccttctcctccccttcacgcgcgctctctggcagccgaccttgccgcgcgctgagccgccgcgcgttgatctcgggatcgatcgcgcgtgcccgaccgccttggcgcaccgtcgcccgtccgacgccctcagcccaccgccgccgcaccaatctcgacgatgacaaagccgggacgacgaccgccgcacgaaatcaccgcttgacgccgtgcgcacccgtccaagccgccaccgagtgcgatttcgcttctacccggggtgaatcgcgccaattcttgccgcacggttggattggagatagacggtggtatcccctctcacaattcaaaccattcacccctgagccggccgttttcaccctcgccgccgccgcgcgtcgcgctcggattggcgccaacacgtcgccagccgaatcaacacgcggtcaagccaatccttcgccggtaagtattcaaacgtggcctcccgccactcaaatcgatctttcccgccctctctcagcctgtgccacctttgcctcatccaaatcccgagctcatccatggcgataacggtgcccgagctcatccgctcctcctagccctataaataggaccccaatcccttccctgtccatcatcgatcatcaacaaccatagccccataatcccgaagctctgcttcaccaatccatctcatcaaccaccctcgcccgtcggtcgaacactttgtgcgtgatcgactccacccctctccatccatcctccgccctaaataacacttagaacacctatatcataccatgttctagtatactaagccctaaccaaagccctacgtcgagttttacctcgccgcaccaagccgagcactgccgcccctgcgctgctctgttcttcgccgccgcgaagtttttccggccgcaatccgtcgtttcaaccgatctcggtgagttcttccatttcaaccatttacatactacctagattccatttgagcaatccctttgcactatcatgtcaccctctgagctgccgacgtgagcacggccgccgcctatgtaggcgctcgtcggcaactatgttccgcaccttgccaaaggttggcaagctgccgaaatccctctagataccccgtagatgctctagaacccctcccctaaccatgtctaactctcatcactccggtcaccatcacaacctaaccgtgccaccgccgccctagccgctaggccgtccacgcatcaaattaactcctctgccaccgctcgccgccgccggagatccctagctccctcccctcctcggccacaaccactttctccctctagcgccaccgcagtcgccaaccctagcgccgccggcttgaaatggggaacggctggaggtagaagaagagaagagagagagactgatagatgggacccacacacagtaccatttcacttttattcgattttcaaactttagaagcccatatcttttaaaatatagatccaatttcagtaaaacttggaccaatattcttctaaaatcatcctctatctattgggcccctttttgctatttttgcattttatttaaactcctttttgaatttgaattttatatgtctaaccctaggtcttgaggattcctctgacactctagataatatcaatcaatctcaggacatcgagcaaggcaagttaccatatacctgttgatcatttaagcctatattttacaaattatttatttatttatagccttctattcaatattctattttctatgcataaattaatcatagaaacccaaataatttagtattgcttattttgcttacaatctggttaaaataccctatacttagattgggacaatacgtaagatttggatgatttccgggtggctagtattgtctcaatcgatataagttttaccaggtacttatgtcgaacgaatgggtacgaccgcagtttctagaatggggacagacctagttattatgttaattagcaatatggcacctctgtatagtggttcttatttttaagtcctcgcgcaggaggcaactatagccgcgaagggcaactttaaccattaccatgtacaggtaaatggtttgtgatactcgggtataaactatatggtatatttctaaaccctgatcgagatgatgtggtgtcatacgatcagttccccttaaatacctcgggaacgccagaactcctcttgctgctgttaacattacgttcagagcatatgaggatataagttcatggaataagtgccataattgttattgacttaatactgagccatgactaaagccgatgattatcagcaagtcatggactgcgggtaaagcgtacatctgctgcagtagaatatctttgaaactattcgaatagccgtactcatggagttgagtaccgggactcatatggtaccttggttagaaatctaaagtttatatgttttataaattctgctataacttttccagattgtccaataccgctttttgcaaagaaccctattatatgtcaatgcataacatatttccatgataatttgctgagtattgtgaatactcatccttgctcttataacccctttttcagatctgggtcaagaggaggacccttataactattactacgaagaccctgataatttagaaaatccctaaaggttatacctcactagttagaatgtatagaaacttccgctgtatattaattagcttaggtgagtacctattattgtaaaacccttagtattgtaagactttaacgtatgcaatgaagaaccagttatattgtatgtatcaatttttactgatccagggattgatacattaatctcagtcggatccaagttgttagttttgggctccgacaggactggtatcagagcatatgtttgactataggatgaaccttaaggactattaactaagctaatttgaatttatttcaagcttaccttttaaggggggtagatttaaatccacgagcatgtattataatatcatttgtgtatttcaggataatggcagaagagcatgagcaagaactcatagaaactgcaattactatccatgataatgagtgcactgatcaactaatcaatttgatgactaaactgaagataaatgagaagccggaattctattcacatgcttatcaacggggagaacgttgggaatatgatatgaccgtaaagatcaatcctccacgaggtgaacgtgatatgtattacttccgaacacgtcataggcgggataccgtgcaagctgcactatatgatgtgtccagggaggcttttctacgtctcaatcatatttaccaagacaggttgcaacactctcagctattcttatcatcctatgcgagagccgggcgaagactattgcaccctccagaatgtggattatcatgaacaaccagtaaaagcaactatgtctatctggatggaagccgcggatgacatgtatgaagaagctctggaacatatggacgtacaacgtaaacgtcttgaagaagctgaatgcagagaaaatgttcttaaacacaaatatcgtatacttcatgaattatatgaggaaagagaaaaacaaaattctatcctcaatatttgtgttgcaggagcagccttttgtcttcatcaaatcccaaatatggtagtgatgacgatgatgatgatgatgatgatgatggtatagaaggacatatctcaccagtacgtgaaggtgaaccagatgggccaaatcctcatgataatggtgagggagttttacaatgtttaccaccatcaccaccaccgttgtatcctattcattctgatgatgaagcagaagaaatgcattcagctatggatatcagtgagcctagtcaagaaccagaaatactaaggccaaatcgggtgtttcatatcaatgagttaaatactgccccaatctggactgaatctccagaggaagaggaagatccggaagaacgagagcttgagacacaagaacatctttctatacatactaatgatcaagaaaataatgaagacccttactcatgctctgctcccaatattactgcatcaacttctgcatctcctcatgaattttcacacttcgcacctgcatcattgtttactaatcccgcagaaggcagtggtggatggctagataaatagaagttatagatagttagaggtcttaagtgtagaatagatagttatcctactcctctctaacttctatgtgtgattacctctttctttgtggttatggttttctttggtttgtttctttgtagcatacatca

SEQ ID NO: 40764 - DNA, 18448 bp, Oryza sativa
  unsure (1)..(18448): unsure at all n locations
tgagaagatatcaattaccccattttctagatgagtatgggcaatggcagtacgggtgaaagagaaacaggagaaatcccttcaccaaatcctaccactttggcagaagtaatggcaagacaaactcaattattacaagccatagcacaaaatcaaggaagtaaaggttacagcgcacatgcagaatttatgagaattaaaccaccagtcttttctaaatctgaagaacctatggatgctgaagactggctaagggctattgaaaagaaattaaccttggtccgaacaagcgaacaagagaaggtaacctttgcaacccatcaactagaaggaccagccaatgagtggtgggaagcatatcaagcttctatagaagatcctacacatattattacatggatggaatttactacagcttttagagatgcttttatacctacagctgtgattagaatgaaaaagaatgaatttcgaagattgaggcaaggctttatgacagtacaagaatatttgaataaatttacgcaacttgctcaatatgctgcctctgatattcaagatgaaaaggaaaagattgaaaggtttatagaaggactacgtgatgaacttcgaggaccaatgattagtcaagatcatgaaaattttcaaagcctagtcaataaagtggttaggctagaaaatgatcgtagaatggtcgaaggacttcgtaagagaagaatgaatttacaacgacaatcaccaactaggggttcactacaagttcggaggccttatctatttaagccatctttacccaatgcaagaccaggcatgccaccaatactaccaagacctggattaaaaatggaagactctccatgttatgtttgtgggaaaattggacattttgcaagactttgccctaatcgtcaaaatatgggtggccaaacttcttatcagaaaccatctgctacaggttttataaagaaaaatcctccaattattaagagtggacctaatcttggacgtggtcaagtacatcatattaaagcagaagaagcgcaacaagatcctaatatattgatgggtatgttcaccataaactctaaaccagttactgttttatttgattctggtgcctctcattcctttttatctgcaaaagccagttgaaatcagtctttacctaaagataatttagataaagctatgctaatacattcacctggaggaactgtattagtatcatctatttgtagaaatgttccgattaaattaggagatcaagtatttttaatcgatttgatgatactacctacccaaaccatagatattattctgggaatgaggcgtgtggccacctggaagtaacaaggatacaattcccgatgatgcaacagtcaatgctatcttgccttgccttcttatagaatcgtgcgcgagggatgggggaagcagcatggcgagggggaggcgaccgcgaccacgtcttcggtcatttcattgtttgaaaagtaaagactgaatttcaatgtaaaaatgtcaggatagacaaattcggtctcggtctcggtcctgaccgaaattcaacaacattttcatatttgcaaagaaataatggaaattttcaacacaaaaatcaccaaaaaaaatcgtgaacacgtagaagtaaagactcttattatgttgcatgcctagaagaagtagggaagtgaaaattagagtttaatcctattgaacttagtggattgtagattgcatttagacatttttttaattcggtcatttggtctattcgattaaccgagtaaactaagtgaattttgaccgaacaaaatttggtctttcattacataggaccaaattaatgattgaatttctcagtgtcggttttttcggttcggtctttttctacctaccctaccagcggcggcggctgtgagtgatgcgatccagatggggaaggagaaaaaaccctagaaagagacatgggctgactcgtgtgcgccgctcagatcagatcgaatggttgaggattagacagtgacgtggcttagttcctaagagcaggtataagccacctataaccacgtatcgagaagaaaaaataagagagagaaaaaagcgggctgcagatttgtagccagctgtagcacggacttcaatacattacgtgtgtatgggaccgggtattaatagtgtagtatatttttatagttaactattgtatgaatgggctattagattaggccagtcccaacccaagacactagacatagtttctataaactccacatcattaagaaactagtactagacactactctttcatcaatgcaaacaccactcttccatacttaaatttaatgctacttatctcacatgatgtcttgtatgttgtgtagaaaccatgtcttatgcaagacctgatttccttcgctttcctcatttattcatttaccacatcatctttcatcttaggtggtagtttatttaatgctatggacaccatcctaatcattgggttggggttgggaatggccttagagcaagtttaatagtatagccaactactagctccaattcatatatatccaatctaatagcttattcatacaatagttacacactacactattaatacatggtcccacctgtcatacacacacttcatctttgcagttcgtgctacagctggctacaaatctgtagcccgctgcttctctctctcctcatttattttcttaaaatatgtttacagctagcttatagcctgctattgtacctgctcttagctatagatgatttggagccagtagttggctatactattaaacttgctctaatagggatccaggcgattaaattactaatggcgatcccggcgattaaggccctgtttgtttcagcttaagattattgtaatctagattatagaactagattactataagctggattataataagccaacatagaataagttgctagctgtttgtttctctggattattatctgtttgttagttgttagccacccaataatctaaaaaaacacatttatagtggcttaccagattatattaatctggcttatctataactaatataaatattcgtatttttccggtcgtcacctcataggtgcagtgatttttcgtccccctcgcctccccccaaatcccagttggaattccatcaccaccacccaaaaaaaaatcctaatcggaattcaatcaatcacacaaataaaataaaatcggaggaagtattatacacacaaatatatccaaaaaaaaatcgaaggggaagtcgccgtcgaaccgccgccgttgtcatagggacgccaggccgccgcagctcccctcccgctggatccgacagaggggaggggcgccaccgccgttgggatgctggcgagccgccgacgcctccccgggcgccgccgccggtggtgggggaggacgtcgccgcgctgccggtggtgagggaggacacggccgcaccgccggtgatgggggagccgtcgtcgccgctggcggggggagggcaccgccgctgccgcttgggctcggtgagagaggcgccgtcgccgccgccgctgctcgaggggagggcgccgccgccgccgcttgggctcggggggagaggcgccaccgccgccgcagtcgccaccgctcgcgggaggaggggcgccgtcgccgctgctcgtggggtaccaccgccgccgccgctcagaggcgctgaggggagggcggcgaagagagagataggtgggaaggaaatgggctagggtttctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcgctgagattgctagataaagatgaaagtttcactatcaaacacaatatggtggggttccgattacaggcagacgggcggtttagccaacacgcgcgctgcgagccggtagcaagaagctatctctatcatcaaaacctgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaaatagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgaacgtgggtaataggaccatcatgctgtatatggggggacgtggatgtatcgatggtgttgatgtcctcatcagtttcggcggctgagggggttttgtttccccgatctcgaggcttggccgtccgatcaaaaccctagagatcggacggacagcgtcgaccgggccgatttcggcccgaaatgggatcgagagcgaggccacttttccggcccaagccaaggttgcggcctggggaggggaagtgcacccgcgcatgcgcaaaaggccgtgggccgaccggcaagggtctggaagaagtctattttaggtccctctagccgaagaaaaagagaagtagttcatttttagtgcttctttttttagaagcatttacaattatagttattgaatgtgtttatttcgaatcaaacctaaaagaaaggattttctttctttttccaattaaacaatttgttaaatgatgtttgtattattaaaattagcaattaagttatgaaaattccaataaaattctaaagagtgtgactaatcatggagaatttaataaaattaaatttaaccatgttattttatttctcgcatttgctttacttgtaaatttatttaattatacacatacctacttaaaaataccaaaaatttcaacgaatttgtattttaaataattgcatattttttgatctgtacgcttcccgttgtaacgcacggacacttttactagtatattatattaatctatcataataagctatatgtttgtttcaacttacttctaataatccaaattataataattctaagctgaatcaatcagaacctaaattcatttccttgcttggtacggagtataaacctcgatattagcggggctcataaattattttcctggttattacttattagcgcctaacgcttcggataatggagcgtcgtaaattattttttctgattattagcgcttattaagaaaccctaatagatagctataaaaacccactcttctctcccaccgttccagccgccagcgaccgtccgccaggctcattcccgacgatgccggagcgcttcgatcctgccggccgccggcgcaggggcattctcccgccgcccgtcggcgcaggggcatcgacgggcctccgacgccggcctcctgacgtccatatcgccggcacaggcgcatcggcggaacggtcggagcccgcgctgtcgcctcctgaccgacagatcgaggtccgaccgccggcgtccgacgtctcatcggtgtgccggcacaggcgcatcgacggaacggtcggagcccgcgccgtcgcctcctgaccgacatggtaaaataacattatggccttgtttgtgatgcaagcatgacacaatttctcattgttagttgataaagggattgaattgaggcgctataaatgttaatttcaatgttcaatgatatacgacttaattaactagttttgtggtatgaataggatagatagtcccattttgtatgttttgttaatcttatttatatatttttgtttatataggtggtcttaacactccagaaaattgtgctataattcaaggtagagctaacagaaattgtgctataattcaaagtagagctaacagaagggatgatattctagacgagatggaagttgctgctttagcttctagaatcaattggacaggtatgcattttatattgatgaaattctggatgagatggaagttgctgctttatcttgtagaattaattggacaggtatgcattttatattgatgaaatctgaactaattataaatttacatttcattattttttttgtttatttagagtatcagttagcttcaattgaagctgctgcgattggtaacataattagggatggaaaggtcattgaaattgctccaaactcgaaaggaggacctctacaggatgtgctgagaagtttgcttgaaaagtaagtgtatttactaaacttgtttcatacatatttaacagaataacaaatttgtagtgctttttagctgatttttttctgcagttatatgatcactattcgttggtcacagattgcaatgttgttgatgtgttatccactaacaattgtgcttttgctcatatttatgtcctcagaaatgaattgatgataaataaactgtgtgatgaggatgctccactggaaagtaccgcttcaaggtagttatttttagatctactgcatctcatttgatttcgtgatgttttaaacatcagcatttgatgcaattctccttagatataggagatcctttactgactattttgtgatgatttaaacatctagtgtcattttgtagctcttcctttaaatttttctctcaccgctgtgcaggccgctctcaggcttctttttcaacacattatgtaaggagcctgggtatctcgcatttgacaccatacgctgcggcaagcttctttaccctgagtcacgctttgctgcattaccagagcccgtatctttccttgcatccacgcgtggccttgtctgcgtctgtggaaagacaacaggcttgtactatgtaaccaacacgaccaccttcaagtgggttcagctaccacgccacagttgtgatcatggagaaccagcagttgtcatcacattcgaggaacccctgacatcctgcttcgacggtgctgttgagcattatcatgtcgtcgctgccttccacctcaagggcagcgtctggacatctgagtcatactcctccaggactgggaggtggactattgctaaagatgcccctcctgctgtggaggtgaaggcggagtctggtgttggtacactgggctgcgccttctggcgcacttcccttgggtctatcctctgctatgacccggggaaggacctccttaaagtcatccctgcccctcgagtggtaaaccaagataccgtatgggagcttgggcaaatggagggagatcttactgtgacctgcttcaaggatgttgacggtttcctcacattgggcgtgcttaaaataaacaagcgactgtttgatgataaggttgctgcactctggacagttgtcggctcattctccggggagaaggttggcaaaagggctatgttgctccgctcacaaggcgccgcagaggtcgttgtctgggaacccttggaggagcgcgtcgtcgccatggaccttgaaggcctcgttactggcaactttgggcccctaaccaatgaagggtgtactccatgttttgttccttacgttccatcgtctgtgagtatttgaaggactgacgatgatcaggaataaaccagatgtgattagcatacaattgtatagtataagaaatacacctccatgttacgtttttgagctggctggcaggaccaaccctacctgatatgagattttaccatgttaggtttttatgcttgctggcaggcccaaccaacctgacatgacatttaccacgttaggtttttatgcttgctgccaggcccaaccaacctgacatttcggctggactatgcattcttttttcttgtcttaacccattcattcagcacttttacttgttcttccattctttctgtaggagtactttttaccatgttcctgttgttttctttgctttttctggaataaactacccagtaattttctgtcatgtaattgtaattgtttgcgtgcatgtcttaatacggcaagctaatcacatctcgtctctgacaagttatgctagatcctccgtggcaaaatttgggagttcagtgtgttcttttttgtcaaagttcctcactcaatgtatgctggtttattataacggtcacgcggaataaggtgtgtctagttcgtttgaaaaaaaagttaaaagtttacgtgtgtagaaaagttttggatgtgatgtgatgtgatgaaaagttaggggcatttgggatgtaactaaacacggccataagaatgacacttcataggcagtccccctgcaaccctcgagaaaggtggcaaaggggcctatagccaggtaaagagcaagtataactattggcttcacctagcagtccacgtaatcatagatcaatgtgttaatttataagcattaagcagaaacatcgcaagaccaagtttagacaccgatttgcctttccaagttcctgccaactgtaataaaataattactttattgcctcattttcagcaccaaagttaaattcagtaaagttagattcgataaagcgaagtatataagagcaggtacaatagcaggctataagccaactgcaaacatattttaagaagataaattaggagagaggagagcagcgggcaaacatattttaagaagataaattaggagagaggagagcagcgggctacagatttgtagccagctgtagcacggactccaaaacgcaacgtgtctatgacaggtgggactaggtattaatagtgtagtatataactattgtatgaatgagctattaaattggctatagataaattggagctagtagttggctatattattgaacttgctctaatggcaaacataacctggggtatgcattttttaaacactgaaatacatgacacatggatcaagctgtcagtgaacatgcctctcatcagaataacttttaggatatggagacatgcaaaagtcttagatgctgcaacattactcttcagtttgctggagttatcaactgtttattgcagacagtaagagaataataagagcttaattgttccaaacaaaaaagaaaaagaaaaacttttattcataaacttgaaactgaccttcaaactctccatgcacagcaataacgacctgtcaccagtaaaataaacaggaaatccaatctagcgcacaatggtctgtttcagcaattttcaagttttatatgatctatatttgcacccacttcacaagttgttcttgtggcggcaattcagtctttacttaaaaacaaaatgaaccaaacaacaatgtgttcatctgaagtccaaacggccagactaaaatggatttacatctcgatgaggtctacaaatccacggtctccaatcgctcgtccatccgagctacggttcaaacaatcaacctttcagtccctactcaaagcgcccagtcaatgccaagcacacatgtagtaacataggctagctcaccaatccatggtgtttatatatacaatatgccatacaaggcaaatggttgcatcgagaaaatagtacaagtacaacagaccagttactgaccatttatacaacagaccaattaaagttgagacttaagagagagtatgctcaaagttaatgcctctaactatattatttgtttttgttttgtgggcttattctcctatactggttatgttattttctttgtacacaagcatatatatatatatattccttcttttggtctatatgaattgaatctagttgatgtgcacaaatctagatcagaaagaatgtgtcttgttgtcctggattatatgttcgtttatatatacaacttgatgaagttctttacattgcaaaagaatcataggaaagagtctgaacattgaagttattcaggatatattacaaaattttgtctagatttctgcatttaacatggtgccttgaggcagcgcaactactgtacatgtaactagagatcaaggctgcgcacctagagcttgctcattgggttgccaaacaatgcaagcaccaaacaagtaggttgcaaaaatattttctagataaactgaattaacagccacatgatcaatctaagtaatttttcacataggtagttaacagccgttcgtttgtccaatgtgccaactaatccaaataacaaattttagttccatcactggatatatattcaagtaagattcatgtgttattagttaataaaggtcctaccactggatataattgatattgtatacatcaatgaacgaacaatgagtaaatgataacggttaaactgttgaattttttgagacataacaatatatactaacctttagtttcgtcataataaatgctcaacaaattaatgtgcacaaacagctgcatacattaccagaatcatcacacttgatcttggtctgctagaaaacttgtgcttgtaaaccaaaaaggctaaaaaaaaaaaaagacacgcacacactcccatacgtggaaccatatgcaagatatcatgacctcttagataattaagtagatggtacacaagcataacttagggtgtgtttgaggagaaggggattgaggagattagaaagatacgtaaaacgaggtaagccattaactcatgattaattgagtattaactattttaaattttaaaaatggattaatatgattttttaaagcaactttcatatagaaaatttttgcaaaaaaccacaacgtttagtagtttgggaagcgtgcgtgcggaaaacgatgtgcattctcactccctatcacccaaacgaacgcatccttagtaagaaacacggaacgtcaaaggactactagttattacagtgaagtgatttggggagcaaactgctcttactgcagtaacatgtggagtgatgcaggacacaccagcggcagatggttttccatcaaaatttccgccaatattcagtaagtggctcccccccatcgtcgtattcgcctaactctttttgtaggtaccaagagtcgacaggtagtcctaaatccctatcctttttggcgcgagctaattcctttacgtctttatgaagatactggttccagcaatatgttctctttgcattgaacttgaatatacggaagcggcgaaccatctgagcatgatcatacttcctgttgtatgacttgcaatagcgctcaaataaggcccacacggcttcgtccgactcaaggtcctcttttgtcacgcactttccatcatctatatatcacaaacaaatcaacaattttgcaaacattacatcagtaaaagtgctcaagaaaacagtgaattgtacgaatagcatgcaacaattgaatgaatttaatacagaccagagatggatgtattcctcctaaatcctaatccccctgcctgcctatctagactatgctaaattggagagctgcaccatgaggacagggagggatcagggagggattggttatgatttacctggaggttcactgctgtagcggaaggagaggcgggcagcgtcgtccagtgggggacgaggcttcaagcgggcggcgcgagatgcggccgccgcagctaagcgggcggcgcgagatgcggccgccgcagctaagccggcggagcgagatgcggccgccgcgtcatggcgcgccaccgcagctaagcgggcggcgcgagatgtggccgccgcttgacgggcgaccgccgtcacgagcttcgacgccattgttagggttcttcggtcgggctttgtctgttgcacatctcaaacaaaatatcgatgatagtagtgtgtatgctgcgtttttcccccttttttgagtttttttatgttgagtatttttgcaaaaaaaaactcctcgcttttcacggaatatcgtatatatcctcgaaccgactgacaccctgttatgttttatttggaaaacccctcggtttgaatagaaatacaatacaaatgccaagtttagttccaaactatttctttaaactttcaacttttccatcacatcaaaacttttctacacataaactttcaacttttccataacatcgttccaatttcaaccaaatttacaattttagcgtgaactaaacacacccgatgaaaagaaaattctgtttataggggtagtgctataaacatgaaaaagacacgggctttcatgaaaagcagtcatatctacctcaaaggcccaagggttaattggatccatgccactgcatattaaaaaaataccactactatttgcgatatcggctatgtgccactggaatttggggaaattggaactatgccaattccgtccagttttttgtcaacctccgtcatctctctccctcttcctttcttcggttcaggagcagaaagcaagcgcgccgggaggaggttggtagctgcagcaacgagtgttggggatggcggtgcggcggtgggcggggtggcgaccggcgcgggggcgatggccggggacctcgcccggggagtgggcgacgacgatactggcgcagtcctgcccgccggctccgagacgaggcgctccatattcagctgggatgacaagttcgtcaaagcgcaagcattggtcaccaaggcactaaaacctatcctccttctgattcgttcttgttcatgtgaatccaaatttctgcttaatttggattgtggatgttaacattatacaattaatcttgtattcctgccgctttcctccaagggaagctcccggccgatggtagtcacaccgagatgaagaccaacctagaccagttcatctgcaacctcatgcagcactccggcggcaatcgaaagatggggcagagaacgaagatgtacactcgataagagcaatcgaaaacaacacatatcgtattaatagttcattcgcataattgccttaatctgttgggtgtttacaccttgttatacattttaatgtcccatgactactataaggaggtaagtaggtctagaggttgtggggtgacacgtgtcgtagctgagtcggtcgacccaccctgcctaatgggtagatccgcccttgacgtgaccctggcgtccctcgtcctcgctgtgcacgtcgaccacctgatggcgacgagggcggcctcgctccagtgcgatggcggcggcggccgccggcgcagttcactgcgtccgctcggtcacaggtggactacatcctcggcgcttgacgacgacgacgacgcaggcgcagccggacctccctcatacgatgatgacgacacctcctgttgcatctacggtggaggagagagaggaaggggaaagagaagagaggggagggatgtggggcccacgtgcagtttggggctaacggggatttttgatggaaaatgtgatgtagtggcatggttccaattttcctagatttcagtagtacgtagccgatatgacgaataagagtggcattattttgatatgccatatttgcacttttgcagtggcatggatccaattaaccaaggcccaaaccctacccggccgtctccccatctcctccccaccgcgccccgcaccggcggcggggacctgtctccgccgttcgtcctccccacgatgccgtcgtccgctctccccccgccgccaccttccgccctccccctgccgcctccgtgcgccatcccaccgccgccgccgtcgacgacgaccctcctcccctccctctccctcctgcccgtcggagctcggcgccccctcccccttgtactctctcccttgtggcggcgtctgtgcctgcggcggtgtcggagtcggcgccggttcacccctattctcactcatctcgttgcgtagttcgacccggcgctagccttcctccctcttcagatctggagcagcaccggtggtgacggcggctaagaaggaggtgttacgggcgggacgagtaggacaggcggtggggagtgggacatgggacgggcagatggcccggtgcctcctcccccttcatatccccctaccttggcggcagagccggcgtctgtgctcccttcccctttcttctcccgcatcctggccgcctgctcctcctcccgtcctcacctctccacaacgccgccctccccctgcgtcttctccaactcctgccgttccgcctccctcgcacacggctcctctttctcctttccagtctacgtcaaccacccgctcctcccctttccattcttgtcgttgaagccccgtggctggcgccacttctccctctggatccggcggcatccccttcgccatctacccatccctcctccccaccggacacccttttcccctttcatccaacactaggtctcaggcggtgccttgatccctccacgaggtggtgtgttggcgaacctgctctacgtcgccgtgtcttcttgagccttcaacgaggaggacacaaatccatggcacatccatcaacgagggtccggtccatcttctcctcgtcgtctcagactatcgactgtaccttgcctcccctcaatcattctcctttcatctctcccatgtcatcctcttctctaaccatgatttgtttgctgtttttttaggggatgactggtgctgcagccatccgaggcacaactgaagagaaaattgtagtccgtgtggattgatgccaattgtatcgcttgcctcaaagagtaagtgcatgctcttgttggcctcaaaattctcttttgaaattatgaatctgggaatgggttcatttaaaaaaaaagatgattctggcaatgaatgcatttttttttactaattgatttgtgtttgcatcttggatttagagacagaataacaagggatttaaggagataataaaaaggtagagatagttacctcatgtatctttttttttctcgataatagaaatgttcgattgtgtctggtgtgccaggacctctgtttatcttggataaagtaaaggtatgtgttagtattatggtacaaattttcaactgactaatatggtactcctagcaagttatactgaacatttctttcttcatgtaactatgttcatggcgcaaagtactaggaaattgtaaacatccgattgggagatggaaccactcggtgtggccaaattctggaagttgatggtgaaagaggctgttgtgcaggtcatcacttctctattcttatgaaaatattgttttcttgggattgtattttgatttgcattaaccctatggttgttgcattattcagaacacttgaagttttattattgggttacttgattttcaggtctttgaagacacttcaggagtggacaacaaatacaccattgtgcaattcacaggtggtttatgtggtttgaacgttaagattctttagtaggaaccaacacgttgattatagatcccattcaggagccgcccgttcttaagttacccacaatgatcaatttagtgcttacaaagctatctatctctcaatatcgaaatcttcgcggattctcatgcaaatagaccctccacgtagcgtcatacgaatccagagttagaccccctcctatagccgtcggatcgcagatgtacagtgacggatctctgtggtggacctcgttgtaatatagaagattttaggtgcatttttttgcaaaaaaaaagtcaggcccttctctccccttcgccaccactctattcctccaccttcgaccccctcttatccgccacctcgccgctctcccctccgacctgcgccgacgtcaccgccgcctccttgttattcgacccgccgtcctacgccgacgtcgccgcctcttcctcccgctgctccgcctccggcgcccgaggccgagcctcccacgcgttggcgcgccgttcagtcctctgtcctctgatcccctcctcgtcgctatatgtgaagaggagctcggtgtcagcgacgagctccggtgaggacgctgcctctcccctcaagcttggcggcggcatggcaaaggggctcctcgagcggtggcggtgcagatcctcgccagatagggcaacgagctcggttgctgtgcgcggggatgggggaggagaaaattcacatccatcgccgtgcccgtctacccagccgccttttgattcgccggccgcctcagacggaggccgttcgccgtgcagcaaagggcgtagtgccgaggaccacgctatggcagccgccgttggacgccgcgatgtaggagttccctcacatggtcccctacgtgttcacgccacatgtgattaatttccaccgataattaagaaaaaaaggattttcttttgctcttggtggtttttgcgtgatacacgatgctactgaatattgataagattggctccaaggaatggattggttgtcaaaattaattgtcacactcacatgttttgtcttggtctgaaatctgatgagttggccattcttgacatgcagtacaagggtggtgcagctgagggtggcagaagaccaatcatctggaacatctttgaacaacgaagcacgcccgccccgtgtgcgtctttcacgacatgctctggtcccgggtttcttcctgtggtcttctagcgttagaagaagtcgtgtccgtcccggacatctgcaacgtcctctcacgcctttttttggggggacaaacaaagatcaggaaaagacggaccgaacccattcggtgactttcgcggttgccctcactgaaccgacttggatctgaactacgattcagatcaagtcttaccgaaattggatttccttttcgtgccatatgtcgcttagactttactttttcccctttctgtcctttcctctatttgttcgatagggtcttcaatctggacccaggcatgttaattacatctctgtttggctctgccttctagctgtgctatactttcaacacaaatcaagttcaattaggtgtatttcatatatatctacaagcataaaatttgtcctatttagtaaccagaaccaggtcaacgatgtaaatgcaaaaaataataagctgaatacacaaagacacaaatgatatcatagaagtatcggaaaaaacatgtatatatgtctattattgtctgaaatatgacaaatagtctattatatgattatccttgttggtgagttttttatgcaactagagcagcctatcttttgtcaatggtcatagctttgttgtaagaaagattatactctttggttcttcctatgatagcccagagagtatcttgacctgccaagtttatgtcatcaaactaatttagttcagtataggtcctatcagttaaagctactcgcaggcattattcctgttgttgtcagttcacttgtatagttatagctttgacctagctttgacctatccaactagctttgacctagttggataggttaagaaatagaatattggcaatacaatatatcatgcaattttctaaacatagcttcacaaaaatatggttcattttattcctcacagaagaaaagtgttcttcattttacagtgaatattccttgaggcattgaagttagttgttattgtgccaatgttgaaatgttcagtatatttggtgaattgatgctctatttctttgcaaaccatgatttctgaattcttctcagttgctactttggtcatgacaggttaaatgtgttataggagtacttcagcttttactgtttcatgagttcaaaatataaattgatctttgaggaatgaaaagcaaatgttctcttcagctatcttttctgaagttcaaatgtgtcctttgattgaattaatcttctgtaacattttgaaacctccagactagcatcatcatctctcaatactatcgacattaattcagtatccattttattaatccagtttcacattttactttgatgttcttaataatcttcagcggaaagagatgttctacagctctgcactttatctctgcctgttagtagcactctgaagaacagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40765 - DNA, 2386 bp, Oryza sativa
gtcttgtagccgagcgtgtacttgccgctcttcatcaccagctgcagcttgttgttgatgttgtccgtgctcttcttctgcatcatcgccacaacccaccaatcagaaaccagcaaaaacatcgcaacgaaatggtgagatgcgcagcgggagagcgcgacgaggagggggagggaggcgcaatcgatcaggaaccttaccgccttcttggtgggagccatcgtgatcgagcggccgcggcgacgacgacgagagctgcggggcgcggtggcttctgcggcggcggcgcgaatgggcggctggttagggtttagctcgacgcggtgtatataggtgccgcctcgctgccgaaattacgcgtttgcccctgggcctccgtcctcttgggccgtaaaattcacagatgggccttcagtaaaggtgggacccatatgtcatttgcctcctttaatattggtttgctcctctcgattcgcgaaaaccctaattacccccagcttcgccgccgccgtcgacgccgtcgccactgcagcggcagccatgaagcagaggagggaggaggagaagaagaagaaggacatcctcgcgggctccgacaatgagtccgatggaggcggcggcgaggaggatctctccaagatccagatcaacgaggagtacgcccgccgcttcgagcacaacaagcggcgggaggcgctgcagcgcctggaggagcgcaagaagaagggcctcgtcccgccggaggaggaggaggaggaggacgacgacgacgacgagtccttgtcggacgacgatgacgccgccatcgcgtcccgccgcgtcgaccgccagatgttcgaggtcatccgccgcatccggcgcggcgacgccgccatcctcgacgcgaaggccaagatgtattcctcctcgtcggagagtgaacccggcgacgaggagggggagaagcccaagaagacgaagaaggagcggcccctgtacctcaaggacgtgaacgctcgccacctgctcgaggagggccccgagttcgcggcgcaggctagccatggcggccacagcagcagcaagtacgacaagatcgcctacgacgagcagcagaggaaggggctggaggctttccttgcggcggagaaggcggcattaggcaatggcgatggcgatggcggcgaggatgatgacgatttgttccaagtgaagccgaagggtggagatggtggtaacaaggaggatgatgacgaggagaagaaggagactgagcagatactgattgatattttcggcaaagacgaggagctggacgagaacagcaagttcctgaagaaattcttctcgagaggccgtatctcgagacgggcagcgagaagaaatactctccggatgatatccaggaggtatcggacgaagaggagcatctcatagagcaggaggattatgagaccaggtataacttccggcatgaggaagcagccgcgactggtgcggatgtaatggacagggtgatggggcattcgcggtttgtcgaggggtctgtgaggaagaaggagagcagcaggaagcagcagcgcaagaacaaggaggagcggatagcacgggccaagcaggagcaggcagaggagttgaagcatttgaagaacttgaagaagaaagagatcgccgagaagcttgagaggatccggatgattgccggaattgatagcgatgcagcttgcaagctcggagccgatgacttggaggaggattttgatcctgaggagtatgacaggaaaatgaaggagacattcaatgacaattactatgaagcagatgatgttgatcctgaatttgggagtggtgaggaaattgatttggaaaaaccagactttgacaaagaagatgaactgcttgggctacccaaggactgggctcttgatgggcaagatggatcgtctgcagcagctgagggggcttctcagaaaaagaaaggtggaaaagatattgcaaatggtgaggggacaaatcagaaaatgaaaggaaaaatttctttgaaggacaaggtggagcttgagaaggagatggaagagtactacaagttagactatgaggacactattggagatctgaagactaggttcaagtataagcaagttaagccgaacagtttcggcctgagcacctatgagatattggcatcagatgacaaggatttgaaccagtatgtatccatgaagaagatagctccttacagggaggcagaatggaaggtgacgcatcataagaaactgatcaaggattcgatccttggaggacaggataaagaaggcaagaaggtcaaaaagaagaagtctaagtctgaggaaggccctgcttcatcagaaccagagaaggagctgccgaatgaacagggggatgc

SEQ ID NO: 40766 - DNA, 12482 bp, Oryza sativa
tttttgtttatgtgatgcattttgtctgggcgttgtccttgtggaagcatctgtttagggcattcatgatatatctggagctgtgaacccgttattgtcacagtggtaacatatggttctatggaagttttgcttacatattgtaatttcatgagccatataatctttttgtttttacatttgcctctgcaattttggtttccttatcgatttctatgatgaatggttaagttggaaagaggaaactcatgccagagtgaagatttgtcaatttgtatggcacaaatgtctatcaaaatgattcatttgttcctctccagccgtttgaccagaccatacctggccaatttacatcttgtgttaatttgcatgaggagagcttaccttccatgtttatgatgttgtcagctacagtggaattgtgcttacaactgtctaagacaaagcagtaaactacagttaggcctcaccgagtgaagaccaattcagagcagctccaagcagtggcaaccaggtcaacaaaaactattttggcctgtcatcttcttccaatcatctcatttctctcttcttgtcaccttgttctctgcacaaaaagaaatccttgatagggtttattcccttgtgttggttgttgcacatgtccctttcttccatcgtcacaaccttcagtactcacattactctatataatgctctctcatattgttttgtttactgatcaggtcttcaggagaaggagcttgctttgtactcctaactgctccttccagtttgtgctctgctgttccccaaattctctttctcctacttcctgcagatacccatatgattcatttgttcttcctgcgctactgattacttctttcaggacacagctttgctactggattactgccaattgagtcttgttattcggttcctcaatttatcaagttcttcagagcaggcagtcgaagtccataatgtccaagactgagagcagaaagttgtccgatgactatgaagttgtggatgttcttggccggggcgggttctcaatagtaaggaggggagtgagcaagtctgaagagaagacccaggttgccatcaagactctgaggaggctcggcccggcgatggcgggtatgaagcaggggacaaagcccgtgcccggctccggcctgccgatgtggaaacaggtatcgatctccgacgcgctgctgacgaacgagatactcgtcatgaggaggatagtggagagcgttgcgccacatcctaatgtcatcaacctgcatgatgtgtatgaagatgtgcatggtgtgcacctcgtccttgagctgtgctcgggtggtgagctttttgatcggattgtggggcgtgaccggtactcggagttcgatgcggcctgcgtcattcgtcagattgctagcgggctggaggctcttcataaggcaagcattgtacacagggacctgaagccggagaattgtctgttctctgacaaagatgagaagtccacactgaagatcatggattttggtttgagttctgtcgaagatttcagtgacccaatcgtcgcgctgtttgggtcaatagattatgtttcaccggaggctctatccaggcaggaggtttcagctgctagtgatatgtggtctgttggggtaattctgtacattcttttatctgggtatgttggccattttcttgttatagttcccttgattaggattattttcgtagttttaagcctggtagtttgtgtatttcagatgcccaccatttcatgctgcaaccaatcgagaaaagcagcaaaggatcctgcaagtaagtttcctgagctaactctggtcaaattgttgcttcaatggtgttcaaaatggtttggaatattctggttcgcatttgacgatacctattaaacacttcgggcaattttagtggaagcagaatcattataagtattctgatcaagatgatttataagtatctttgcattttctaatgaagcagaattattataattctggcccgtgaatgtgagggtgtttttcttgcaaaaaatggaattttggtgagagttacatgtagctgacctcgagtgtgagtcggccatacggttttccagtcccaaattatgtgttgggcatttgattcactctaaaatttcagcatgagtgtgaagttgttagccttttatcagtgggtttgcagcaaatgacattgcatagtttggagatctgcctgccaatcattgctgaaatgtcgtcttttggtagttgttagcacttcagtttatacctgcattgtcctatattttgtccagttctagtagaaaaagttgccctgagatgtcaaatcaatagcagttggccagtagctaactagaccttacattttactgaaaaggtgtaaaagaatgttctcttccacaaaagacacatggattggattgtacattttccaatgaaaaacacgaactgagtcagtatggatatggggctactgggctagtcaaatgttgttcagtaaaccactgaaaaaataaataaactgtgccgtttgtttctgaagaattatgggttccattatcaatagtgcctttgaataacatgactataagaggaggatttgtagtccttgtgttaggcaccaattattcgaaaatgcctgtattaatcaggaacttgctctaatggcatataatttgtgtgcttcttcagggtgaattcagttttcaggaccacacatggaaaacaatatcttcatccgcgaaagatttgatttcgcgccttctttctgttcaaccttacaaaaggccaacagcaagtgatgtctgtctcatatgctcccttttcagcatattaccatgttagctaagatactataactgttcttaatttgaatatcatgtgtcatttgaaaccagcttctgaggcatccttgggtgattggagactgcgccaagcaagatctcatggatgcagaggtcgtctcaaaactgcaaaagttcaatgctagaaggaaattgcgggcagctgcgatagccagcgttttgagctgcaaagtggcattgaggactaaaaggctgagaaatcttttaggaacccatgaccttacctcagaggagctggataatctgcggcttcattttggacgaatgtgagtatcatgacttgatcagcctaaaacctcttgtgtaattactagaattttgggactagcatttctcagttagtaatttgaggaacactacagttgctttaagggggagtcatatatccttgtcttctctgaaaacaaatgtttttttttccaacactgaagaagtcccaattttgcaggagtatatttgcacatatcatatatcatgtgcagcccattttattaggattttaggagtagaagatatgtgctatgatgaactgtgaaattaacaccgaaaagatttataagcagaaagcggtagcctttttttcctttgccagagaagcttcagaagttcagatttctcgtaaaaccttcatagttttaggatttaaacatgacacatatgatgttccaatcgaaaagtataacactaagcaagtgctctttatgcagatgtgcagatggagaaaacgccactctgtcagagtttgagcaggtgctgagagcaatgaaaatggactcactgattcccctagctccccgcgtattcgatctgttcgacaacaaccgtgatggaaccgtcgacatgagagagatcctgtgtgggttctccagcctcaggaactcacgaggcgatgatgctcttcgcttgtgcttccaggtaaaaatttccaaatgcactcgactcaaactgaagtggcagcccttccaatttatgtacaggaatatcagaaacattgcatgatatcatatcatacataacttcaaattcaattaaaattcataacaagagaggtatttcagcatctgatcatgagcacacaaaaaaaaactgcatttttcttttcagatgtacgacgctgatcggtcaggctgcatcagcaaggaagagctggcatcaatgctccgagtaagaactcctaaaaaaggaaaaccaaatctttgctcttcttgagatggcttgttcatgtctcttttcaagttttgagttgaaaatctgacgagctgctgttcatctgaactttggtgatcctcacaaggcgttgccggaggagtgcctgccaggcgacataacggagccggggaagctggacgaggtgttcgaccagatggacgccgacagcgacggcaaggtcaccttcgacgagttcaaggccgccatgaacaaggacagcgccctccaggacgtcctcctctcctccctccgcccacagtagcagcagcagcagcagcagaagcttctcagattgatcgatttcttcaggaaaaatactagtatctgtactgctaatacttctgcagcgaatggctggctgccttatctgaaattttcatctgtgtcggctgctgaaatggtagcaaaactgtagctgttctgttgtcacctcgtccgaaaaaattatgagcggtgcggatttcacattttcactatattctgggtgaaattgaatagcaagccgggtaacatatttacctgatttccaaaaaaagagaaaaaatggatagctactgccaaatatgttgcatggattttggataattgtgtaggggtagggatctcgaagcacggttaaggagttaggctttgttcgttcctgggagatctgggagattgagagagaaaaacatctcgtttttcacatgcatgcttcccaaactactaaacggtgaactttaaaaaatcatattaattcatttttgaactttaaaatagttaatgctcaattaatcatgagccaatggctcacctcgtttttgcgtatcttcctaatctcctcaatcaccttatcgtcaaactcacctttagtgatccataggggtgagttccgtatgtggaggtcaaggttcgcgttggccgatctggttgaggttgcttcttaataaaaagtcatgtgggcggtctttcctccgtcggtcgagtattatttcgatggcatgaactaaccagtggataatccttgatccaccatgtcgtgtgaatttttgttcatttaattgaacttgagtggtccaggtattaaatgtgggtcaggccatgtccatccctacaccgagcttgccatgcattcatgtttaattattcctgcaaaacaaaggggaaagtgcctgttttgaaggaaaaaaaaacattcctcttcaatctttcattcgaccgttgcattgacatccttttctttttggtaaattttgcatagtgttagtttcagtcctgtcagtgtcaaataatgtcaagaaatgactattctgggatagaattcaagaaacgtaactccatttcgcaaaaaaggaaaaaaaaacaagaaacataactcgatcactcgaccgttggacacatacgcgcgcgtggcgttgtggccttgtgggatgtgaaaaacgcaactgacacagactgacccataaataacaacaaaaccaagggcctaaccgcaaaaagggatccccaacccaaaaccaaaagaaaccctctcccgtttgcctccacgccgcttcagtttgaaaacccaccgccacgtcgccgccgccgccgccgccgccgccgacgccgagatggctcgcacgaagcacccggcggtgaggaagtcgaaggcggagcccaagaagaagctccagttcgaacgctcccctcggccgtcgaaggcgcagcgcgctggtggtgagcgcgcgctctctccccctctgcgtttctttttttttttcctttttctttcaatggcggtggatggtgaagcttatgccccccccccccccttcccgcctcttgcttgtcccctttgcaggcggcacgggtacctcggcgaccacggtgcgtgcgggagcgggtctttcgtttggtgattttttgattttgtggggggatatgtttttgttttgtatcttggctggatggatggcttgctcaccacctgtttgatggaatgcagaggagcgcggctggaacatcggcttcaggtgcgttctcttgggggggtttctagggttattcatgggctcgttggagcttttcctttctgtctcttggattccgggggacctgaggggctcaatgtgtcccttttcttgctctgttttaccgtgtgctgtactttcctcatcgttgttttctgaatatattataagaacagtagttgcagaaagatcttcaattgctcatcagtcaaagcttttcttgttttcattctgaaataatagcaaatccagtttggtccatggaggggttatctgaaacattatgaccataaaacatggtattaagcattgctagccaagaaatgtgtggtttttagacacgatgttgataggtgatttttatgctcatccattattagtctttgcatcgtgggaactgatttagtaaactttctttagtgtcatggttcaaatagcgtctgttctacctagatgataggtatccatatggaagtcttggctttggaattgctctccttttgttctcctgtgattaaataactttaacatgtgtgtgaagcagggacgcctaggcagcaaacgaagcagaggaagccacaccgcttccgtccaggcacagtggcactgcgggagatcaggaaatttcagaaaaccaccgaactgctgatcccgtttgcaccattttctcggctggtgggtacatcctgaacctgccttctctctatatcaaatatttcgtagtgcaaacttgtgtgatggaagctttttgtgccgataaaatttgcaggtcagggagatcactgatttctattcaaaggatgtgtcacggtggacccttgaagctctccttgcattgcaagaggtcagtggtcaaacctgtttattataagtttacaactgatggcttagttagggaagggtcagactgaattatactgtttaaattccattctgcttcaagactcaagtcacggctcaagagtgtaactgaaaaatgtacaaatcttccatgatcaataaaatgaatatctctgtgtgttgatttatgagtcagattgctaaattattatcctttttcagtagaacacctatatactacaaatatgcaacctccctattttgttgtgtctgttcaagattgctatcatagagtataccaatttcagttccttctttccagccatgtctgtttctgcataaccaggaaaaggaacaaagagctgacttaattctcacaaaataaattatgttatttacttgctgtcctgcaaatttccagtggttttccctctcctgcaggcagcagaataccacttagtggacatatttgaagtgtcaaatctctgcgccatccatgctaagcgtgttaccatcagtaagttgtcattctgaatgaacttttctctttctttttctccctttatattattatgctaaatggatatcatatatgccacagcctacatgatatcatatacgcatccacttcaaaagcattctatttttttataggaataacattctaattgcaggatgattcttaatacatgtgtttatatttaatgtcatatctagttttcatactcttaaatttatcatgattattgattaaacatagggagaattagttggtttgtgagttttgaggtgtgaaatatgctgcttgctattccctgtaaagcttatcagcgttgtcattgtgtggtttaacaaataaacgtttgttctgcagtgcaaaaggacatgcaacttgccaggcgtatcggtgggcggaggccatggtgaaaatttgtttgcgagccatgcagcatgatggacaaggagcaacatgtgtcgttgattaacattttagaaagtagtgtagatgtatcttcacatagggatcaacttacccttcgttcccattctaattcagttgatgttagtatttaccttttgctccatttggattggtcgaattcaggatttcatcaaacagtcgattgtgaaatgtgaaccaggaattgttgtgttgattgcaataatgggttcctctcacctgcttcttccatcagatatttgaacagctgttttcaagaaccctgtgctcaaggaacacaggcagttgttgagtgcagaggaccttgaaatatttcctccaaccccatatattgcactcatgatttgttattcagacaatgttacaaagttactggatctagatggaaacaagtggcaagatggaaaaaatggcaggatctacacggaagccaaattacaggaacaatgagcaaaaccaaactaatcatcaggaactagaagctatcatcaaaattcaagggtgtccaaaggaggcagaagcaatcaagacagcaacataaaagaagggaactcgcctattcagatcctctgattttgtaagcaactacactatcactggtgatgaactgttgatgatgttgatggtgaacactctacttgcaaagggaaaacgaggaagaaactaaaattccacatcaaaattcctatgtacatttctacagccacatctcggaagagctccatgtgagcgtgtgtcgtctactgatagtagcttagcttctaattctgcctgggattcgacttgctcgacggcttctgcttccccaggctcgcattgacctcgacctccacggcggcggcggagcgcgacggcggtgacctcgccgccggcgcattctgcagcagcttcctcggccggatcaggccttctccccctgacgctgaagctgcagcatcgccaagatccactgcactgatgctggcaaagcattgcaggatcatgagaatgcaaatgcagaggacacaaatggtggcagatctcatggctttggtgacctgcttgcggctcactttgctggacagtatgaatgtaggctgttgcagtgaagtgttcagcttatatgagcttaattaagctcacacggcttccatgtgagtaatgaagtggaggtgattaggagtggatgggcgtgatgatgggcatgtggtgagaggctgcgagttggattagtccatttgacagccagcctgcatgcgcttgccatgccatggctaattgcattccgttcgtcagatcagattcagagcgtgccctgagccatgcacggcacatgcgacgcgaagcagagcagcctaacccagcctagcctgctgctgctttcggctctccttcctccttgtactagcacgagtagtctataggactcatgagtcatgacgcatggatggatgcatgattccgggccaaactgtccgaatgattgcacgtgcaggaaagcacggggaaatgatgagatgcgagccccagaaacacggaattatctcgtgaaattcattcgaaattcgacacaaaccacgagatttggagctccaatgatcggaggagcttctgtctgctgcagctatttctggaatctccaacactctcaaacattctaactttccatccagattacgagaaacagactaccacgcgagagtttgtttggaggagcttctaacaactacagctattcataaagtctccagctttctcgatcaatccaacttccattctaagaaactgtagttacaaaattcagaaaataaattaaacccaaaaagctctagattcccatcagctacttctcacaatctaaaactctgctcccccagacaggcatacgatatgtgttgcatgggtgagccgtcaacttatcacccatcgttatcttagccgaaacaggggaactgatgttgatcaggccataacaaaagtctccacagtacactgatcacaaccaagtactaagtatcaaccaaccacaagaaacaggcaaagggcccaatcatgtataaccaaggagctctgagaacttaacagcgacacgtgccttggagaatttacatactgacaagtgacaaagcctccgaagagatcagcagctggggcgacatggctagggctctgctggtgctggtgtttacaagctctaaaccaccaccggctggagggggaagatggaatctcaagctatatcgattgttcctaccgccaaaggatgcgaaatatgtgggcagaccccatataatctacaaaatttactatggacatcgtcaccatcagaaggcggccgagcttgttcgcctgagttgatacttgggttccgggggaggcgcggagttcagtatctcatccaactcctggaaacagcgggggacaaaatcatctcataagggacatcaacatgaatgaacagtaacaagatgctataagctaaatggcattgccggtcttgcttacccaatctcaagaacaagggcagcatgattcacttcgtttctaaactgtaagaaatactataatggaatgtcataaaaccgtttgtcaaatatcaacgggccatcaattctattatgctaatagtacagagagatgtttgtgactttgttcagcatcaagtctctgttcaaggggaaaaggcccaaagttaagggcatgggaatcaagcatcttggtgaattactatggaattgcagcacatgtataacccgtaaagctctacagatatacagagtagtttcatatgcaaaaatcttagaaaaggcatgtttggttgataaatcattaccatgattgataaataaaaggcaaccaaaaaaaggaggcccacctaagtgttcagtgatttaatgtatgcaacattgcaacatttaaaatttacactttaaaagattgcaatgatgcgcaaaattggtgatgacaatactagtgtttcacatatttaatgctgatatataggagtataatgtagcatgataagttgattaaaatcctcaagaacttcatataggtctccttagaaagtcaaaggcacttgcatatatagcaagtcaaaatcaaagcctcatttgattgtttcatagttcaaatatagtagtaactacatctggtacatttgccatttataaggagaacatagcataatccttaagtaaacagatcaaatagaaattactaacacaattacaaaagtatatagcacttatctagttatctgttaccactttggacctgttggtgtaacaactgtggcaagtggatagcgagagaaaaaaataactagctaaaataaaacaggaattgtcgactgtgcaacaacagtatttcaaagccatatcaacataataacacagggagtagtccttagtggaatatcatttgtctaaaggaatgacaaaatagaaacagtacaatggtaacagcagagaaagtaccttctgcttctttagcctctcattctcctcttctagacgaagaactttgttttcaagctcattagtgtaagcctgccagttagaatgcacacagcggtgaaataaatatacatgatccataaaagaaggggaaaatggcattccaatgctactgcaactggtatgttcttacagctttggaaagatataacatatatattgatatattagactaaatactgtatgagtaagagaaatgccaacttaatacatccagagattaaaaaaaaagaatccatgaggcctttatgtttgaaagcagtaaattataataagcaaagtaagagcatacaatatatagaaaattctaagtaggaaggattaatcatacctgcttcctcgctcttgacctggcagctgattccctgttttttatcatcctcttctgccttctttctactagcttatctgcaatctcccctgtggcacagcgtttgcgcccaggtgtctgaggatcagaaagagccccgagcattggcgaagtgatctggccatcggagtaaattggatccaaaacagcacctgtagcaacagctaatggctgaggtgccaggtgagttgccatgtaaggagcacctatgcttggatgctggggctccaaagcctgctggtgatactgctgtagccactgtgctccggcattcaaatcagacgtaccagctgcagccgcagcagcgccccctaccacatccatgtttcctggcaaatcgttcggatccgtgacaaccccagctttgaccaggaaatcctcaagcgtcatctcccccagggtcggctgcctctcccgcctccaccggccaccctcctcagcacccctcttcggcacatcctggatgcccttccacacctcatccaccgtcttcttgctcagctccggaggcatcgtgatgctcccctggcgctgcagccccagggccggctgagactggcccgcgatgccgccaccgccaccgccaccgtcaaggtccgcgccatcaggaaacacgcttttaagcagctcatcaaggttcatactaagcaacggctcccccaactggctctgaacctcattgagtgtaagcccatacagcgacccttgcctcgccaacccctgcatcggcccgcgc

SEQ ID NO: 40767 - DNA, 9877 bp, Oryza sativa
caaatcagcccccgaggattccaccctaccctctccaagtaacctcagcagccgcgatacccagcgaggctgacctaacctgggggcattagggttcaactgaaccccagattttcctctgcaaaaactaacatccatcagtaccagacgcatcacagaaatctagaacaaactggacggggggctaattgggaaggagaagaaaatccaacccaacccaatccaacccgcgaacagattcccctacctacgcgaccccgagccatcaatccaagcggcccgcggaggagaagagcgaagagaatacctttggattcgattcgattcgatttgacccgagacggtggccggctggcggggccgcgcgcgggaagaggcggagggggtcagcgccgccgcggcgggcttctcgccggcggtggccgcggccgcgcgaggaagggggggggggaggagacctaccggagtagcagtgcagatcgcagcgagcgagagaggagggaggggggagagtgagatggagtcgagatgcgtgaaagagaggaaataggaggggtggaaatggggcatgtcacttggtcattgggccattttatttattttactagtactccagcttgtttttgtttgaaattaaaaaaaatcttggcactgttcaaaatcatgatagagaaaaaaactgtttgggatatgaaaaacaataattgaatagtctcttccttaattccatgtcaccgtagaacttcaatactccattcaataatacaaggcacaacgttcttttatttaaagttatttcataatataaggcagacatgcatgcatgttattaactagcactcttttcactggaatattacttcctccgttttacaatgtaagtcattctagcatttcccacattcatattgatgtatctagattcattaatatcaatatgaacgtgaaaaatgctagaatgacttacattgtgaaacgaaggaagtattatttaaatcctacaccatcaagatctctaattttattgggcgcgtgcattctatttattaggatagcccaatctaattttattgggtgcatgcattctatttattaggataacccaatctataaggtgataataattatttcttggtctttgggttgagagtagttgtgccttatatttaggaatggatggagtacatttttgaaatattaaatctcttatttgaatagtctctcacttattataaatgtagttcctgttagaacttcttgcaactgtttgtttttctatttcccttaatgaacgaatgctacgcgtcaaaaaaaaactaaatagatatataaagaaactaaataaatgctactactgttctcatggataaatggtttgtatgtttcaatgcatcgtaaatgaagggcaattatgttatttgaattgttttcataactacccgtagtataagttgataattgaaatccatttaatactatatataaattttatgtggtaaaatagtgcatgatcccgaatcttaccttatgtaaattattgttgggaacaaaaataccatagcttagcatgcattataaaatagagttatatactgcagttttctttcatgcctctatctcagtctcaccgagctacatgaagagccactcttttatgtccccttcgccatgtctcggtgcactaccggtaacctcatcagctgtcctcgaagcttcaccatcatcatctttatgccacgttacctagttgtcatcatcctagttatgcgtcatctctaccttatcgttgtagcacgaaaggaggaggaggctgagctgctacggtgatagaagcgggaggtggcagcaatatgggcggctctggagctcgcatagagcaacaaaattgacagtctcatcccatttgaatcccttattgaggttgccctcgaggtaatcccagaaaggcaaggaacaagagaagaggtggagctcaaaggtccatttttaaggtcaggcttagagtgcaaagaagaatggcaaactaaggtaggcacggactcaggcatgaccaaggttcgttattatccctcttttcacatttgtttgttctcactatattgttcgcctgatgtgttgatgtgctgctgttcagactttgaacctacattttatcatctgtgagtgggttttgtttggctgtattttgtgaatttgtgatgcagtagttgcaacttgtatgcttgccgaacggattttgttgctatctgtttttttttcatttttcagaaatttcgcccgcaattttcaaatttgtattcaaattttttcaaaaaaattcgtccaaaatttccacaatatttctaaaatttctgaaattttagaatttcggtgaccccatacaaatcagtaaacccacaggtcgaaccctgcactccgggagggtatatataatcgcaaaattcctagtgaccaccgacgcgtaccgcacatttccggggcccacctaccagcagggccctccaacctgcccctccacgccctcaccacaaacccacgtgggccccacctgccggtgacccagcccctccccctccccctcctatataacctcctcccttgcgcgatttcaacgacctctctctccccatctatctcctctccctctccgcccatttctcctctccacctgcgatccatccgcgcccgcgaggaggagggagccggacgccgccgcggggagagcaggggagagaaggagaggaggagatcgccgtcgccgtcgccgtcgccgtcgccgatctcggtaaccaccgcccccgcgaaattcccccgctggtcgtgttcgatctcgctggttttgagtggaattctgcgtctgcttccgatccgatcggttcggcagcagctggtttggtttgattttgatttgatcggtagatttgggtgtgtgtgtgtgtgtgcttgttttgtgcgatttttgggggtgggtttgtatgggttggggtgatctgaaggagatttgattggttaggttttctcgctagattcgataggtttggggggggggggggatttgaattgattcggggggaagtttgacccggtttgaccggctccgctcgatctagcttcgttcccacgcttggtgttgggaggaatctgggtgggcgcggggaatcgcttcggttggccgcgaatccgatccgatgccgcgctttctgcgtgcccttgctcgcagatctgcgggctgcgggcttcagatctcgcggatctagctgcggttgctttgattccgctcgtttttctatcgagaccctgtggatctacgggactgactttttttgtcttcatttcgttttcagagcgggagcggagatggggctcacgttcacgaagctgttcagccgcctcttcgccaagaaggagatgaggatcctcatggtcggtctcgatgcggccggtaaaaccaccatcctctacaagctcaagctcggcgagatcgtcaccactatccccaccatcggtgcgtttccaatccacatcctatgctgtgcacgtattgttacgatgtgttcagtaattcagcttatagtggtatggtagatgcacggtctccatttgtcccatcgcattaagttaggctgtgtgcgcataattaacattccagcttgcgttgctcagcaatagatcaaaggtcagaattaggtcctttttagtcagacaataattttttgggctggcttaatgataagaactgtttagcaatgggattagttttagctgatctcaaattgattatttggctcaagtgtgtttacactccacttcacgtataatgtttactcctatatgctaggtggacttaaataaattactgagatgtctccttcaatgtgtttcatcttactggatttaaaacctgaatactctctttcagagttcagccaatgttgtaggatggtagaattatatggttttaggaagttaaaacactggaaaaacaatctgctagcatttacattgatccaaacttgctgtctataactgcaggttttaatgtcgaaactgttgagtacaagaacattagcttcaccgtttgggatgttggtggtcaggacaaggtaagaaattgccttcgatcagctattatttctgaattatttttttggtgcatattatatagtttaacattgtcaattacctgttattaacatgcttgcataatcagaaaccacgcatgcaaactgcagtatatattaccttacactaagctctgatggatctgttttattgaattttatgaaaaaaaaaagaatttagatttggttaacttcctttgtcaaacatatcaatttatcatttcaattgtttatagcttcattctctcatctattttgtcttggcatgttcttgtgatctgatattttctgtgtgttttattaatacagatcaggcccctgtggaggcactatttccagaacacccagggcctcatttttgttgtggacagcaatgacagagagcgtgttgttgaggccagggatgagctccaccgtatgctgaatgaggtactatcaatatcagagttcaaagtattagtctacctttagactcttgttgggaaacaattcataaattgcatgtggtttgctatattctgttgttgagaatcataattcataaatacgtgtgatttgtaagattctttgcccatgattccctctttcccttttttcctctagccatcaggaagatctgccattggtaatatacgcataagatgtggttccaaagctatttgaaatttctaaagagcccaacatggatgaaacaacttatacatgctatcatgcttatcatgtgatgttctagaagctatagttttaatgttggcatgttgtggctacaggatgagctacgtgatgctgtgctgctggtgtttgcaaacaaacaagatcttcctaatgccatgaacgctgctgagatcaccgacaagcttggtctgcactccttgcgccagcggcactggtatggtttcctttcctcttaaaagtttatggcctgctcacacagggctttttagattgatcagcaatagtgtgtatttatatgctttcagcatactatgtgctgctcgcataatggtgctcctgtattctacttaagtactaaatccttgtcctaaaccaagtaaaaccattcatgcattagcaaattgtgaaccaagtaatagcattcagtgtgcattatccaactgtgttgacaatacccaatattagtgttttaaagttaaactttctatgcaatctgaattattcgtcttatgttctcataggtacatccagagcacatgtgctacctctggtgaggggttgtatgaggggcttgactggctttccaacaacattgccaacaaggtacgacaatggcatatttgctgctatagaacatccacagtagcgctttaaccgcgcgttatcatatcttacctaaaatgtttgtaggcaactaaccacctgccttttatatcctaaaaacaggcttgaagcatcttggccgggcttaaatgaaaggaagacatggcggatatccctgagtgaacgctgcctttttacgtatcgaaactatatagtcatgacagataatgatgtggatgttttgggaagataaagctctttaggttccaccaccaaaggagctagctatcagattgtttttcgtggggggttaaaaaatcgtgcgtgtttcagtttggtttttaatcgaaaggcttacggtgcctgacttttgtacctctgtactcgccacagatgttgtagtattgacttgtcttgggcatagcgtattgttacgtaatcctgttctgtgcagccacccccaatatccttaccagtttatcccccgttgccttcctggccagcattctgctgcctttcttcttggatggcacttcattccttttcagtagctttccgtatgtttatattgaagtaagcgcgttgtaacgtcagcctgaaaattgcaaaccgatcatttcctgtgggctgtaagggtttcttggaacataagaattttacaggaatgggttttgatctcaatgaaatccgtttggtcatatcaaatttcaaaggaggcgtaaggctgtgattggcagcacaaacatttggacgaatactttcgcgcacatttcccaaattaaaggtatgtttttttaaaaataaattctactatctccgtcccatattacttgtcgctttgactttttcttccaacgtttgatcattcgttttatttaaaaaattagtgcaaatataaaaaaacaagacatacttaaaataaatttgataataaaacaagtcatagacaaaataaataataatttcaaaaaaaatttgaataagacgaatgattaaatattactacctccgtcctaaaatatagccacttttagctatgaatctggatacacagttgtctagattcatagctaaaaatgcttatattttgaaacggagggagtacaaacaacaactcaaaccgacaagtaatatgggatggaggtagtatataaaaactgtttcaaaatacaatattaattcatttttaaatttaaaataattaattaataattaattaaatattaattatacactaataacttatctcgtttacctatcttttcaaacgttttcttttctctactcttaaacagaatctaagtttgtgtcggatggtgaattccccacccccacccccacccccatccccgcaaaacaaaacttttccgttcccgtcctcgtgaaatacgaaggggaaattttgctcccatcccagtccgcacggggaataaattcctatggggtctttgtccctatttaaaataatatatacgtgtcaaattatataagcaatgcaacatatattcacacccagggaaatcggagtcccattaccatctctagtgtcggtcggagcaatatatccaggcggctacgatgtgcctatgtggagtcctggacgaacgaatattttggtggcatcccaaagtttttgtacccgtcatgttcaacggagcaaacgaaagagaccggcaggcaagcaagcggtcgagtggccattgtacacctgagagctgagctgagatggctacaattccgttgctttcttttcccacatgaaaccaagccggtaaacatgttcgttgccttgtgtattgggttaaccaacccagagacacccgaaaaatgaaaccgtgacagctgcacgcagcagagccacagtaacagtagcacagagagaaaggggacggtgatcatgcctgtaccatgaatgcaagaatgaatgccagctagctagatactcctacagtacatcacttccccaaccgtccgtgcgctaacatccgacgtgacgtgacggtcctactttttactccgattcaatcgccgtgtttagtttcaaaatagagtaaagtgaaccagcggtcctcaaacttataagggtgtgtcatctagatccccaaactctcaaatcgcatttacaggtccctaaacttgcttagccgtacattgcctgtccaaacccatttgactcggtctgctcgctgacatggcttgccaacgtggaggggaggagacagccagggtggtgcattatgcattaagccccttattttttcgccagccctcagacgataaatccccctctgtttcgcttttttttccccatcgagttaagccgtgaaaccgtagggaggctcgattcgtcgcctccatcttcagttcgtcgccctcttcttcaagctcggatgcggggcatccaattggttccatttggcgtatctagagtgaagcccttcaatttgattggcgccatggaagggggctcgagttcatcgtcgacgaatcggcggaagggaaaggggcgtttccctctgattaagtgcccttgttgcgattgtgagacaatcattaggcgtgcggctaatacgcctgagaataaagggcgcatattttacacttgcccttgccatcaggttagttcttctcttctataatctgtgttgtggtggaaaattttcaattcgcatcggtttgctgaggttaattttgtacattttttgcgcagcgagatggaattggatgtcgcttttggtactgggaggaacaatatgaggagtacttgattaatactgggcatcttgcatctcgtgctgtgcatattcagagtccatgttctgctgtgcgtgttcagacaaatgcaatggttcaacagggtgcacaaccatatgttgaaaatgatgcagagcaaattgctgagcagattaaagtgcttgttaggaggatgaacttgttgatagacattggtagggatattgttgccttattgagatgtgtagtagctgcctgtgtggttgttgcggtgacaaatatgtatgctttctttaggagtggttgaaatgtgtaatgtgtgaaatgcactaaaaatgcatggtgtgtgatgaataaaatagccagtttctttaatctgcatctttgtgaatgttgggtctatacaaattttgaaggaatgcttgttcaattcatagaatatttgaggcacaatattgcaaaggcaaaatgaggcacacattcagtaaaaaggcagaacatccatttcagatactttcagcacttaagtatcacaaaatgcaactataattctggcaatcagcaagtagccatgcacttgcactacagcatgcagctgatatagcatatttttaatccattatatacatcacagtgtgttgacaaccaaaacaccattttttgtcagattgtcactaaacaaaatatattcccagctaactaataggcattaatttgttccaatcccaggtgcaggcttcttttttgatgcggcacttgcagacttcttgtttccagttgtggtctttcttttcttcagtgccactgacttccctaatttggtgttggttgtaagaggagctggccttgctgatggaatgttagacatgataaaggcaggatctggcaatgggcctagttgttgagatagcacagaactttgatttggctgcaaaattcagaacatatatacatgataaatagtttgcaatgacaagtagtttgcaatgtgagattgaaatgattgaaaacaacattacctgatcagccatctgactaaaaacagtgcttcctagctgtgatagtagttgagatgaagtctgagaagcagcaatatgttcatctatgacatcctatatataccataggtcatgtagttcataagacatgcaaaaaaaacatgtgcaacagaggagttatgttcagtgatattttacctggttgataacatttggttcttgttcagtgatattttgttgaatctccattgcaagtgattcttttgctgtggcaaccatcctctttgcctcctcagaactgatgccctgcttctttagtttacaaccccctgagttgtgattttcttctccacaatacttgcagtgcatcatcactccatgttttgtcagctttggaccatttttgccaattacttcatatggtgcctttctcctagactttttgggcctgccagccttcttctcatacacaggtggcttaatctcaggaccattgatattttcccatttgctcttgtcattgcagggccaaatgttgaaaccataggctttactgaatgcatctgtagtgtagcaattagggagaatactttcagcatttatcctctcatgcctaagacaggatatggcatgattacatggaatccctgtcaagtcccacctcctgcaatcacaatgcatagcattgatatccactatgtactgatattccctttcatgcacttgaaatattccctgcccagctgg

SEQ ID NO: 40768 - DNA, 703 bp, Oryza sativa
agattcctgcacccttatcttctaaaatagagttatatagaattatatgccatgaatagaaagagtaagttcagtaatcacgtaccatatttcagatacaccatttctgatgcagggcaactgaagccaagagcaaccggagttcagttcaccgatgagaatggaggactccaccaggcattcctcaacagcaactgtgatagtgaaatcattgtctctgctggcgcaattggcagcccccagctgctattgctcagtgggattggacccaagaatgaccttaggagccataaaattcctgtagttctccataacaagtatgtgggtaaagggatggctgataaccccatgaactccatattcataccgacgaaaagcccccctcgccagtccctgattgagactgttggaataactgaagctggtgtgttcattgaggccagtagtggttttggccagtcaccagaaagcatccattgccaccatggaatcatgtccgctgaggtatgtcatcaatcttacttgcatcatgagaagctttttgtgcataaaataggtctaaagcagtatcacaaacatcaggaaaaagctgctgcttagatctgcagacttcaaaaaggaaaacagattctaaagtctaaactatcaaaactcacattttgcaacattgcaaacacaacttagaccaattcattaattacag

SEQ ID NO: 40769 - DNA, 8483 bp, Oryza sativa
gttagagtatcaccaacaatactccaatattatcctcaaaactgattttgagggccataaggaccgcatgatctatttcacacggatggaggaaaactgagaattttgttggtagtttgatagaaatgctcacttttatttttttaagataaaatttagtgtttctcttggagagttaagcttttttgtactttctatttttagtttagaaagcataaaacaaatttttagagagattatatataatctcttggtgatgctcttaaaaaaaatttcatcgtgataaggagcggagggaggggggaagaaaatatttttccaaacatctagtattacatctagtattacaattgacacttgcttagggtataatccataaattctggtttattttaattttttttctttctttctcacttaaatcccaggatggtatctctttcctggatgttggatgggccaagaattcagtcttcttaaataggagtttcaatatactccctccgtttcaaaatgtttgacaccgttgattttttagcacatgtttgaccgttcgtcttattcaaaataatttgtgaaatatgtaaaactatatgtgtacgtgaaagtatatgtaacaatgaatcaaatgatatgaaaagaataaataattatttaaattttttgaataagacgaatggtcaaacacgtactagaaagtcaacggtgtcaaatattttgaaacggagggagtatttgagaaaaaaggtcggtctatcatactatctttactggttctttatatggtgccgggatgaactgaacgtttcacttaatccagctctggccattaactgactttgtgattgtagcgatttggtatttttatatagtcgggtctgaatagccatcttttttcacctaaagcagcaattgtttatgaattttgcgatttcccgtaactatttgtgcgagatgttccctctagtatgaactagtcttcacttatctggccttcaactttgtttaggaacaatggttttgttataaaaccagctccgaaaacgacatcggaaaccaaacgcggaagaaaacgtcataggagatccaaaacgatgacgacaccgaggcacgatatttgataacggagttcagctgaagcctacatctccgaggcactgattactgacgctcctccccaatccagcatatacagcatatcagagttacaacgactcacgatcggtcgccgccggcagccgctccctctcgctatgctaagtcgtcatacggttataacaggcacgcccctctatttatgagagatcctaggatagagtccgactcatactctaatcctggtgacctggtgacctggtgactggagtctggagcaggcaaaaaaatcatgcttggagttggatcccatgcttgggtttacctgtaaggctgacgagggatttcacgatgccgagggcgcctttctcggagatcacaaatgatttctccttcacaaagctctgtatagcttcttggtgtcgtagtctagacgctcttgatgatctgcgacattagggaatggaagtcatcagtgttgtctcgaggaactaaatgaacacaaactgttctcaacagtgaagggaaaacatttcaagcgcctacataatcatagtatgcaagaacgtgctgaagttgaggcaagacctgaacttgtttaaccccttttgtgatcatgcgaggcgaggctgcatagagaatatgtggcatacatgcagggattcagctactaactttagagcaaggataatggtgagctataagcaagctatatgcttatgtggaagagagagataaagaaaagtggggagtgtggctctcatgcaagagctagctccacacaagctccaagaaatatacattaaattcatagtgagataaagagaagatgcaaaaataaagccaaccttacagctaacctattatacatgttagttttaacattgacttatagtaagtagtgggatgtactactaaacttgctcttaatgctatagttacgagatctcgtaatatacacgtcgttccgctggagatgtatttttgggctattggcaaatgtgagtaatttgagaagcacgacaaccaataatcctcctggttgataaacaacggcacgtgaataaatatgaaaacatgatcctcaatagacttaatggtagaggcctaactccaaaatagtaaattgaattgtacctatttgtttagttcagggaggtacctttatcaaaaacaatgtgtgctacatgaaatggaacacgagcaaagatatctgatcatggaaacattagccaggtatcctctttgggattgtgatttccgcgagtcgagcatatctccgtaaccagcagcttgccagaagttccttccatctccttcattataacctcgaagggagatggcacactagttttggttgtcctagctcttttccggagcgttgttagcgcttcctgttaggccattcacagtgctatgcgctgccattcggcctgaacgttccatgtacgtaaacagtgaaaatttgctgccacgttattggttgggcccagaaatctgaagcgtgcgtgaccaaagtttgctgcctgtgcttcgcttgaatcgagattggggaatgcgtcgcgggcgtcttttggaggctaaaacgcacttctgaccttgtgtcttttagagttcttaagtcctgtttggcagccgaggccgaacaaaatttacggcgcactgtgagtgcccttagaattccttatcttgtcattttccactaactgatcgtcgcagaataaacaaaaatcagaagtgatcagtatcaagactcatgtaatatttttacaagaattaggtcagtcagtagcacatataaacctgatgtcttgccagaagaagttgctctgcatcagtttcgatgtcaactagagctttttgaagttgcttcattttggggtccattataaactacaagataataccacttatttcaactacaaaataagaactacagaaatcagcatagcataaaaaatgcataaaaggcttcaaaatctttatagttccattttatataaatcccctttgagatagagccaagaaaagaatgcaaataagcgcaacggaaataatttgaaaaaaaattattgagttatgacttatgagccataaaaaagtacttttgggtttatgccaccccaaagtatgacagtttgaaaacgacaccccatagatgtaatggcattgatgccactccaaagatgtgtcactaaagttttggcccaagtgtggtattagatagtaccccagaatttttttgttattttttgaatttggccaaatccttgcactatcgatggaattctcgtccttaaaacatcccagcaaatgtccttaatgcaaaccatatcatgaccatagtattataagaatttcagtcaatttcaataattgactgaaatgatattgttccgtttctacatatattcttgactttggctagatgaataaaatgatatggttcaggatgacgggatacaaattttaagaatattcctaaaatagttatacaatcctgttcaaggaaaaaaaatgaatgacacagctcacggaagtgacgaatggacacagttccgaaatgcacaagataaaatgaaaaaatggacaaggaaactgaaaacacaagcctccttttttgccactaaaaaaaatctcatttaagacttttttttgtttcttgaatatattgaagtactgcatgcaaaatttctaaatttacaatgaaatcccaacaacattcctaaccaggtcataacaggtgtaggtcacaatggttgccagatcgtgctaggcttaaaaggcaagtcaagccctcaccaaagtcccaaaaggttgttttttccgtttcatctatcattagggccttcacagtgcaggtcacgtatttgctggatctgagataccacctaggttcaagccttttgaaagataaagctttgtgtgactcaaatagatccaaagccacgcatgacatacgaggaggagggtgcgcagagacgtacgaggccgaagctactcactccacaacgcgaccacctcgtgtgttccttcccccatgctcgaagaaccggtagccttctttggacgcgcacgcttcgttttggtgggcccggtcaaaagacgtggtgtgattttcccctccgcgtcgacgtgggacatggaggctgaatgccacgacaccgcattgtgaacacccttagtgccagacatattttatgttttctaaatcgttattcataatgaaattaatttttaatataagattagcttgtagattttataagactttgagccagacttatgaacctagtctcacccatatctcacccatttaatcaacctaatcctaccaactaaacaactccatagtccatacatacctcgcaaccaaacaagtaaatgaatgatttggttcataaaaccaaccaagcatggactttgtaaatcacatcccgaactattcatccttgttccccaaccaaaacaagcccaaaaatatacaccggaaggaaaatatatagagcatttcacatttgcagttcaaaatatattacctacctatattactagcaatcaaagtttcagccttttgggtattatgaccttcatctagtgtaatagagtagtaataataagctagtaatccagctcttccttccacaaacaagggcattgcaaccaagcaattctaagatatgttttgaacaagtgtcccacactgcaaaagagaggaggaatcgagaaggcaaacctaacaaaggggaactagagaagcgccgatactgtacgccgccgacaagaggagggtttcctggacgggagaaatgccggggccagcagatgcagccaagaagccgcccacggcgcacgcgtgattttctcgcctttgaccataatccgagcaacccctctgacatcagaggggaggacagctctagggagaacaagtagtagcgcggtggtcggcggcggcggcggcaaacgggatgtgagtggacacctcccgtcgtcgtggcgacgggtgaaatttcatgagactccctatgttctaaaacaatcacgtatttaaaatgtataccaaaatattctattaaccatataagcacttcaaacaatatttttgagactaccaaagtcttttctcctcgaccatcatcacttattttgaatttcttgatcaaatttctttgtagagtaaattgcatctctggtacacgaacttgttaggtgggtgcaatctagtgtacgaacttgtaaaatgcttgttttggtgcatgaatttatctggagcgtgcagagaaggcgaaaaggacactacacggctaattttattgatttaggggctcattaggatactatgtaaacatgtatctgagaaggttgctattagataaatacctcttcaataaaaataggatatagggatcatagaaaaagataaaaaaaaccgagtaatgatataagggttagaaatatatgaaattcattaattccatgatgaaggataaagtatagatcaaatttataaatattacatgtcttatatatactcactatacgtatgcacgtcacatcctaatcaacatccgcttcgtaaaattaacatttcgaagctattttggtcctcgttcgcatgaactaaacaagttcgtgtacctaaacaagcatgttacaagtttatatattaaattacacctacctaaaaagtttgtgtactaccaatgcaatttaatgagtaccatttctccataatattaatcattggtaaataaccagaacacttattttaaaacacagtgtacatatctaaaaccccatttgaatgtaacaaaaacactgagcatattagcggcacacgaaacaagactagtcattacctcatgattagttaagtattaaaagtagatttctttgatttttttaaaagcaatttctatataaaaaaatagagtagctaagacaactagttgagtcaaacagtgagagataaggtaaaatttgtattttttttataaatttaattctacatatgtagttttgtgaaataatatgtaaaaaaatatagttttgtgatattttttttaagtatatgcagtttaaaaattacttttacccaaaaaatcaattattcccatcaagcagctgatgcctgtttaggaattgaccctttgaactataatatataattactttatagtctattctagtatagtttattttggatcaaagattcaattgtcatttttctcatttcctttccctctgtagttgtatctcctctcgttaatttcttattaagtcaatatcactaaggctctgtttgcaaagaacaggttcccaacccaacggaaggcacgaaaaacggagtggtccattagcacgtgattaattaagtatttactatttttttcaaaaatagatcaatatgatttctttaagaaacttttatatagaaattttttaccaaaagtgcaccgtttaacagtttaaaaaacgtacgcgcgaaaaatgagaatagggacttaggaaccaactcttgcaaacagagcctaagacaataagtggttaagttggcaatgggcttatgggcctatttagcacagctccagctccaactaaacagtttcagctttggaaaagagctgggtggagcgctcccacaaaatgaactagagaggtgaagttgtgtttaggctactccacaactttactccagacacaactcctgaagctaaatttaggagttgaaaatctaccaaacagaccctatgtctatcattttggctatactcgctctctaaaattgatttgtcctggagtcgtggtcggtattttccctctcaagattgctcatccgttgctatcacttttcacgaaaacttttatagctttgacctcatttttcttttgctttgatttatattgcaacaggaaaacttggcaagattttcaattcttccaatctataccttcattccaaaatcctcttagaggaaagaaaaaccaaggtttttaatccttcttttaaaaaatcctctccatcccaaacaacttgccagcttggagccttggtctaggatattcggtatgtactggtcctgtagcgggaggctgaaggtgattggacttttcattttagcccttttgtaaaaattattttacaaatacatctaaaaactttattgtataaatggatccgaaactcgacgccaaagttgaggttaaatatctcgacatccgtaccaatgatcttataccatagtactcaatccgtttcacaatgtaagtcattctagcatttcccacattcatattgatgttaatgaatatctatctattagatatatatctatctagatccattaacatcaatatgaatgtgggaaatgctaaaatgacttacattgtgaaacggaggaagtatcaaagtgtccattgtgcgtggttggtgaggtggatggggacaacactagtctgtctgctgctgatagtctacacctatgtcattggtgtttgatctcccacacacttatcccaatagtaatcctaaaagtaaaagctaaattaggaatgatttaatttccatatgaagtccagtatcaaatcgacatgatttggagggaggaaggaatgaggagggaagaccgtaccattccccacaataaaatatatatcacgagagatgaatcgacatacgtcggtttatcgtttcccccttcttttcatgctgagatattaacatatcaatctccagcacacgccctttgtcaccgtgggtatccacgccaaaacacttcggttcgactgaaacacccaaggttatcgacgtggagctacgaatctattttttatcacaaattgcttaaaagggtctatctataaaaacaggttttcgaagaggatcaaactgtaaaaaaaagaagtcccctaccctacggtggtatagtacggtgcgacgcacactactcgtgtcttctcctgcgcgagagactcgaggactcccctcccccccctctccaaaccctcgcctcggctcccccgcagccgcgcacgccaccgccgtcgcctctcctctccaccgcctccccacccacccgctaggtttccgccgctgcccggggttctcgccgccgcgccgccctcccccacgctcgctctccgggtgggggtggtgccgcccctctcctcctccgtttccaggcgggtgccggccgggggggtctctcgccctcgtctcctctccccctggtcgtcggcaccggcggctgggaactcgccgacgcgtcgtttccccgcgaggccgccgcctagatctggaggagggggtttgggggtaagctcgtggcgattcttcaatgcccgttcgttccgtgctattttgtattattttttggggggggggt

SEQ ID NO: 40770 - DNA, 25435 bp, Oryza sativa
attcctgcagccctaatgttgcagtagcgaatgctaatgattttttcttctgtagttattagccagtgaaatttgtcagtatcttgtctatagctgttttgaaccatgctattgattttatttgagatttaataatatctgtttgtccttagaagaatgattttatttgttctgtttcgtttgccattgtacaccacctatacatgattagatacttgcctattctgttcatgtccagttcttttagtaatgcgaattgcatactctttttctgacatctgtagagtttagaatgcgtaacctactccccctgtttgagaatgtttgctgctaacaagtatgacgtgtcaatatggaataatcaaaagcttctaaattgtccacgacttttgaacagtttgagtatatgttattgccctcagacatttcgagaggaatatcctgtgccatcaccctgttgttttccggacgcccctcatagcttgttttcaggacatgtatttggagaacaacaggagatgcttccagaattttctttctaactgttcaagggcatgaaaaccaacctgaaccgcgtatcctcaaattggattaggtatctttgcctaactagaaatcaggatacttcaccattagccaatcttttggagttaatttactaatgttgagtgatgagtcttctgtgagcgtgtaaatggtcctaagtgatttggaactggtgattctatgaatgagccttcgttgcaagtatcaagtagcagaaggtcaattgtgtgggaacactttgaataggacttggtaatcattgatggtgtcccaaaggctatgtgtaaaactaacgtgcactcacccttctgactggaacagtggtttgtcatatagtctgaatattttgaagtgtgagcatgctgattttactgtatggtgtaagcattgtctaattcgaaaatatgacaagatatgcaagctataaagttttcccacttattttttctgatgcctgattgtgctcttgaatttttttcaggtaaaatactgtttgttagacaacaagattgagattctcaaacctgttggctggtgctatatcatttgcatttggttgaactcgaaaccaaaaggtactgtgaattgcaagaattgcaaacacttgttattctcttaatatgcaatgttagaagaatatggattggagttatattactgttgttttatttctgctgtttgccactgtatgacctaacacctatgcatgattagttacttgcctattctgttaatctacactctttttagtaatgtctaattgtgtactctctttcggacatatggagagtttagacctttgtctcctgtttgtgggtacttgttgttactaaatatgacatgacatcctggcatattagcaatgatatttggatagtttaagtatatgtggtttgggttggtttttatcctctcgtacagcctcaccctgttgttctccggatacacaaactcagagcttgttttcaggacatgtatttggagaataatagggtgatgctgccagaattttcttttgaactgtacagaggcataaaaccaacctgaaccacatatcctcgaattggatttggtatgtatctttgattaactgggatacttttccatgagccatgtcattttatggagttaatttgctagcgttgagtgatgcataagtatgcaagcatgtaaatttttcagaatgctttggaaccactgtcctgtgaatgagccttccttgcaagtatttagtagcaggaggtcaattgtgtgggaacactttgaacatgacttggtatcattgataatgtcccaaaggctgtggcaactactatgcactcagcttttttactagaagagtgatttgttgtataatctgtatattttgaactgtggtcatgctgattttactgtattgtaaccattgtctaatttgaaaatgtcacaagatatgcagtctataaagcttccccacttattctttctgattcttaattgtgctcttgatctctttcaggtgcaatactgttggccacataacactattcagattctcaaaccttttggctgatgctgtatcatttgcatttaattaaagttgaaaccaaaggtaatgcaaagtgcaaccaactgttagtcttgctgcatatattcctctttgtctgaaaagaagaaatttatctgtgttatatactagcaaatatacaatgcttttatctcctagatgtattattgatttcgctctttttttttggcccttggtcagcaattctctacagtactgaacactcaggggaaaaacacagaaattttaggggttttgtcaatccctattatacaaataataattttacgctcaccaagaaaatgctactcctttccataaggggggcatgatgcaggctaaaagattgtttaatcgtgttgaagttttatgttttgttcttgtaagtaggcctgctaatggtcttgaaaccgttctgaatccaaactacccaacaaggacagcttctcacccacaaatctattgatagaaaccaaaccaaaccattccagcccaagctcccaccctagccaaaccttcagtagtatgggtaacagcattacacccaattctcagcccgtttctaaccatggaatactttttatcaaaatgttgaagtaatcgaagcatctccagtcttcctataaggatatttttagtaatttgatctatgccaccactttaattacagttttggtttatgctgctacttttttggcaaattcagtctgccacacaaatgtgaaatttgtttgggccacactgaatttgttttggcaaacaatattgggacggatggagtattactaatggtgaagcgatattgctgtagatttagtttcttgagataggcaagaaggcctatttggcctttgttctactgtagtctgttatttatcaacaagtgtttttttggtccaaatggaaattcttaatcagagtcacttgttcaaattttgtgcaggctggcaacttgttaaaattggtgtaccatttgttatttgaagccatagcatatctcagctcctgaacaataaggtgctgtattcagcacagtttaagtgtgaaaaagaatggatagaaaaatcacactttgttgccactggtatgcttttgaaagaaattaggggtttggatctctatctattctagttacaatggattgcaacaaagatgaggctgttaaggcaaaagctttggctgaaaaaaaaatgcgggagaaggatttcgctggtgcaaaaaggatgattaacaaggcacaaaatctctccaaagatgttgacagcaacatttcacaaatgttaactgtttgtgatattcattgtgcttctgcaacgaaggttaatggagagattgattggtatggtatacttcaagtacctgtcacagctgatgacacactaataaagaaacaatatcgtaagcttgctcttttgctacatccagacaagaacaattttgcaggtgcagaggcagcatttaaattagtgggagaagcaaacatgacgcttacagaccgctcaaaacgttctgtctatgacatgaaaagaaatgcctcagtcagaattggttctgcaagagttccttatcagcaatcaaggagaactgcacctgttagacctaccactacacctgtgaatctccataatgtgcatcaatcacaacagcataagccctcaaatccttcagactcacaaacattttggaccatatgcccaacttgtggcatgcgatatcaatactacctttcaatattgaagaaagctctccgttgtcagaattgcttgaagccctttgttgcacttgatttaaacgagcaagctgttccttctggggcaaatcagaggtctgctggggtgtggaaaagttcaggagcaccacaaaactttccaggttcacaagcaaatgtaggacagcaagctcagaattctgccaatccagtccatgctaattttggttctcataatgcacatgtagaaacaaagaggggagctgatggaaacgaggctggtgggctaaagaacaaaagaaaatttgctaaggcaacagggaattcttcaaaagcttcttcagttgctggatcaaaaaagcgcagaaaagctatgtttgaatctagtgaatctagcgcttcagacaccagcactgatagcgaagaagagattattgaagatggtcctgctgcaagtaatgtagggccagatcaacatccccgcagatcaagcaggcagaagcaagaagttaagtataatgaagatagcgatggtgacgacactgactgtcacggcaatggtgatgatggttttgtgagttctcccagtttgaaaaggttaaggaaaggcggtctgtttcatggtggtgaaaacaatgaaactaagttgaatgctgacacaactgggcctgggcatgatggtccaactaatggtgttaataattacaataatacagaagacatagagagaggctctgcttgtgctgagcaaatcaagagggaaacaatgtctggtggaggaaatagtgctgagaaagaaaaattatcccattctgtcagcaacaatggtctagagtcaaactctgatgatgctccaaatgaggttatttgtgcggattcagaattttttgacttcaatcaacttcgacatataaatcagtttaaagccaaccagatatgggcttgctatgatagtcaaagctgtatgccaagatactatgctcgaattacaaaagtaaaacatgtcccgaagtttatgttaaatttcatttggctggagtttgatcccaaaaataaagcagaggctgcttggtcttctggggacctaccagtgtcttgtggacgttttaagcatggagtgtcagatacagcaaaagagagcagtatgttctctcatgccattttctatgaaaaaaacaagacaagaaactcttatgaaatatatcctaggaaaggcgaagtatgggctcttttcaagggttgggatattgattggagtgcagatgctgacaaacacaaaaactatgagtatgaagttgttcaagtcctctctgatctcactagtagcactagcatcattgtcatgccacttgtaaagataaaaggctttgttagcttgtttattcagtctaaagaggcatccccatatgtgatacctcaggatgacacactaaggttttcacattgtgtccctcgtcatacgatgattggaaccgaaaaagaagggattccagaaggggctattgaacttgatcctgcggcgcttcctctgaactttggagtggcttttgcttctgttgttccagaaagctgctgttcagtgaaagtgcagggttctggtgctgaacacataggttcatccagtggaaataactgtcacaagggatcggtggatgttggggagagccaacatgctacatgcgcaaatacagggttcgctacaaggacaacaaaggcagagatcaatgagcacaacgctcgatctgcagtagaaggtacagatgatgacgaggaacctgatgattttgcccaagcagaagtactatatcctgaatcagaattctttgaattttcagaaataagatcgatccacaaatttcaacctgggcagatctgggctctctatagtgatgtagataagttccccaattactatgcctgcataaaaactgttgatgtcaagaataatgaactgcaagtaagatggcttgatgcttgcccacagagtgaagaggagagaagattggtaagagaagatctaacagttgcgtgcggaacctttaagatttccagtttccatggtattcaaacttacaatggtacagagtacttgtctcatcctgtacaggccaaacctggtagaagaaatgaatatgaaatagttccttgccaaggtgatatttgggctgttttcaagaactggaggactggatggaccgcaaaagattataagaaatgtgactatgaattggtggagatatttggccacactgattcatccatacaagttcagcttttaagaaaggtggatggttatagggcagtatttatgccagacagaagagagggagctgtgaagacaataaggaaagatgagtacccaaagttctctcaccagattccttgcttccatctgacaaatgaaagaggaggcaagcttcgaggttttttggagctcgatcctttgtcagtgccagagatgtttcttttcaccgaatcaatctgagataagccttatcccaagttaatctgctagagcatttcttgtgatgctaccggaactaaaggttttccagaagttgggtagtccacaattcaatattttgcttagtgacagaagctgctggattttcagaatttgtatgtagcagtaatgttatgggccgcagcttttgcctattctccaatcctcactatgaaggcgttgtcaggcaatcgggaccgttttgcaagattagctgcagtctgaactgattaattttcctgcagctgctttacctagttaccgatagttgtatctagttctctagctggactatcaatcgtcctttctcttgtcgtactttgcattgttggaccatgtaaaattgaactgtgcgaggccagtctgattaattcggaaatctctgttggcctccctttcctggaacttaatgaattgagtccaacttctgtttaggttgccaattgatcatcataggggtaacgatgaactagattctgtgcaatgcttctgtgatgggaatggacagacaccctgctgcagctctcccaaggtatcattcgtccatttattgatttgtttctctgctgttttctttccagcaaggtacaggtttgttggcatccatttgatttgatcttttagttttggatgttggtatgctgtgtagctgttgctctatgaacagtttcaaatctttagaattgggatttggacctcgagcctgtgatttaggtcttgtttagaacaggtaggaatttgtgggaaatttagttcagttttagttgtatgaaccatacaaaaggttagacttcatctctgcttatccgaagtctttgatgtaatggtgcatctctgaacacaatggtctctaagatagattaaggtttaatctaagatctctgttgcttgatttcagctgatatactcggtcttaaaagactagcaagtagcaactggattgctttttctaatgatggtaacagagtagcaatttatgaaaagtttatggaccgatgccccttttaccggcagtgttctcatctctatttgaccaccatctctgttattagtatcatctcagggagccctggtttagagtgtgcacaaccacaatatcaataaaaaaatatttgttatccttcaaagtcaacagataattacttagtaggacaaaaccaatatcgtagctagatgctcatccaaacaaatctatgatgaaataagcattgaacctaatcgccatggaggcattatcttaatcatgaggattacaaagaaaatgtatataccattagcgaacctggcgcgtccacgaaagctacctgcatccaacctgccttagttgcagcttgcctctgctctctgctctagctgctatccgtttctgtctcggacaggacgagcttaaagctgcgtcgcccatgtcgccgttgctcagtgacaagtgtcgtcgcgcacgcgcagcgatgtcgtcgtcgccggcgccggtggagtccccgtggctgacgatgcgcgccatgcggcgcgttggcggcgcggacggcggcggcgggcagcggagcgcgctgatggtggcgtcgtacccggtgctgctgctgctcgtcgtcctcgccgcgttcgtcaagtacgtgtggatcgcgctggcgctctacagcgcgctcctgctgctgttctcgtgcgcgtcgcgccgcctggcgctggcggagcggctgccgtcgccgctgggaggaggcggaggaggaggaggagtcgccgcggtcaccgcggcggaggagctccagggcgcggcggcgcggggcggggtgtccggggagacgctggcgtccatcccggcgttcgcgtacgacgcgtccgcgcacggcggcggcggcgaggcggcggcgcagtgcgcggtgtgcctggaggcgctgcgcggcggcgagacggcgcgccggctgccgtcgtgcgcgcacacgttccacgtcgcgtgcatcgacatgtggctgggctcgcacgccacctgtcccgtctgccggcgccgcgtcgagcgcaagcacaagggcggcgtgctgccgccgatgccgccggagccggagacggagccgccggtgtagctcgtcgtacttcctgtgtcttcctcctagtgatgcagaagattgcagaatggcagacaaaatttgtcaaatttgtactacatgtttagattagaggtacaataggccagtttttcttgccactctgcttattctgctgtttgtagatgctaacgcgactcatctttgtgaaatctgaagcctgtcgcatacacaaattgtcaccctgttaattatgatcggacaattttcttaactacttttcgtctttcttcctctacagaaaaaccactccctcttaaaaaaaaaacgatccaaaaaacccgtgaaaaaacggcataaacaaaactcagtttacatttttatctcccaattcgacataaaagaaactgaactacatttttatctcccgatccagctgcaacgcacggtgcgttgcacgtaactagtcatggtctcatggacccatggggtgttagtaacagggttcgcaatctctgtgagtgaaaaaaaaaacatcttgggggcgaaacttttgatttttttttgaaacttaaacaaatttccactgaatttaaatattccttttactaaattaaagcacattgaaagtttttggccagaggcacatcgcaccatggtctatcagtagacccgaaatttctgaaatttcataccaaaaatgtgaaccatgttccggaattaccacaggtaaccactcctaagtcctaacctgtccatgatgtgaactgtggagtctgaattaaatttgggatgtcactaactgacatcagggttaagctaagaagcactggaattaaggcatgtgagaagactgagtatttctattttttcccctagaattttgcaaatctgcattcaacagcatcacctgcagcatgtttttgacattgttggtcagcacaaattatttcttaagagaagcaaatgctcatttgcactacaatcacttgaatacttgggccacattattaactccaagtggaataaaggtttggccgggtattgaagtccataaaaaaatatggtatacttttaaccgtcctctcactgattatttatttagggggtgtgtttgaatgcgttcgtaccttattcttctcgcacgaaaaacaagctaacttattagcgcatgattaattaaatactccctctgtactaaattataggtggtcctttttttggaaaatcaaactaggcacttttgattaataattacactaataatacgtaggtcaagtattattatgttatattattagatttgtattttaaaatattttcatgtgatagtaattttatagctgttgatgacataatatgaaattaattaatggttaaagtatgctattgaagaccgtctaaaaatatattggtcttataatttgagacggagagagtattagttaagaaaacgtgaaaaatggattaatgagatttttaaagcaacttttctatagatttttttttgctaaaaacgtatcatttagcgtgaaaaataagacaagtttcataaatgttgctttaaacgtatcatttagcatgaaaaataacaaagtagaagttggaaaagggtagtgttgaacatagccttaacagtctcaacataatcaagaattttgtaagaaattaaagaggctctaactttagggtgtatttaaccctacctaacttctatctctataatactacctccgtcccaacatatatgacgccattgatctttcgcataacatttgatcattcttttttattaaaaaagtaagtatgaatatgtaaaagttgtagtttctatgatgttaaaacaagtaaaaaaaagatatttatatgattattttgaataagataaatggttaatcattatgtcaaaagtgaatgacgtcctttattttggaacggagtgattacttcaaaagctgagcacctgatgaaggaataggttatgtccttcaagcaggacaatcatagcattttttaggaaaggtttgggacttcagaacacaagcattatcgacctatgaaaaaaataatgctaactaatttattcgccgccgataagtggataagttatttgcaacacagaccatttaccatactaactaattacaaaaagccacactcatttgggagaacaaaaactcatcactagtattcagcaaaagcttctcccaatttgtgacatcctcctacctctacctgtgttaaccagatgacaaccagaactagtgaaagtgtcaatgatcaggaacaaaaacagagactcaaccactagtaaaaatattagatgatctatcaaattccaaacacagggtcttcctctctagaatcttgcaaactgcctacgatcatcactgcctttccttccgtatgggtttgaagggccgataccatgcctcctgccagtgtttacattcctcttctttcgatgttttgacgcactgctctccaggtccagattcacctttggaggctcactaaaacagaacgaagccgctacgctctgcaagacagcgaggaataacacacaagctagttcaattttctgtggtgtcaaaccctctaattcggtatgcgaatgaacacacgccattttcattggcgttgaagaaagagtttaagaagcattagcatttatcttacaccaactgacaattagacttttcatcctcagctagcatgctaatctaacagtaaaattaagaaaataacaactgtgcttctacttgagaactaagattagatttcataagtgaaagaataatttaaaaatgaactaaaggaaagagaacagaaatatgccccaacaaacctgagtaacatttagtgtgaattcttacgtgcaatgaaaacaaaatgcagaggaaaagtaatgcgaacaaaccaaagacaaccctgagaaagaacactgtaaaattttaccgtcaaatcaagttgatggatagcaaaaatgtctttcatagagtgtgatttgtatgccaaaagataggatttgtaggcttctttcgccgatctgtttaggatgtaattcccaccaacaattttctcctgctcaaaacttgagtcataatgctacatattgaaataatgggattaagtcattgtagttatgtaaagagacactcacaaggtaaggttgcaattttggcacaagctcttgtctgaacacatattcagatacagaaatattagctgcctgcaggaaaacatgaaacatgttggggcgttttggtttgataccaaaatgttgccataccaattttttggtactttaaatagtaaatgtgatgatttggtttgaagccaaatgtttggtaatgcctatactcaatgtggcacaattctagaatattcttcaccacaatttaaaatttggctctcaattggcataaatccaaatacactcatttacaattctaccctaccgaaatattggtagtgccaaaacttgcctagagtttgacactaacaacatattggtaaggtactaaaccaaacaagcccgttattccctctgtccaaatatattatgggttggagaagtcaaatcataaaaatgtttatggtatgaaattatacaactagattcatattttaagtattttgtgagaaaacaattgtcagatgaattatttcatactttcaggtgaatgagcaactgtaattctttcggtagtaagaacagtattgcacttcctttgccattatcgccacgggcagtacgaccaactctgtgaatgtaatcctgcaaattaaattccaatgtcaagttagtaaaagtgaggaatagaaattttctttggcaccatttaaaatccctaacctttgtttcatctggaggatcatattgcacaatatagtcctaaacaaggcaacaaactcttaggttagtaagtggacaaaaataggagtggttaattaaatggtctaaaaaccacaagtcaaaaacctcaccacatcaggaatatcaagtcctcgtgctgccacattagtgcataataagatgccatgttctgccttgtgaaacttaaaaaatgtactagttcgttgatgctgctttagttgcccatggatatcataacactctatctggatgaaattcagaagttgtgcatggaatttgactgaattacatgatgaaaagaacaccatgaccttcgtcttctcagaaagtgccttttttaggaaagcatacagaaccagaaaccttctctcactaggaatgacacaatagccctgcttcaatccttcaacagtagcctgaaagagcatcgcaattatttctcacaccaaagaacaaaaaaaagttccactaatcttgtgttcatgatcatcatgtaattcagtcaaattccaacataaaaaaaacttaaaaggacagttaaacagttcaaaagttcaatacctttgattcatgatcatcaactccaacataaacaagtgttcgctgcctttcttctttgctcccaaatgttaacttcgcaaaatcttcaacctacggaatgccagcacataagcaaagacaccaatgaaggaaacagcttgaatgagctgaataacagatccactaaccttttcagtctgtgtagcagaaaaaagaacagtctgcctaccctgcaaatgatgcataataaattgcaggataaatacagtattatgtcagtaaaaagttaaaggctgcatgatgcatatgaaatgaaattgccagacgggcagatagatggtcatatacctgccgaggaaggagtttaaatatttgtttcatttgttcctcaaaattttgctcaagtatacgatcagcttcatcaattataaggcactacaacattaagatgagttatgtcaaagacagtgaagagggcgagggggtcagtcacgacattcattatattggacagcaatttcatggcattctgtagcttcagccaaaactacctgtccatatggcaacggcaaaagtatcaactagatttgactccatgtaacacccataaacttggtgcaactaataacaaaacaacaagaaatctgcaacagagctaacaaggacttgacagtagaaaattatcacccgaaattttgccaatttgacccttttgagaacgtgccaaaaactttattgcaaaaatatacaaccacctcagggccagacctgatggctctgagttataacgccttagcgccacaaatgatggtgttgacctcttatccgaggtgagtgtttgccagatcaacgaagctcaatatatgcgcattggcactgagatctgtactagctaaaaggggtgaatgtcttctttgactgcaaggtgtgcttggtatagtggtggtgtcttattctcttatccaagaggtcatgggttcaagtctccatccaaaaaattaagagaatgaggacttgaacccatgacctcgtgggtaaaagcaataagggtatagtggtggtgtcttattctcttacccaagaggtcatgggttcaagtctccatccaaaaaattaagagaatgaggatttgaacccatgacctcttgggtaaaagcaagaggctccaccactgcattagccgcaccattatatcaaataaggcatgtgcttccttttagttagtagagagctcagtgccaatgctattgatgttgagctccaatgacctggcaaacgccatctccaaggttaacaccaatggcgctgagttagtgatccattttcgcaataagtttttcaaatgggtaaaattgtcaaaatgttggaacctatagaaagttgttttagacatgcctctagtcaaacatcaaaaacctttaccatctgtatctttttaaatatttaaccgggcacatgaaaattatacgtatggacttgtaatgaaacaacttccgcaaaagtacaattctatctgtctttacaaacataatacaatagaaattattgttaaaagttgcaatttggagacagtacgaattaatgttaaaaaatacagctttgcatatactcagcaaaatctattttgaaatttgatttatatactctaattcagtactaacaaacacactggacagaataaagggtagatgcaggcacacaatttatatacgaaataatcaggtgattgattatgcaaattgcgagagaaacatgaaaatgcagctcgtactttttaagcaataaggaaattttaatctgcaaactatttcaacagacaggtttagttccacattgtaaaggaaagtgtttctttacctttaggcattcatatttgaaacttttggttttttgcatatggtccagaagccttcctggcgttgcaactaatacattgatccctttcgcgagctgctcagcctcgcccctcaagtcaataccaccaattacatatccaagagtttgtgaatgatacctcattaattccttggcaacattgtgtgtctagagcaattgaatcaatgagacgcatgattaattatactgaaatacaaagatgagccactaacaatacataatctgaaccaaaatttagatacactacaaaatgctgccttttaaagtttaagaatttgctaataattggcaacagcaatgtgaaaagcagctttctgtgcattcttaaaaataccttgacatgaacataaattgccttaacaaagctagtacaatcttatctcattttacatgtacatccaatgttgattttttattttcactcacaagtcacaacaagttcaattgttgaacaggcataaaacatgtagtataaaatggatccaaaagaaatactgctgcatcatgcatgaaaaattttgtctgtcaggtaccaacaaacgccaaacaaatactagcaatgcgtatgaaaatgcacctggatagcgagctcccttgttgggcaaagcacgataactccggtcccgttcctcggcgagaagcgcagcctgcagagcagctcgatcgccgggatgaggaacgcaagcgtcttccctgagccggtcttggctgacgccatcacatcgcttcccaacatcagaggcggtatcgatctagcctgaatctgcaatcaatcaatcaatcatgaaaaaaaaaatgacacctcgttacatatctgtcgagcactgaaatccaacaatttttcaacaaaaagaagatggataactgtggaatttttagacgatggatggtgacctcggtgaggtgggtgtagttcatgtctctgatggcattggcggtgaggtcggagatggggagatccgagaagagcttgtccgtcagaatccctgatcccttcttcccctccccctgcttcttcttcctcttgctcttctcctccttcatcttcttgttgttgtgctccctcctcttccccgtcgcgttgttctctccctccgaattgcaggcggcggtgttgtgtaccggctccggttcagattccggcggagtagcggcggcggcggcggggcgcttccgcttcttggacgacggccggggcgagcgggcacagagtttgatcgggtgcattgcgtcgggaggaaggggagggaagcgaagcaagccgatcgggtagagtttttggggcttggacgacggggtgaggaggcggcggggcggcccggcgccgtggaggaggatgcttgcaggcgacggcgatgtggcggtggcggcagtccggccgtcgaggaaggcagtcgggtcgtgggctgggcagcgtcgcttgagcgggccaagaggattttcgtgagggataagtccactatgactccctcaattataggcccagtctggtttgtacccctcaaccacgctaccatatatcttgcccccttaattattattattaaaaaatcggtgcaaaataacttttccaatggttctgaaggtggtttatattgaaatgacgtgtacgtgccacattgacttattattcatcatctaacatggcactacaataataaaaataatacgtgggacccatagttttagtgactgtttcctcattttctcctctctttctctccacctcttagcgctctttctctctctatggtcgagacgatggtgaggaccggtaggaccaggatgtcgcctaccggtcgacgtgagaggtggtggccatgcgcgccgagatcagccaggcgaggaggagggagaggaaggcagcgacgatgccgaggacaacaagttcaagtgggggagggcgttcggcggctttggtaggccaggagttgggcatcggcgtggctcaaagcagagacgtctcccaacgagaaggtcaagcggctacgatggctgaggaggccaccgtcgccacttgggtcgtgagtggcgtgggctgatgttgttgtgctgcacgatagtgtcgtcatcggggaaggtattcagctgaggagggagctaacgagggtacaacggtggtgctagcggtggtcacagggtactgcatcgaagaggagatggatgttgggtgcaaccgcacacactctccttgctgagcgtggcactgctgctccccccctcaattaacacgatatgagatagaaactaatatcgatggtggcactggttgcctaacttcgccaccctctcatcatcatcctcgtttcccccaaccaccaccgcttggtcctccctgttgtcgtcctctcccaccaaccactggttgcctaactttgccatcctctcatcgtcatcctcgttttttagtcccgccttggctagctaaggtaaaggagaccatcctataagataaggtgtccggttgaaaaaaaatccggttaattgttttgcactgagcgaggatgaaagcacaaacaaattaatttaggggtgtggttcgactagatgagttctggcatctacagcctctagaatctctagctgcaagaagctcctcaaatagtccagattttcactcggatttgaagaaactgtagttgtacaatccagaaaataaactagaaagaagctgtagttgtagaatccagaaaatgaactagaagacagaaactaggtttcctagcttctctagataagctcccccaaacagggccttaagtcccgcctcaactagctatgctgagggagacaaaagcgcaaacaaataattcagaggcgtggttcaatttagatgagttgggcctaaatccgtatcacaccccagatgtttcgccgggcgccggaaataggaaaagaagctgtcactagggctgtcaatgagccgagctcgagcgagcttgcctgcctaggctcgagctcgatacaagctcgagccgagcctataaaatgttcgagctttcaaacaggctcgctttgagctcgatcaagctcgagctcgactaacgagctcgatttttaattagaacaatgtatatttcaaaggataatttttaaaaactatttaatttatggtttatcatattagtgtaagaggaaaaagaataaaataaacatatgatgccaatacaaggcatacaaataacatatttgatctaccgatttgttaaatagcaacataaaatcatatattactaggctcgttagaagctcgagctcggctcgacaaagctcgcgagctttgggacaggctcgggctcggctcgtttggagctcgaaccgagctcgaatcgagcttaggacgagtcgagctcgagcagctcgcgagcctcgagctttttttgacagccctagctgtcactaaccaatggggtccacatattattttattgtttttattattgtaacgccatgttagatgataaaaactaagtcaacgtgacagggagacgccatgccggtgaaaaccaccttcaaaaccacagagagtcattttctatttaacggagcgtggggctcctcaccgggagaccgcgcgggcccccctttgccggttcggccgggggcgctaggtgaggttctaagcactcgatctgtggaatgttttgcgagagagcaaatgcgcaagacacgggcgatgtagacaggttcgggccgctgagaagcgtaataccctactcctgtgttctggtggatctgtgtacgaaggagttacaaagagctggagagcaagagagttcaaactctagaaaccctcttcctctttctctcctctacgagctcaggtcttctcccccttctttccccaactccccccttcttaagtgggcaaggtcctccttttatatctcaaggggatcccacatgcaccacttctacctactcttcttttgggtggggactcaccctatcttcccaaaaaagaaaaaactggcttgccccttcgcctggaagctaaatcacagcttgtctttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtcacacactgtgacctgtcacggaccgaacgagtgtgctgcgctgcattaaatgcggcgtggggcgctcgtccaacccgaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgatactattggttttagtagttgagtgattaaactatctggtattatggttaagggatatgaattcgacctataattgaaggagtcaagatggactttttcctttttcgtgtagagaaaccgagaaaatcctaccggattgggcctccactatttattagcactagcccgtttacacattggagggacccatattcgttggacggggtttaaaccagcccaaatctaaagtattgataggagtaatctttcttgaaaagttattatgtaaaattatgtgagccatccgatttcccctctaaacaatatgaaaccgttagatccttgaactggtgaaatcttttcatggtactcgaagaaacttctttttacaagaaagtccttccacgtccctaagatagaaaaaaatcatgattccccggtaaaaaaatcgtgatggcgagacaacgtgcacttcccgtcctccccctcttcgccgcgtccctagtgttgtcggcctcttctctcacgccgccgcctccccatccctcctcccctcccttttctgcagcgccacctcttcctgatcccgtcgtcgccgtctcctagtccctggcaccggcaccgccaccatctactctccctccaccctcgtcctatccctcctagtttaaagtgaaaatgccaatatgacatcctgttataaaagaaatagtcattataacatttaaaatgtcaaacacattaaacatatttcaagccacgtcgccaatatactccctcattccctaaatgtttgatgccttgactttttttaaatatgtttgaccgttcgtcttattcaaattttttttgtaaaatatgtaaaactatatgtatacattaaaatatatttaacaataaattaaatgataggaaaaaaaataataattacttacatttttcgaataagatgaacggttaaatattttaaaaaaagtcaacagcgtcaaacattttagaatggagagagtatttcagtctatgcatcaacttgtccccataggtcttacacaaagtcacaaacaaccaacagggcctagatagcatcttcaagaggtgactaaaattagagtccaaaaatcttttattctctaatgattttacagttagtattaattaagtagatatcccactccactacacggggttacattgaatactgatagaacccacaaagatcttagcccaattacaatcattgtacctgcaaattaggagcgcagtttcacttaattttactgcgacgatacaacagaaacgactaccgaatcagacaggcggcagcacagcggccgacgccgccgccgcggccgccacggacttgcgcggcgggagcacgcggcggcagagcgggcaagtccggcggacgcgcagccacacgtcgacgcagtcctcgtggaacaggtgcccgcacgccggcagccgccgcaccatctcgccgccgcgcaagtcctccaggcacaccgcgcacagcacgccgccgccgccgccgccgggctcgtacgcgaacgccggcagcacgccgatcccccccgcgccgggcgccatcagcccgcacgcgcacgggcagctcagcagccgccgccgccgccccgacgccgccgccgcggcggagcctcctcccgtcgtctgcgccagcctgccggcgagcgccagcaggaggagcgcgaccgcgacggcgacggcgcccgccacggtggcgctcacggcgtaggcgatggagcagtacagccccatcaggacgttcaccgccatgaagccgtagcaccctagcctcgtcgagcagccatcaccgccttcctcctccgccgccgccgcctcgggcatcccgaccagcgatttctccgatgatttgaactgatttatttcgtgccaaattcctacgaaatgctacgaaattttcgaaatgcagcgacgacgccgaatacaagaaacactaggaaatgagtagctagcacacgatctgcatgaacatagctggcggattacaccagcagcgtcacgctctcgacgtgggcgacgagttccagacgtgtcaagcacgtccgttgctgttaccgtaccattttaagtacgtacacctgtccaaatcggttgcgtttgcatcaatcacaaagttagtagagtatattaatttgagagtttgtagagatttctgtattgtcctatgccggctaaattccaaatagccggtttggtcacaatcttatggaatcttggttgattattatgtcctgttgatcccgaaaataatgggttacagaacacggttacagggcacacttttctggtttggaaatgctaattagttagtataccaagtggtagaacattcggaattaatgtacagtgacgcagtaataacaacactaggtgatgttagtagtgaacaccaagcaaggtgaattagcgtttcacaccggcggcagcacgtcggtggaggagaccgtcgcggcggcggcggaggatttcgcggtgaccttctccggcgagaggtcgcggcggcagagcgggcaagtccggtgcgcgtgcagccacatgtcgatgcagtccacgtggaagaggtgcccgcacgacggcagccgccgcaccgtctcgccggccacgacgtcctccaggcacaccgcacacagcgcgccgccgccgcgcggcttgccctcgccgccgtcctcgacgtcggcggcggggggctcgtacgcgaacgcgggcagcgcgtcgatggcctgggcggcgagcccgcacgacgcgcaccggcgcacctgcagccgcaccgccggcgccgcgcgggcgctaccgccgccgccgccggcgttccccgcgtagagctcgggggccagcgcgacggcgaaggcgtccgtgggcgcgagccagccggcgaggccgagcagcaggacgagcaccccggtggcggcgaaggccctggcgacgccgacggcggagacgagcgcgcacagcagcagcagcgacacgcacgccaccacgatgccgtagcaggcgcgcgcctcgccgtcgcccggcggtgcggcgggccccgccgccgccgacggcgcaggccgcaccgccctcagcatggccgccaatcttgccgtcctcctcctcctcgcgatcgctagcactagccccaccaatccaccatgcgcgagcagcagcaaagcgttccaagaatccgcgggcgaggggtggaatggtgaatggaatggtggatgcggatggtggcggcggggcgcgcggcgtgtttatctcgttgggattgggaggcgtcgccatcgatgggactcggctgctggttggtggacctacttgcctttctcgctcgcttgtttcagttggatagacttggcaggcacgcacgcccacactcctcgtacgctcaaaatatcaggcgattcgcgatatttttgtcaccgtggccttttgtgttgtgggatcacgcagcacaggctgtttattactagaacacaggaattttatagtgtgtttatatagtttagttttgtttgttcgtaaccttgtaaattgtttcttggatccgaaaagcttttacatgattttcgtataaatcgtaataattcatacattcaataggtggttcaaaataaagtatttttttgggctgttctgctacaattaacggcacaaccacgtagccggttactacttattacttgctacataagtcaaatttgttagaggctgcgaaacaacaccgtaggcagctgaacaactccttcattcgcatagagatagtttttttttacttattatcctcttggatagcatactccaacaaattaaggggaaaatgactacctgattttttttaagttttatcacattttaaccgccaactcaataaattgaggggaaaatgacattgcggctcctttcgtcttttttttcttccccttcatctatatgtgaccatgtctccgtgatgtgtggcgatagcggtggcgaaaagaataggccagcgagcgtggcagagaagaggggtagtgggtgcttgtgtagttgtatgggcgcacagatggcggtgaggacgacaagagcgcagaggtgatcactactcatatgtaaggcaaggcaaccctacaccactcatattatatataaaccttataggttatagtcttatttcttttactatatttaatgaaactattcatggtctaaatgctggtttgtaaaaaaaaagaatggcaatagctaccaagtgtctaaatgtgtgtgtttgtttataatgatcatttctacgcgtgacgaaatagtttagactcagttcggctcagtatttggttgtggctattcacggctcaaaaaatggagcggattattagctcatggttaataagtattaactatcataaatttgaaaaatatttttttcatttttctgaaaaaaacttctatacagatttatttttaataaaacatgcagtttattgatttgagaagcatggtaaatccagccatatatttagaaaattttatttcccgcattttacttcacttgtaaattaatgaacatttaatataattctaacaataatttattaaataatttataaatcctgaaccaaaaatcaggattaagttgtacaaagagggtattttttataaaaccacagctattatagtttaagttgtacaaaaccaaaaaccacatagatttaggcatatggcacataagcctagatattttggtcataaaattttcacaaaactacactattgatcattttgatatggcaaattttgttataggatactcaaaatttgtgcaatttgcagatagacatcgaaaaaatgtgttacagctaaaagacactctaaacaactgataatttgctagaggatactctcgactcaattgaagaaataaattcttaagaaatacgagaatgaccttaggaccacatgcttcagacatggcattagagtaaaagtttagaaattatgcaactgtaaatttacaatcaacataagtaaatcactagcataaatcatatttcaccttcactctattctcagctcaaaagtttttgaccctaggggattcttgtctttttgaagaatttctctctctaattgaactgaaaaaaatcttccagcaaattaccagttttttaaagtgtctttcagtcatgacatattttaacgatgcctaccagcaaattacacaaattttaaatttcctgtagcaaattttatcttttgattaggagtatgtcaaaatggtcaatggtagggttttgagaaattttaaaaccataatcccttgagttatgttccacatgccaaaatctccgtggttttgtgctatttagatcataatagtagagttttatacaatttaataaaagaaaattatccctataggatggattagagagtactaattgtcttattaatcgcatccatttaaatttgttcaaatcttataacaaccaccgttactctttacattgataaagaagattataacttttttctctatcactaattttttctcctacaacatatattatttttatatatggggatggagggagtaaccaccttagtctttatttaattttccgcacaaaacttttgtagattccaatgttttatccacaggattttcttcacactggtggagaaaccatctttggtcggtcggcccaattccacaatagtcccggttccaataaaaaccgggactaaaaagcatctttagtcccggtttaaaaacttaggggtattttttgatctttagtctcggttggtaacaccaaccgggactaaagatcatttttactcccggttgaagaggttgtcaggtcgtgtcaggccccaattatttttagtctcggttggtataaacaaccgggactaaagatccatctttagtcccggttgtttagaacaaccgggactaaaaatcaccccaagccgagcgcgatgtttatctcttcgcgtgtccattgtctg

SEQ ID NO: 40771 - DNA, 26463 bp, Oryza sativa
gccgcgcggaggcggcagctgcggtgggcagccgatcagcggcgaccggcgcggcgccggccggcaggcgcggaggggaggcggcagtggccgccggccggattttttttcttttttttgagatgtgaatctgtgatgtatttttgtgtgagatgtgaatctgtgatgaattttttagaatcttgtgatgtaatttttttaagagtttgtgatatatttggagatgatttgtttgaggatttggagatgttctgtaatatgtaatgatttggatatgggatgggattgtgtgaaatcaatattcaatattaaaggcagaaaaaaaaaaaaaaatatctttcgtcccggttggtgttatcaaccgggactaaagatgctcccatctttagtccggttggtaacaccaaccgggactaaagattgatttttagtcccggttatttgaaccgggactaaagatagcgatctttagtcccggattcgtagtcccggttagaaaaccgggactacaggggggttatgaaccgggactagaaagcatttctccaccagtgtcaagatcagttcctgcaattgctcaattgtgcaatccataattaatagaccctgttgtatgaaaaatgtcagacagcaatgtaaagcggctctgttggacagctagcctagtattgtcgacttagcaaaacatgataccataagggccccatcagtaaccgaaccgtaaatcctcatttcgatttgaagcttacatcactaagggcctcatcgtacggcacatttgcaaacgaaaaataatttgtgaataaaatttttatacacgtgttcttaacgacctaaaaacaaaggctgaaaaataaacttcgatgaaaaaacctaaaatctttaaggctgaaaatttaaattttagctaataaatatagcgaaaagatgagtccgtaaaacaatatgaaatgcttagcatttagttataaggacagtgttttcatccatgagaccatgattggtacaaaggttgggagttcatcagttccgttatccaaaacatatcagcgagcacagatcgagcaaagatggccttggaattctttcggtcatctcactgctacagcgccaattttcccgtgcgggcgacaccctagcaccggttcttaatttttctgtgcgattccacttacaaaccgcacggaaataaaaaggggaggcgtccagaaaaatcaatcgtatagtagtgtcaccagcttgggtcttatgtacagttgaattctgtaagactgtaaccaaaagaacgaaccattgtgtgagctgttaaaatattagccggtctagttgcatgctggaaacctacctcactcatttgtttcacttaccgcactgtcatgatgcatgtatggcagcgcaagacctaactcaagacattatacaatgcacacatgtggataatgaaaaggacattacacagtgcacatttgtatgcacacttgccaaaatagactccactagaaaaaggtaaaatccaattttagcccttgtactttgctagaagctcattttctacggaactatgaagtcggttattttttaccctcaatgtaaaaccgaaagaaaaccttaagatatatttttattggtttgtccgaaatggaggtgattttgttagttgatactcttattcgcatattttgccgatgagtgactctgtgactgaacgtgcatctttactatgggatttgaaggtttatttatcttgacctcctcctattattttatcacatagcaaacgcacacgtattatatttgcgcaccactgtgctcgcacgctcgtgaatgcgtcccgcacacacaaaacttccaactcacgcattcacaaatgtgtctgctaatacacgttcaaagagatgaaaatcaaccgtgtatttctgatcttgctaattcctattaaaaagttatttgcatgtgtgtaataatctcgttgggtgaaattatgcagtggtgctgcttcccgacctctttctttttccgctcctaaagctccttcacctgacacggcccattgcaaactgtcagcagatatctatggacaatttcgttcttatccttgctttgatgtccaatattgattttgtcactgctttttagggttttcgtttttgtccctgtttttttaaatgaagtagatatctacccctgtttttgacagaagttagtggaccttgaattattgagctaaaaaaaataagaaaaagagggaatattgattatgtatttttttggttgacctttgtcctcctagggagagaagaaaggaagggagccaggctccgacgccattaccctcccaatcaattttctccaaccctaggggacctaggcggtgacggtgagtcggcgacggcggcggcgatcttgccggcggcaactagcagccacctccttccctggcgaggcagtggggagtaggcggtggcggcagcttcactagcaggcgaagcaagcggccactagcaggcgaagcaagcggccacgacgatgacccgatgtggggaggaggcggtggctactctgccaggtggtagggaggggtcttcgccgtggtaaggatggatcttggtggcggcgacaatgggaaagggtcttggcggcggcgacggggaggggtcttggcagcggcggggacgggaaggggtcttggaggcggcggtgggggagcaggaggccgcgacatcgtgccaacaagtagagcgcagagacggtgcaaggcgacgatgagttggcacaagggaggtgaacacgatggcgagcagtgtcgactaggcactaagacttgatttgcttgactttgagcacttggcatgggaggagcaagaggatgtaggattggatttacttcactttgtgattggaattttttgactttgtgatgctttgctatacttccgcttgttgtgttaagaatgtgtgaaacttgtgccattctatcttttttttttgtcaaaatgtgtccaattttttggcaaaattatgtgaaattttgaagcaaaattttgcccagtctggcaaaattgtcatacttgtgaaagtttatcagaattgcgagctgataaatagtaacaaatacacaattcatataaaaaatagtgtcaaatgtgtaatatatagcaagtaaggtaaggatgtctttttgtcaaagatttaacaccgttaagatacccatccaaaacaggggtaaattttggtttcgattcagaaaaacaaagggtaaaaagaaaaccgtaaaaaacaggggcaaaatcaatattgaacatcaaagcagggtaagaacgaaattgccccagagtacagcacaagttgcatgcattttctgcaatctattctctgtgttctctaactcaactttttatgtgcatctttttgcagatgcccatgttttagatgaagatatttcgagagtttcttcaagtgcttagttgtacgttcaccatatatgccaatctgaaacgaagacgctgattcattcttttttaatttccatgtctcttttcatagaattgaaagctcaaaattgaaaattttggattgatttttcacctgaaaattccaactgaaatggtcttggtatagtcgtacctataaatagcaaaacacgctgatttgttgagttacatatgcataattgtaaattggtcaattaatggacagttacaaacatctcgatcatttaatttgccataatacgtacgttctaatgattgtgtcaggttctggactgggcctcagaaaaaacgagctgaaaacgcaggcccaagctatgggcatcagcccggcctggtagactgtgagctggattgggctgggctgagtttgaacaggtagagaggtggacacaatgtagcaagggctgaaaatgattgcttagtgttttgggtagggtttatcttttccttttgcaaatgaaaaccgcatctcaccggcttaaaataagtgataaaaatgaacgatgttaatccaatgaaatttctccataaatcttttgatttaaaggggcccttaatgttgagaacccctgcttggcaggactttgtcatttccgttctatcaaaatacacacattcttcgtgtcaagacaatgtgatcaaggagcaaatctaagcccacaagctatacaagagacatacacaaaaaaaaaaaaggaagaaagaatcaaattgcctgtcaagctatagccttatcctggcgtctcttctgcagcctcgttattaatgtggcaccggcgacggcgacttggaccgcgaaccaccaccttcccttgacagcgccaccacctgcgttggcgccgacgccgacgccgacgtggttgcacctgcatccaccccttccaccacgccgacgcctctcgccgccgccgccgtcgtcgtctgcagactcagaccacctatcggtggcgacgacggcgacggcgacttcgaccgcacaaccacaaccggcgtcggcgagctcggccaccgctcgttcaggctgtggtacgccgtcggagacggcgaacgtgaggcctgcacgtagttgatgatcgccgcttgaaccggtgacgacggcgacttcgacgacgtcgacgtgatcggtccgccggtggtggtggtcgtcgtcgtcgaggtggtgttgcccctcaatggagaacgtgccaggatgtccgccagggcgcgcgacgccgccgtgggccgctccggcgacaggccgcaccggcgcagctgcggcagcggcggcgacacggccacgacgtcgctgagccgcacgccgtcgggctccgggtgcgcgcggcacaccgggcacgtggagtgggcgcgcagccagaggtcgatgcagccgccgtggaagaagtgcctgcacgccggcagcacgcgcaccacgtcgccgtcggcgagctcctgcaggcacaccacgcactccaccaccaccgtcgtcgcccccttccccttgccgctgccgccgcccctcctcccgccgccgccgaccagcggcgacgccgccgccccgcgcgcccggtacgtgaacgtggggagcgcgtcgatgtcgtccgagctcagcccgagcagcgcggcgcgcggctcgccgccgccgccgccggcctgcagctggcgccactccgacatcaccgaccggccgtaccggatcgccatgtacaggatcacgccgacgaggacggcgatgatgatgtacagcagcgtgaagttggagctcgccgtccccggcacggccgagccgccatcgccaccaccggagctcggatcagacggcggcgaggacatggcggcgaccaagaacaccacccggtttcaaggacatggcaatggtaaacaaaagcaatatcgatcaatcaaaaccaaaccgaaccaaccattcgatcgatcgaggagaagagggtggttgtgcgagatcgatcgaggcatgcatgcttcgcgcatgatagggttttttcagttgggtcgctagctaagctaagctaagctgggcttggatgatctatcgagacatgatgagacgccacgccatggagtattagtatttgattggttagaaggattattatatttttttaggacatcgttttgtgataatttcgtgttggattgggttgctgggtagtggtattgtttaaataaatttcatctattagattatctggtcatgcttgaattcaaatcattcggtggtgattttgtgcattttgttagtcatggttgattggtgactttatcattgtgaaattgcgagttgcttgacatatgctggtgaatgcctggatagggatcaaatataaggctgcggtcaacttcgcaaccaacagatgcacgtatcattttgtaaaatatattttgggacaattaagacagtgacatcatcgagaactggaaatactaaaaacatttgcaattagaacatcctaggcactagaggagtaacgttgaaaataatcaaatatggacaatattccatataaaattttccagaaaagcataaatattctggcccactaccccaaccatgtctaggagcctaggataggacttaagataggatggcagcaacgaagcagagacagcaagattacgagtgcattagggcatccacaatgtacactgaaagtaaccttagacattaaatactgctacagtacaacgcatttagcattgtggagtcagaccacaagtccgatgcaaccaaagtacaccttaagcttaaggtgtagcaacaaagctataaaatacaatacttttactgtttttctgtgcacaccaataaaatatacatgtcagttactaaacatagtaacgagtactactagccgttgctgctattccatttgagttgctcatttggtcccctagccgttgtcttcctccagcattcttctgctgcctacaaaaggaggaacaagtgagatgaacaacaatttttgatctattcagttttcccacatactaaatggagcctttcaaaggaaacttctcaaacctcctcaaccaaggttcctcaagccaagcaacaaatagtgaggcccaaaactccctttctacccaatttcccacaagttatccccaaaacttcagacctagttttctccaaaatttccatccttttggtcctccaagcaactaccagccatatcgacaccctccaatctttcaaggtgctcagcaacaagaatattatgggcaacctactccaggaagcttggaaggttttcaacttcaagaaaatctggtgcactcatctaaccaagcatttggatttgcagccaatagatcacagtttggtatgcaatatagtacttcaattagggctacagccaacacttcttctcatggatcagcttctccatgtcatacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatgcctagcaatgggaacaaaaggaaccccaagcaatgcagaacacattgggacaatgtcaagagagatgtcactaagttctgtggattttattctaaagctagaactactttcacaagtgggtattctgatgatatgataatggagaaagcccgtgaatggtacaaaaagcacaacaaccaaaaacctttcaccttggagtatatgtggaaagatcttaaagatcaacctaaatggcgtagagtccttgaagagagtagccataataagaggagcaagatttctgaatcaggagcatatacttcatcgtcgaaccaagacacagaggaggaaacagagcgcaaagagaagcgccctgaggggcagaaggcagcaaaacagaggcaaaaaggaaaaggtgcaccatcacctttaggggataagccaagtcaaaatatggttctctttcacgaagctattacaactaaagcagcagcattgctaaaggcagcagaagcaacactgattggagcagaagcaaaaaaagagaaggcgattgcaaaaaaaagagaaggcaagggcagaaaaataccaaatgtatttaaaactgatggagaaggatacatcaacctccagtgaagcaaaactgaagagacatgaaaatgtattggaccaattagctagagaacttgctgaggaataaatgactagcaagcaatgttagcaattatgcttattttataatgtcagtattcttgtcatatattaaaattatgtactgtgttgatgcttgtactgtgaacctatttgtattgtactatgttatggtaatttgtataaatattgtgtattacagctatggaatgaaactacaatatccttagtacttgagaaatcaccttttcacatggatctagttggtgttgatggtttttcttccatccatgaccaatctgtttttttttctccacctgaatacatatgagcaataattaatagagaacaaaagcaagagggatgttgacaaaacctaggaaaatatagctgttgtaaaagactgacaaaagcaagagctagctgttaggatattgacaaaacccaggaaaatatagctgttgtaaaaatctgacaaatctagtcgttgtaaaatgtatcatctacaaataggtaatgtagttcagcagaacaacacccattctcattttgttcaacttcatctcaacagccttcccactttcaaaaaaaaaaatgtccagcaagtcaccacatcaatctagtgagtcagatgattctagctctagtgactaccttgaagagctgattttggaagaaatcaatgatcctatggaagctgagattgaagatgagattgaagctcaacttcaagctcaaatgcaagcacaacaaactggtcattctaatcgtcgtgggggctacaaacgaaggtacatcaatagagattaccaagacgaccacaacagattgtttgcaaaatactattccgacaatcctttatataccgatgatcagttccgtagaagatttcgcatgagaaagcatctatttttgcacattgttgaagctcttggcatttggtctccatattttcgtttgcgaagagatgcatttggcaaggttggtctatcaccgttgcaaaaatgcacagctgccatacgcatgttggcatatggtacaccagctgaccttatggatgaaacttttggggttgcagaaagcacagcaatggaatgcatgataaattttgttcaaggtgttagacatatatttggtcagcaataccttcgcaagcctaatgaacaagatatccagtgtttacttcaacaaggagaggctcatgggttccctggcatattgggtagtcttgactgcatgcattgggagtggcaaaattgcccggttgcatggaagggacaattcacacgtggtgattatggtgtacccactatcatgcttgaagcagttgcatctgctgacctatggttttggcatgcatttttcggtgctgctggttcaaacaatgatatcaatgtgttggatcagtcaccattgtttactgcagtgctacaaggaagagctcctagtgttcaatttactgtcaatgggacagaatataacatgggatactatttagctgataatatttatccagagtgggctgcatttgccaaatcaattactagacctcaaagtgacaaggctaaattgtatgcacaacgccaagaatcagcaaggaaagatgtggaacgagcatttggggttttgcaaaaacgttgggccataattcgccacccagcacggctttgggaaagggatgaactagctgatatcatgtatgcatgtattattttgcacaacatgatagttgaggataagagagacgattatgacatacctgatgacaacacatatgagcaatcacaatcttctgtacaactagcaggactcgaccatgggccaatccatggatttgcagaggtcctagacgcagacatgaatattcgcgatcgaacaacccatcgacgtctaaagtcagatttgatggagcacatttggcagaaatatggtggtcaacaacaacaaaactagagtttatttgtgttatgaaacttgtgttcttttttccatttttctttcagtcgtccaatttattcttattagtaactgagactctttactttttcatgcactaagagtaatgtaccagtaccattgccttaattagtcaagcacaagtcatattgaaaatatcatgtttttttggtcattttttttaatttcagatctgttggagcacaactaaacactctatgaaaattccatcgggatcgaaatcaacgattcacatgatgcatacgtacaaacagaaaaagaatctgtagtagcagcacttgcacatatttgatgacaaatttaatcgtagcagcagcagcacttgcacaaacagatataaatttaatcaccgggcaaaccaaaagcaagaagagattccacaacacggaaaaggagaggccacggaatcaatcaccttgtctctaacgcagaactcacggacgatgtaggcgaagttgagggcggtgaccgtctagtaggtgctgatggttgagagcagcttcaagtttgtggcgcagacgagacagagaagcacgcgtcggcagcgtcgcggccggagtagttcgcgcacgcagcgtcatcgatgggtgaggccgcgcacggcaacgtggcaccgaagccacggcacagcgaggtcacagccgaaggaggggaggccgggaggagcagcgacgttggcgcagccacgggaggagcaatcgtcggagaaattggggatccagtgcatgcgctgtgggagaatttggggatcgagcggagcgacgaagagaggaattggggatctgaggcggaggaaatggggatcgaacagagtaacagtggatgaggattttttttcactcgcgcgaacaagcagatggttaggagtgatctgtattctttttctcccgtggggcccagcgggacccaccttatttccatcaaacaaacagtatcattgtagagatttccttaataactattgctacctgtagatgggcccactcttgttatgcattttaccatatacattggccttgcccttagaatagcggacaaagtagtacacatacaggacaatcattattactctatcataggctaaagcagtcttatctaatgtttgcctaatcaggaagagggcccgaatatcattttacccatgtgcttagggctgtcaacgagccgagagcgagcgagctcgcctgcctaggtttttaaagtagaacaatgcatatttcaaggataatctttaaaacataattagtttcttgttcatcgtattaatagcagaggaaaaaagaataaaataaataataataccaatacaagatatacaaataacatatttgatatcctaattaattaaataataacaaaaatcatatattactagctaggctcgttagaagctcgatctcagctcgacaaagctcacgagctttgggagaggctcaggctcagctcgtttggagctcgagccgagctcgaatcgagcctaggacaagttgagctcgaacagcttgccagcctcgagctttttttgacagtctcctatgtatattagaagcaaatgccaatttactttaaaaaagcataaagtatttaaaggactcgttttctacaagatatggtgacgtggattttatcaaattgtagtttttagttttgcaatatatatatggtttgtatatttttagtgagcatattctcgaactgataaatgttacgattttttaaaataaaatatctttttaaaattaaataaatatattttctaagtttataataattaataattaattaattatatcctaatggttcatctggttttacgtgcaatggaaaagctcctcacatttgaacgcagcctggttcatgacatttaatttaggctttgtttagttcccaaaacaaaaattttcacgctgccacattgaatgtttggacacatgcatggaatattaaatgtaggaaaaaaatcaattacgcagattgcgtgtaaattgcgagacaaatcttttaagcctaattacgccataatttgccaatgtggtgctacagtaaacatttgctaatgacggattaattaggcttaataaattcatctcgcagtttcttggcgaaatctataatttgttttgttattagactacgtttaatacttcaaatatgtgtccgtatattcgatgtaacaataaaacctaaaaattttgcctaactaaacaaggccttagactatcttggtcctccaagctagtttgcccttggcgcaaagtggccctggggcacatctaaagtgccatctttgcaaggcaaccgtatgccaactttgatggtgaactctctttgagaaaacaactatgctccctgatcagctagtagtaaaaaagagtgaaaagccggtttgacttacctcatcatgctagcccacccaccatatatccactccatgcattcacttgtgctatgtggtttgactcaggtgaaggtaaatgggggcaaacattccatatatcgatggaaataaaagaacatataaatttagtttatttcataaattaatcataacattaaacttgtaaatactagtagaaccacatcatacgatctaagtatgtaaactagatagtaaaacatgaacatatcaaataggcgaaacatgatgaatacgtaccgaggaccgtggttgtgctgtgaatcaggttgacgaggagtagcacgcaccgcaggaacaacacacggtgttagatgttgtcattggtgcgcatctagagcatagaggaagacaagccgttatggaagactagtgagctgtcgtgcgaagcgcttgctaaaaacgccgccttctctcggtgtaggaggtcgaaggcgaaggttccgaaaactagctctaccgatagtcggtgcatgtcagcaagcaggacggaatagactacgagcgacaatgcaacatagaggaggaagaaaatcctagattgcttttcactgtcttgaaaggagacgatggcttggtttatatagagataacaggatacgtgatcaagatgcctgcacgatctccacaacgtgtaatcaaactggataagttgtgcataacctatacggactccactccactccacgcactggattatttggtgtgtttcaaaaaacaaacaccgaattttgcagcgaaacaaaactgcaaaagacatatcgaattttgctggaaaacaaaattgcaaaaggaaaccgtgtccgcccaaggattaggagccaattttgatgaatcattcacacacttatcatgtacatgcaccgccagacgaggtgaggtgaacaagcgcgtgtgtttctttagttctttccaccacacatgtctcaagtggttagaagagcactgttctttttaagaatgtctcctcttataatactgtcgaggagtaaccctctctagcaggaggacgtgagaccctcccctttgtgagtttggccaggggataaggcacgagtgatcaagagctgaccttagctgaggatttggttatggtggtcgaaagtgatcgggagtgaggccagagattatacaggctcgggccgctcggaagcgtaataccctactactgtgtgtgtggaactatgctcgagttcttacaagaaatcttgggctctaggaaaacctaactgtgcttcccctagagttcaagttctcgaaagtcgtcgtctttgctcggcgggtaaggtcctccttttataattcaaggggataccacatgcaccgcctctattcgtctcacccttcctggagaggggtctctcttccttgggttctggtcccgctcatgccttagaccaaaagcaacatggccgtttgctccgaggtgggtcccaacgccgtctcccatctgacatgggggacatcccctgtcattccctcattaagccttgaagacttttgtgggctcatgataccgggagcgcactggacgtgcgtgctgagccctaatggctgatgggacggggcatacttgcccccacgctgcctgacacagggcggggcgtgggtgcgctgccacccgtcccatccatctgtcaccggtcacagactggtccaagcgattgacgcacgtcaatcccttgggtggcgtcgcacgaccaaccatgccgcattgcgtgggtggttgggacgctgtccgtaaacgtgccagtggcgccccctcctccgcccgcccagccgccacatggcagctgagcgggggccttggggtggcgcaacccttcgggcccgaggggtgcgacgggataccccgaggcccctaggtggatgcggggcgcctctcggctacttacaggtggctaggggaaagggctcctccactccttccccctaacatgggtatcccgggtccatatcaccgacaaatactaaacatcctcatgcatatcttcttatgaagtgggattttgtgtttttcttataattaatctctgaatggaacttggcccatccattaattcaagatatataaggtgtttaatatcgttctaagttaaacttaattaagttttttgaagttgataaaaaaacataccaatatatataatattaaattaatttcgttaaatttactgttgaatacattgaatatgtgtttaattatttgctttgggttgaaaatggtatcattttctaatagaaatttgataaaatctaaataagtttgatttaaaacaaacctaaaacacttttacaatacgaaacacagcaattagaacataaaaaataatatggagcgaaaaaagactctaaaggagaagattctaagaagccaacttgtaagaatctaaaaacgctgaattttctaggttctgacatactccctctgttccaaaaataccccaatcctagatttaaaccttgacacacatattgatttttcttttgggacggattgggggaattctatcagctggaaattctgtgagaaactattgctgccaaaagctttctaaacatgctcaaaaccttgctgaacttgagggatcaaatttgttatttctttcgtttttatagacatgtaccatattgtcataattcctcctttttaatgatgatgcagcatgtgcttgagagaaaaaaaatattgctgaaatgaaaataagccttttttagcgcatcgtcgaaatgggttgataacctaaaatgtctgttctaaaaaaaacataaaatgtcttgtaaataaagtcaaagggtaggctacatgacaagtcagtctgttctgacaaatgtccacttgcgtaccaaataagcagtcaagtataggaaagaatcaagttgtcacgatcaccttcggcagcatgaacaccaaacaaacaagagtagaaaaaaaatgaatttttgtattatttctaacctcttatatcagcgtcaaattggtgaatgcacatttgagccaatcggctcatttgcttagatgaatttcgtggttataaacatcttaataactgaaaagtcaataatgtgacatcctcttgcgaaagcgtaaattagtacgcttccgtcattccgtgtactctacacttcgaccacgtgcaaatcggtcgtcgccgtcgtcgtcacgggagacggtgaccttgacacccgcgccacacgctccggagtccacgggcgagtcggcgacggcgacattgccggactacgggcggcggcgtcaatggcggcggccgcgaggtcgaaacgcgtgctcgatcttatcggggatggcgacctcgacgcggctgcggaggagtcatcgtcgttggctctcgacgtatcggcagcggcggcggcggcggcctccttgggcggcgacggcgcgcaccggcgcagctgcggcagcggcggtgagagggacgcgaggccgaggcggaccttctcctgccctgggctcccccggcacaccgggcacgtggcccgcgacagcagccaaacgtcgacgcaggtggcgtggaagtagtgcttgcacgacggcagcatgcgcacgacggcgccctcgccgagctcgtcgaggcagacggcgcagcagtccgccgccgccttcgcgtccccgcgtccgatcaggccgcatcggccgggcgaggcggtggcggcggcgtggtacgtgaacgtcgggagcacggagacgtcgtcggggccgaggccgaggccgcgctgctgctgctgcccctggagcgcggtgaccgcgtcgggcgccgcgccgggggcggcgtgacgggcggacgaacgggtgtagaagatgacggccaggacgacgatgccgacgatggcgacgaatgcgccgatgcccgtgtactgcagcgtcgacgacgccgagtcgccgggcatggcctgatcgatggccggcggcgtgcctcggagtcagagacgtcgcgtcggcgccggcggagagcggccgcgatgtggcacgcaggggacgtggcgggaaagtggtgggggggggggggggggtttggttgcgcgcgctatatggaggttgggcgcagcatgatttgtgtttgggattcgcgtgcggtggcgatcgagttccgaattgggaggatggcatggcaagcacgtagtgtatagagtggaagtgcgggaacgcggcattttgattctgttgaagtgttggctctagcatttcaaacagaccaaaaaaaaatataatcacttaaaaaactcttgcagaattctttctggcagaatcatttgattgaggttgttggaagttatagaaaagctagattcaagcgtactagtatggtaaaaagtttgtaataacaatttttgtgtacggtgtgtagcttttacattgtatttttagagaggtgtcagagcatcaccaagatattgacagtaattaattttcaaaactattttttttctcctaaactgaatataggaagtgagaaaactaatcttcctaaaattgatttcctacaatgaaaagtggaccctccctttaacaaattagttcttctactcatcctcccgatctcctccccaaaacgcacatcgcgcctggccagctcctcctttatcttgcgattttttctccatgtgcgcatgagagagcggttgggaaaaaaaatcgctcccttaaagtggagaatgagttggatatgatttttgaccaaaacttccttaatttgaggatatgaaatagaataaggaaataatgaaactgttggtcatgctcttacctcaaaaactgatgaaccgaaaatcttgtcttcgcaccagaaaatagtaattcctctccttcatattaaatgtcgtttgatttttttatcaatcaaaattttttagtttgatcaaatttatagaaaaaattagtaacatttatcacaccaaattaggttcattaaattcaacactaaatatattttgataatatatttgttttatattaaaaatagtaatatatttgtttataaacttggtcaaatttaaagaaatttgactaaaaaaatgttaaatgacttataatataaaaatcttcagatagtacgacgtataccacaaggtaaagaaatttgttggaaaaataccattcccgtaacttttgacggttacaaggacaagtggaccaaaaccgtacgtcacggttcgccgttgtcacccaaaggaaaagtggcagaacggaagagatggaaaatgggaaatgaagctgcctccagagtggctaggtgaagtggttacggaaaatcagaatatcacctgctgcagttcaaaccaaatgaaccatgacagccaaaggtggcgggagtgataattttcaaacaaatgtttcgacctatgctatgccaaaggcaaaagacatttcccttcggtacacaagacaatagcatggtagcagttgaatttttctgttccttgtagcctgagcttggccaaaatgggaaaaatgagtatctctagtagtggtggataaatagggggcacgacatggcgcaacccagaccggccttgccatgccgagccacgtgttaatgcctcggctcaggcacgacccagtgaggtaccaaggcgtgccgtgccatgttggcacgggcacataataggcacgtgggcggttcttagaaataagcaacaagatctccattcttggttgtgttgtgcatcctctttagcttagttcccagtctttgatactctctctcttccagtatataagcatttttagagttggacacagttattaagaaagtaggtagaagtgaatggtggagggttctaattagttgagtagtggaggtaggtgggaaaagtgtatggtagagagttatgattggttgggaagaaaatattggtggagaagttgttatattttgggacaaatcttgagagataaaagttgttatattttgggatcccataatataagcatttttagagttggacacagttattttgggacggagggagtagcattttcactacttcacaatgtagatatgttctggtgtcttcaatggttcatccacattgattgaagggcgacttagatgacggtagatatggtcatcatagtactatatatattttcttaaggtcacttttccatatcaatatgctgaagtcttgtgcttcgtggcagggtttaccttatcgcgtgcggttaccgcgcttatcaccggggcacggtaatggtttaccgctgtatggtttagatgaaatttgagcaaattgaaaattcccaaaaaaatcgaaaaactcatggatgtagttcttgatttgtagtggcatatgtttaagaaaatttttcaaagagggcaaaaccaaaaataattaagaaatttgaaaaaagaaaaaatgtattggaattagggcaaatacattgtgaacgattggtgtttgttgagatatgaatatttgtgaaataggtgaaatatggtttgctagtgatgtcgaaaatcagggacggagctagaacgaaatggaggaggttgcctcttgcttaatttaatctactttagatcaagtttaagctgatgcgtgtacctaagtttgtattgaggggtgcacacatagtgaaaatcggtgagttataactaaaaatttcttgaccaggttcctgggcacctcctcccatactctacctccgtccctgcggaaaatggttttgtagagttgatatgttatttgttaggtgagtacatatgctcatgtttagttatgaacatttattgttatgataatgggttattttgttgctcatgtaaaatattgtagtgatgtgcaagtaatgttaatttgtactccatccgtcccagaatataagaagtttagagttggacacggttattaagaaagtggtagaagtgagtggtggagggttgtgattggatgagttagtggaggtaggtgggaaaagtgaatggcggagcgttgtgattggttgggaagagaatgttggtggagaagttgttatattttgggacaaatcctaagcgctaaaagttgttatattttgggacggatggagtagttgttatgctatgaaatgttgaattggtcatgccgaatttttgtattttacacccaaaagttagttagtttgtaattgtcctatatattcttccaattatccccaatttctacacacatttaagggtttattagaattttttctactgactttttaattccatgtgttattgaaataaccttgatgtcgtctagagggggtgaataggtattcccaaaaatgatcacaacttcatagcatattagaatgataagaactttcggttcaaatcggaactttcggtatgggattggaagttctggtcttaaccgaaaagttcggcagataacagaataaaacactagctatgaacttgtagctcgaacaaataaaatatatatgaatcgaaaggtgacaaacaaggtatctaagcaagatataaggtcaccaactatattaattaagcatgcaagtagatcgagtaaaaataagctaagcacaatatgagagatggcaagaacgagcaaaccaagagatgagacatgttgatttgtttcccgaagtttggatccatggattctacgtctccgttgaggggccacaaaggccaggtatattttaaccctttcctcacgaggttgcacacatgtacttctcgatttcactcttgatttcttctcttatggaggcgaaatcgaagccttcacaaactttttgaggcacaccataatcttgggtgctcaccggcgacgcctagccttctaggaaaccttagtccccaagagtaacaattgaagatttgcttgctatgaactcgtgtgctcaaagtatggagtgaaactcactagctcaacttctcaatctctcaatccaactctctccccttctcaaatcccactacaaagaggcaccacaaaggtagggaaatggggaaggctatttagctttggatgtgtctaatattgcccaagaacagtagccactcgaagaagagttagaggagtttatatacccgagcctctcaaaactagctgttggaggccaagactgcaattttcggacaagttcataaatttatagtagccaatctcagtttcgcagccattttcggaatttccaaaatattttcagactttttgatattttttcataatttctgaaaagcatagagtaaaatgaccataaattttcgctcgggagtctgttttttatgatcttggactctatgtaaagctcactcagaggactatcaaactcaacaaaaaaggtctaaatccactcaaaggataggttaaaatttaggtttatctcaaggtagcactaggatagatcactttgagcaccgaaacatacacaaacacatcgacgttccatccctcttaataatacggcattcctatactcaaataaaaataggaagagaattataccaataggaatgccttctttccatcttccttcctttgtcttaagggatgccaacgccaaaaacatttcaccgtatattcttcaaatgattgatgcagttacttgttgcttcaaatggtctcgcacggtccatcatggcaaagctgtcacaggcccttcaccacctgatttggttcttcggcaccaagcccctcgcttgcccttcaccactgcatggtccatcgcgactgcgcatcgcttgcctttcaccgtcttaccatagtagccacttcatatcccacatctgcaatatatttgctttgttattcttgatattttaggtgtaatcatatcacttgagcgtcaacacctttttaatcattggaacctatttttctcattcaactcaatgaaattattagtctcaatgatccggttgtcaacctccacatgttgaccaacttattgcgtgtataaaagaatataaataaataatgagtattaatcaacaccataagtgtcatatactcaaatatatgatcaaatgtaaagatccaattaaatgaaagtgagtaacttggatcaagtacatgcataactaaggtataggatttgctccccctaaatgtatgcatacaaaatatttgtgtgaagcaagagtatgcataaaaagatatgaaacattgagagcttatcctatacaagaatagaagacatttattaaatataggcattaaaattaaagcataccttcatcgtctccatgttctcaatgtaaagaaactaaccaagagaaaatgctcaaacaaaacattagtctcacatgtatattatcattcacatggaaatattagataggaacatatgtgcatagagagaaagagtgatacatatagcttgatctcaatgcatttcatccttgtgatttaggtccactatcaatgctcgtttctatctgaactcatataaagtccgagagtcacctctcagaaattctacttccatatccacatgatactaggcaaagaaatgtttataaaaacattagtctcatattattgaatttatcattaatcaccaaaacaaaattaatggcacttgaacttttagttgcgttacacaaccggtgataaccgcgcagtaaccgctccaaaactgcgaaatcgtcaattttttaattcaaaattttggaggtgaattttacgtggtttttggcggttactgcagtaactgccctaccatgggtggcggtagggcaaccctactacgtggctgatggatgtcgctatccaagtaagccttcaacaccatgagaatctggagttgatgccgaagaattatcgtctcggctcgccaacctactacctcctcctgtttcatttatctatgtggacccgtgatgtgacaggcagtgtgccaatgataccgggctagtgcggtatgatggtggtggtggctgatgattgatgacgataaatccaaagacagataaaatagtacggaatgaaggaattcgtatctctagtgataaattttgataggcacacatattgtgtgtcaaatttaaaaggagtgcatatttggtggctaatagtgaattttgaattccattgtttatatgcttattatttgaatcgtttattagcaaataaaaaattatttgcgagtaaaacttttatataatggtccatatcaactcaaaaccaaaagttctaaaataagctacaatgaaaaaaaatgaaaataagttttaagaccaaaatgagtatcaaccaaacatcgaggcgctttgtggctcaacaaaaggacatcatatgtcctgcgtctcagtgacaacgtccaatgttcggcgcgcgcgcgcgaccacgagtcgccacggcgcgcaggcgtccgcctgcccaatttggcgcggagagaaccggcgcgctttcacactcctcgcgccacatcatcattcgcattcaaactgaaaaaaaaaaaagttcaaatctccctcctcgccgtgagcgcccgaaaaaatttgtcttctccctccctcctcgcctcggggccgcgccgctctgagctccaaatttccccaattttcccccaaaatttccaagattcgccggcgctccggaccaaatcggcgaaaccccaccgatccctccaaatttccttttcattcccccccgtccgggaagaactcgaaatctttcccctctccctcccaaatcccaccacatctcggttacaaatagccatggattcctcgctccctcccattccccaagatctcacacctcctcgcacgctcgctcgccgccgactagtgcctcgccgagcgctcagccacggcgcagcagcaggaggaggaggagtaggagctcccgtgtccgtccgccatggccgtcgtcgaccaccggggcgacaaggagaacgtgccgccgcagtcggccgctgctgccgccgcccgcctccacggcgccgtcgccgtcaagaagctcaagctgaagcggctcggcaaggagcgtaggcgggtaccgctccgggacatcaccaacctcttcctcgccgccaccgccgccgctgactctgcggaggctccgccgcggtggcagccgctggaggggtcgtcggagcgtccggaggcagaattcccgcccccaccggcgccggcgccggcgacggcgacggcgacggcgactgcgcagagctggtcgctggtggcgtggtgttgaagccggggagatgctctctccggaaggagtttagataggtggtggctgcttgtacagtctattctttcttctgattcttctcatttgatttatccaattactcattggattacagagaaaaaaaagttgctccttagattggattgatttgtttcgctactgctaattggtggcagtgaaagatttgttcaggggggaaaattttgtcataaacaaagttcagatttgttatgtttcagcatccgtttctcgcgccgcatttggatccttgataatttgtctatctgtcattcctgagggttgcagcagtgtttttcagccaaaagtctgagctgggaaaatctcctggtatccagttgcactacttgtgtacagcccattggttaagtttgatcatcaaaatggttagtttcttgtgcttgcctctgaacttatgatgaatggccagtttatctggaactgctagtctgatgatgtgcatacaccagtagggatagcctgataatgtagtccactactgtagataaactgtacctcatacacttatccagttactcgttggattactcagaacaaaaagaactagtccttagattggattgtttttgtttcactagggttaatcgatggtagtgaattcagggggaaaaaaatgtcatgaacaaagttcagatttggtatgtcaaagctacatttgaggtaggcttgcaaactgaattctaatgtttgagcacccgtttctcccgctgcatttggatccctgattctttgcttatctgccatttctgaaggttcgagcatggttttcagtctgaagtctgaactggtaaaagcatcttacatcccaatcgttctgtaatactacctgatgctgaagtttgataatcaaaatggctagttgtttgtgtttacctctggacttactgcaaatggctagtttgtctggcagtaattgtctgataatgtgcacatgccagtagatattctgcagaaaggttaagttgagttcagttcactactgtggataactgtacctcatttcatttgagctatccctggacttccttgaactggttgctacaatatctaaaccatttgttgtatcattagaaattatattatcggggaatggtgcttatttaggtcttttcagaacctttaccgatgactcccgctgctatttatgcagaaaattgttatgccaaggatcactgatccggtgaaactaggtgatgtttgtactttgtactatgcaataacgcaagtatctaagaattatgattaagttgacttgtgctccttatacttaactcttgtatttttcattatgaaacaaatctcataccgatgacatattagaagtttgttaatagacattcatttcaataatcttccttcatgaaaaaatgtaaaacagcagtcatgcgctgaattaccactgcataattcttggaatatctgggaaatgttcataagaagaattttcatttgataacctgtgggactaattttccagcttcacgtgtttataaattggtgttgctttgaatgctgtcccagtcccgaggaattcacctttcaatatagtcatctatgacaaagtacaatttgcacactaatgtatttagctgctaaaaatcatagtggctcggtggctggcttgctacacctggatcaactacatacacaggtagcctaagtccagttttagttgacattgatgacaaactgcattgtttctaaaatagttctatccatatactaaaaatccatatgttttacatgataatactatgatttgtatacagtagaaaatttcaagccatccctttgtcatagttgcaaaattcctcactactgttctggcttcctgtattgaattattgaatatcatctttcagaatgataggattgaagtgattgaaccaaggcgaaagcataaagtggggatattgtttgttgaggaggcatttttgtttgaagctgcatcaactgattttctttgaaaacagcctatgtgtacacttctggtctgaaccattcttcctcacagcaacaggtgttagtaataccggtgagtgtattgaaacatggttgatttcaagaattaatacctatctacaaaatcattatagctaagcaaggtgatcactactctttggtcttagatggtatatcatgatgttatttgacgtcttttaattcaaaatgggtgatttggaacatcttttcgtcaactgaatttcgctgtcaaaccatgtcttcttagggcactgatacttctaatctgtgaagcttatttgcatcaagatatgtctgaatgtgactactgttgtattcactgacctttgatgaaagctgttcatttgttcatccttgccccagagcttgtctttctagttggctaagtacgatatattgtcccttgtcataggtgcagaaatatgtgtactcatcaacagagcatatcacagttgatttttgagaaaatggaaacaaagttttccattgagatacaggattcatacaatatcttcattgttattctggatactaattaaaaccatcttatgtgtctttgggtgttaagataatgtttcttttagctttgacaaatacttgagatcttcaggattcaccttacagtgcccttgtttccagacttcccatagacgtagctcagtatcagtttatctgaaattgaaagtctctcacaaagtaaactgaacattttatttaacaaagtagactgaacataaaacataggtgtgctattaattaccatttgcatgtgcaagtttctgcatatgaatgtgttttcttactatatttctttctcttttttaggatagtgttcatgatgcacttctagtcttactaggaaaccaccgctagaacttcaatatgtaaacttcaaaagcagataccaccttacatgcttagtgggtttaggcttcaacttccacctgccaagattacaatttttgttttgcggcgaagcgattcactgactagcaatttggatgatgaactcatttataaattctttagtctttggcttttcagttatgtcccattcattcgtttcagttggaatccagatcagagtgtccatagcactgaatcagtatcaagcacaaagttatataaagaagttcatatctatcatttcatttctacttgtgatg

SEQ ID NO: 40772 - DNA, 11202 bp, Oryza sativa
tgatcatgttgcaattaaagtatttactagctaatgaaaaatgcagtgctgtgttgtttaataagtaacagcaagaactcaagaagactttgctatctgttaaattatattgagcaagacaactttctttgacaaaaaggaaaaacatatttgaaaccaattttttatgcaatgcacgtttgtgaaaaccaaacactgcaaggttcgtcggtgcactaattctcaacgaaatcgacgttctccgatggattatgacgatggcagcgcctgttgccatgtctctgtcacaaaacagaacaagaccactgttggcattcagatcttgctatttgagtcagctagtgcaaactcagtatctgttgcaatccagtgtacttaactgctgaagattccatgtctgaaagggatgttgggagggaaacaaacatcagtaaaaggtgatgttaggtaacaaggttcttttacttcaccgtttgctttcagaatgattcatttcctttaagaatcatgcaagtgtattaatgatccatcattgtctagatcgaaaggaatacgatcaaattgtttggccgagaacgttgaagaggaacagcaactttcaattagtttggtgcatgcaagaatccagaaatgagcaattagcatctcaaacttttttcagatgaatcggcatctcaataacagtaatgcaactgaaaaatacttgcaaaaatggcgcctcctgttccagttcatgaattcaaggccatcacaagcaaatcattccttgtgttttggaccagccagacaagtgtaaacttatcttctgttggagaaaagaagattgcacctaaaaaaatccagggatccgtacactgataacgtcagaaacttgtattttgtttgatcaaaaatgcatgattagctggaacacaactgatgtttacacatctatggtcatcaactggatgctatttatgtgctgggtgcttgtctggttctttcgtcaagggtcctcaagtggccttaaggtcctatgcaaagccagcaatcttttgccccttgggtgtcatggaaagagatgccctctgcactgcaggtcgtcttgctgctccaaatcagtctaatgtatggacagtttgatttgaggaatccaaaccatcttgggtgaattggtccatcatgggattatatcatgagattttgatggtgtgaatattcattattgttccactaagaatatgtgttaagaaataacatggtgtttttgtaagaagttaaaaacaaagatagatagatagatatatttatgcttttttttcgttgatggtagttgtgcaagatgccgcaggcaacatgtattgttcatgatgtctagttttttttcctttttttttgttttcttttttacggctgtatgcatccttagttgttgctaagccaaatatttccattacttaatgtaatgagatattccattataaaaaaaaggagatagtatgatgacgagtcaaaccatctattaacttattaaaggaatagaaaaaaaagcatccacgttctctctcatgccctagaaattctcatattaatcggagaaaaaaaatcagagttcatacgggaatacaatttaaaaatagctgaaattcagaattaaaaataaggaatatagggagagaatactagagcccatagcggtatacaatagaactaatggaaattcgaaattaaaaaaagaaaattaaaagtagagattagaatccatatagaaatacaatttagaaataacgaaaattcaaaataaaaaaaaggaatattggaagaataatatagagtccatatagaaatacaatttaaaaataattaaaattaggaattattaaaaaagaatattgaaacataagtttagagttcatatagaaatacaatttagaaataatagaaattaaaaattaaaataaggaatattggaagaagagtatagagttaattcagaataaaaaaaattaaaagtagagtttagagtacatatagaaatacaatttacagatatctaaattagaaattaaaaaaaggaatattggaacaatagtctagagtccatgtaggaatacaatttagaagtaactgaaattcgaaattgaaacataaataatattgaaagatgagtttagagtccatataaaaatacaattagaaatagtgaaaatccataattaaaaaaataagcaatattagaagaagagtctagagtctatatagaaatacaatttataaataacggaaattcggaattgaaaaataagaaatattggaaggggagtctagagttcatataggagtataatttagaaataactgaacttttgaatttaaaataagaaatataggaataaaatttgtaaataatagaaattcataattaaaaataaagaattttggaagaggaatctagagtccatatagaaatataatttggaaataactaaaattcggtattaaaaaataattaataactatcacgtttatacaacactatgaatattacacatgattgatagtttggtcaagttagtataaaaattaaattatgttattattttaatatattttaataactagaaaaaaattctcgtgtgttacaatgagtgaaggctattttattgttatattgcttagtgaaggtgaaattcacagtggcaattcgtttggatgcatttttttttaaaaaaatcatgagttgcggttagaagtctgatcatttcaaattagcatgcgagttttttaaagagatttctcatacgacttcttttgtatttccataaacgaacgaacttaaaaactgactcaaatacggacatgtatttccaaaagcgaacgaacttaaaaaccgactcataaacggatgacgtaacaaaataccgacaaaaaaatcttcaatttttataataatagagataaaataagaaaaaatgtgctattatatgagacaaaacataaatatgctagccgcgcaatttgcgcaggccaccatgctagttctacttatagcaataaggatcatttcctacttgtgagaatattaattccttgtattcttaccttttatgttgataatttaggatttatgcataaacaacaaattaaatttgtatagaaaccactgtaaacatggcgaattattttgtgaacatatatttgttcatatataatatgatcataaatttatcctagcttcagaactaggacgaacaatgtcaaaacactaattctctgattcaaacattaatttatcatagattcctctagctacttaaattactttacaggttgtaaattcttgaacatcaagtagtcatcatggtgccatctaaacaaccaagcaccacaaacatagaatctattgtggcataaaatagatgaaagcacaaacttgagctatctagaagaagtgcgtggttgcatgaagactacagtctatattacaaaaccaactgcgtcattccaattaaatgtcccctttttgaagtataaaaaaaaaggtactacgaagaaacttgatgtcgaattaacagaaaacttaaaatatataggatctaagctgggcctaaaaggacatgaacttggatagtggtctccagtttatagggtccaatttttaaagcatggcgggaaacgaccttgcaagcatcattgtaagtatgcactgtcccttcttacttttttggagaggggaccagccctacaaaccgtatatatatagggggtgtttacatcacaccccaaaattttacaccttgtcacatcgaatgtttaaacatctgtatgaagtattaaatataggctaacaaaataactaattgcacagtttgcgactaatatgtaagatgaattttttaagcctaattgctacatgacttgacaatatggtgttacagtaaacatttgttaatgacggattaattaggcttaataaattcgtctcgcagtttgctgacggattctgtaattagtttttttattagtgcccacatgcgacaccctatataatatccgatgtgacacgccaaaacttaatttgcacccttgaatctaaacaccccatatatttatgtgatgtaaactatagaacagaagcttaggcagacgacataataacatataatatgtctgcacgttgatccaattggactcaagttaattaattaatttgtgcatgacggacgatgccctttctcacaataaattaattaaacgtataaggcagaaccgcagcagcttaacaaaactattacttcctccatatatagtcgcaaccaccactaacaaaccaaaaaatatttattatcacattctcgtttgcatcactccaataacatccaatgaaagtagtgatcttgatggaggattaaaaaataaattaaatgagaggggagaagctataattgtatgcatgtatgtgcgtattatattatgaaactataaaaaaaatggttgtgccttatgctgggatggagagagtaactcacacccgtgctaattttttttaagaaaactagctagaatatgcttattgagagacaccaaagtcttttctcctcaatcatataatatcaaacaacctagaaatacttgtattttgcaacaaaaatatgtgaaaatatgttttgaccgtttgcaatgatcatttctgtagtagaggttgattctatgcttactggaacatgtagatttctaatctacttaacatgatatgcttagcctaaacatgatcaccctaagaagttaaggaatttagggttactagccagtcttatgaaaccatggatgcgcaatttgtgtgatctcctctgtgatgtcgagatctagagtggaagtggaggactgtccttcgaaccactctggagcttggtgtaggcaaagtagtcgtagtagtggtggagttgtggtcaccggcttgatcgtcgtggatcagctgcaaggtggtggtgttctggtcgtcatctacattgctctgggacagttgtgtgttctcctttcaacgtctaagtgatgggatcagaggttttagggttttagggtttcagagagaagataattatgaaatgatagggtcagtggttttaggttttagggtttcaccggtctcccctattttatggcgctgaggaagactaggggcaataaaaaattaaatttttttatgctatcgatcacatgtagcctaatggttacaagagcctgagtagcaggtcctgggtttgattccacgtgggagcgaattttccaggatctttcaatggaaggcgacgtacatccgtcaatagcgaggcgcatgtggtgacttcgtcaatctacaggatgaattctaaaaaaaatacgcataatgtgtaattacagaaattaacactaggtgaattaatcacgttgatagtgcatgcaacggatgggaataaccgtgcgcgatccatgccgagaggtcaaaatttcccaacagaacgacccctagtaatatgttcacttgccaacaatgtgtttgttgaccaacattcagcatgacaaggcccttggtgggggcaagcttggcttcaactaaccaaactaacacgtagcttatattagttgtaattggaatcttggtcgttaagccagctcaagctatcgactaaagtcgagtaacttttgttaaatattccgatcgcgattgggacgtacacacagatcagctgagatcaagacgatgattagtcagcgggctcggctgcagcttgctgttggtaactccattactgggattcagtgcgactttggtcaagtgataaatatatatatacacatctccattctgctatatctatgttcagaaaattcaggcacttgatttctgcgtccaatgccgttcgagcacgatagaaatcgaaatcaatcaaatcaaatgcacgatctgggagagacctagctatctactaagtactaactaactagagattgatgaaggtttgagtactacatgcaatttgaattcagttagtgcattcgtggtaccagcaacctgttatctgaatatattgtagtacgggccggcaatagaacgcaaacctaactatacttttcggatcaggcatggcccaggattattggtccttctggttgttaggtttcgatcgctagctaactgttgtattgtccgcagtatgtgtcaaccgccatgcatcttgctttgtttacattagcgcccaaagtgctgcatctttgattatgtgtgcacgtacaaaagtcacaaaaagtgtttagtttcaaagaaaaggctagcatttcttttgttgtatataaacgctgtgggctatagactagctagttcgtatactgtgagtaacactacgctggaacaggtcaccagtgatgagcccaaaccatcatctccaacaggcaagaccctcgtcagagattagtaattagcagtgactttatgatcttatctgacggatgaaggtcaatggtgaccaacacctgatgggtaaaagaaaactatcactgctgactaatacctgtgacagaaaaaaaaaacccatcagaggcgagcctgaccatattgaattgatgatgttgtcacccatcacaaatactcatctacgaggggttaggttttttgacatcttagctcaattacgataagacctgtgtggttcatgagagttgtgtatgcatgtttagtaccaggcggaaccgatttttaagggcttgtccttccaatcataccactctcgggttaaccctttataaagtgatgatgaaagtataagtagggtagtatgtgtaagtgggcccgtccatcagatgagttgggctatgtggttctagaggaagagttgttatagttttgaccctcgccaccacccgtcattgtttgtaaatctctggcaaaagaaaaaaaatcacgtgcattgctagttaacaactcattcaccattcacaagaaaatctaaagccaaaaatattacagggaatcaagtgttggatctgcattcacactgcatttcacagagttgaaaaaaaatcatgtgttgataaaaatcatcgatgagctgaatactggtggcagtgatcgtggtcttcgctgttgccgtagtcttcaccaagttgaacggcgagcttggtcctgcgacgaccatagtgagcgagagcccgagcttaggtggaggagacaaggggccagtggagaggcggccgcctacactctggtgtgaaggagacgaggagatagcggccagagctcgaggggaagagatgacgacagggatggcaagcgatgaccttgggggaggaggcagagagcataagggcgttcagaacccgttgtcccctacaccaggaggttggatcttgtgtcctagagctcgggccgatcgagaggtgggcgctagcgctcagggtgaggaaggcagaggaggtgctatggggcagaatagagaactaccaacattggattgcgccaccacgaggtagggggtgatcagatccaatgtcccttgatcttggggaggctggatctagcgccctagggttcggcgacgatgacaacgaggatggtgatgacagactcttggggatggaagcgatggcagtggttgctccatggtacgcaaacgacaacgaaaatgacgccgagtgctcgggggcatagggggtgttgggtgcttgaggatggagtcggagaatatggcggtgaatgctctaggttcggtggtcgatgcgcctgatgagagagagagagaagaggacaagaaatttgcagtgtgtcatgctggctataggtagaggacagaaaaggagatggtcctgtggtcatctatgggatagaaaagatggaggcattaaagatgagtcatagtcatctttgactattgcacattttgtacctatcacaggtgagaggtcacctccgacggacctatgtgtgggcccgtcagaggtgagttgtgctgggtgcatataagtagcctgtcgcagatgatatcttatttgtgataggctacgccctacaaccttatctacaatgggctctattatggcttgttgtagatgaggtcctttgtgacaagacacttcagcccatagagatgggatgtcagagatgtgatggtctggagtagtgaaatgtgtagagttcatgtagggagagtgctgaacaacgagaaagacaaattagacaacaatgacaaagaagctgtctcttcaataaaaccacactaacccgatcgagatggccgaaaaacactagacatcataatttatttatggggatgcgcgtgcgcgcgcgcacacacatacacacacctaaggagcctaatatataacaggtggttctatttgtcagtttcttagttctctcttatcaatcgattaaccactttgatagtttgatgtttcatttataggagtggaaatggaaaaggatcatctctatgtcaacatcaaaaagaactcttgctgaatagtatggcttgctctgaaatcggtgtatccaacttcatgaaccaaccctaatgatgttcacctctctcatgctccttttctcctagtggcgtagctaggaatttttccttaggtagtcctagttcacaagttcacatcacatactaaaatttatgaacaccacataaatcctagatacaactacaaatttgattagaatgcgataaaaatgtagcaatagtcttaaatgcaactaacttattaacaaataacaagttcaaatgtgcaaatattacaagatagatagttcaattgttcacataaaaaaaatcttacatagaaatacaaaatgacagtgctgttaccatactctatgcttgctcttagccatgaaaattttaattatgtcttcttcactaactttggagaagatatctcgctcagtatatatgactaagcagtggttcaataaatcatcacatatattgtttctcaactttgtcttcactagactcagtatagaaaataccccgtcaatacttatagatgccaccagtaagatcaattccaatttaagaagcaaatacaaaaactcataaagaatatggttgtttgtctaaaaaaaaaagcctaatagagagctcaccaagtgtttgtataccttcaaatctgtaatctttcctcacatcatcaatagaagtgtcaatttggaattcaagtcttctcaagtccgagcttgaaaagtcattgggataaaacttcacaagcctaagtatcttttgtgcttcataggaggcaaatcttttcttgatttggaagaaaactgatggttttatctccttcctaattagtatcggcgatataccgataaaatcaaccaacaatatacaaactttaaacgttacgtgcactgttcaccatcgtatttgccatttcatagagtggtgaatgtcgacaaactttgtagtgtcaaattcttttcagattctctatgactattttcattagataaatatcataggaaccgagaaaacaagttatttttatataagacatggtacctcctaccacctactacctagaggctggaaagctctgtgcaccaaaaaagcacatgaacatagtatgcatagtgttagattgacataattaagaatattgtatatttttcaggacaataaaatcacttaatgccttgcattgtgttagatagacatatttgaggcataaaatggtgggcttgctacctggtgcagacactccagctccgttgctggcacacatgcccgtcagagctggcgcgtcttgccaagtcgacgcgtcttttatttcatgatttttcctttgcaatttttttaggtttttttgcacactctttttatttttttcttttttttcgtgattttttaatgcagtttagaatttaaatctttcatctcaaatttcataacattatattaaaaactttcaactcaaatttaaaaaattcatataaaaagtcaaaactcccaacttaaaatttaaaatgctttcaagtcaaaattcaaggaataaatcttgagttgaaaattttcaatataagttaaagattttctaatctgagttgaaagttttgaattttgacttaaaagttttcaaatcattttcaatcctgagttgaaactttttaaatttcaagttaaaagttttcaaatctcgcgttgaaagttttaattttttactagaaagtttactcgaattttcaaaatttaaattaatctaatatacttatatactctctctctgtcccataatataagtgattttgacattttgcttgtaccgtttgaccattcatcttattaaaaaaattagaattattatttattttatttgtgacttacttttttatccaaagtactttaaacacaatttttcgttttttatatttgcacaattttttttaaataagacgagtggtcaaacagtacaagaaaaatgtcaaaatctcttatattaggggacggaggaagtatataaaaggataagttggaaaaaaatatccagtgtggaggcccactaaagctagaaaaaaaaatatcatgtggaaaaaagacacgtgtgagagaaaaagaaaaggaaagagagtgggagagaaaaaaatgtgaaggaaaaaccggaaaacgaaagaaaaggaagtgcgtgaagccgtgaagccctggagaccatgcacgatttgagttcctcgcgcgtacacgctatctcgtaatatggctggtggtaatcaaactcctgtcattgatcagctagatgaagattaagctagctaggtaacactgctaagtgctaatccatgacagacagatgggtggcctgtagtcaaagagatcatcttcacattagacgcgcataattacacatttgagttgagatggaaacgaaagatgaaaggatttgacgtgggaaattaaaacgcctatatttttaaacatgaaaccgcgatggaaaaataaaaaacatatatatgcattcgtcatgcctaaagcaaatattaatatgtataataaacatcaaaatttcgcttttctttaatgttttgtaatgcgcgatgagttgcaaaagcgtgcagatgactgtgtggattacgttgaaacgtgagagatatacatgaattgggagtggattacgttgaatcatacgtatcatccgatcctgcatgcgttgactagggttccaacgaatcatctaccaacacatgcacaattcgtg

SEQ ID NO: 40773 - DNA, 6608 bp, Oryza sativa
ttcctgcagcccgaccgggcagcgtgtgccggtcagaccggcggtgattgagcggtcaaaccggccagcccgcggtctgaccggtcgacgctgtgtcggtttcggttttgggttgtttatttagatatccgtgattatttcatgattatgacttctagatggatactatacgtatgtaatactgttatttgctactaatgagtcaagttggagatagtttggtctcggaatatggtttatttatttatttcatgtgtaggtgacttgatgcctcgggagagtatttgcggtgatggaccgggagtcaacttagggataagacgacgtccgtggtggtcagagatcatgcgggatacttaggctagagttgatgcacgtggttgatggagattccatatggtatacgatggaggtattgtgtgcatatgggatgcggagtcgaatttggaaggagtccaaatttggtacgattggttatgtaaagtttgtttcttgtactagagggtttcataaggtatttaggactcctagtatgagtttggttcgtggctttaggctgcctacctcatgtataaatagagggggagcgtgaggcttctcgatatcgctttagagagcaattgagttgagttttgagttagggtttcgagtttagtcgaaatttttataaggagtgttgttggtgcactctgtaaacacagagagaagtaataaagtcgtcatccactttaagagttcttcgatttgtgtttcaccgggtttcagcggtctaactggcgatataccggcggtcagactggcggcaagcggcggttagaccggcggcatacgggcggtcagaccggcggcggcagcaggcgcggtaggcatctcgacggttcgaccgattgatctacatcagtcagaccgatgttcattaggcggtcagaccggtgcatacacttcggtcagaccgcgatccgtcgaattcgagggtaacttttatttccgctaaaagttttcggtttttgggtataccaaccattcaccccctatggttagcttagttcttgtgatttgatcgtacaaactgggggtattacgcaagtaatcatgactacctaaactatagttgtcgcactatcttgtcagaccgtctatttatttatagtagtagagtcaaatattatccatctcttctaaagccaatttttggaaagatgatacatctaaatccaaaaaattaacttaatcgattacacttgcactataatccttttgacactaggctgacatggcactatacattattttactgtcgacattagacaacccagaagtgtgctcatatttttggtacttcctatgtttcacaatgtaagattttctagcattgcccacattcatttagatgttaatgaatctagatatatgtatgtgtttagattcattaacatccatatgtatgtgtgcaatactagaaagtcttacattgtgaaacggagggaataattggagaatgatttagaatctaaactcaaaagaccaactttggaaggtgtagaggcaatttgttaggctttgtggcttagtaggaataacatagtttttaacagctacaatcatatttctttcttaaaggtgatattcaagacaactcattggacaaggttttggtctttgcttcttaaaaatgttgaaggagaggaagtacacatcaagtgcaggattctgaagaagcgagttatggatttttttcgaagaattgaatcttagcctttattcctctttcatcggttgttaaacttttatttgtatgttcctatgtaatgggagaagtcttgtgtactcgtgactagggttttggctgtatgcaccgcacaatgtgtagaggacgggtttaatataatccattatctaaaaaaaattagacatgtatgcatgcctagccgtatctcagaagaatacacgctgaacccacgttggccagcagctgcgtctcacgcacgatggccatttctctgtaacgcaaatcgtgcgttacgtacgaccaatcgatatgagtgcgagcttacacgaccatgcacacacaatttgatcaatatttccttttaaaaactcgtatgccgggattaattctaaatgcacgtactagctctgcagttcgaggcacccccctatatatacctaagctatccagctctagctacttcgcgattagctatagccatccatcgatcgatcaggacaccactgattaagccatggcaaagcttgccctgtgcttctgcgtcgtcctcgtcctcgtcctcgtcctcgcttcctcgccggcgccgctctccgatgatcgccgcgccgccggcctgctcggccgccgcggcctgcagcaggacgccattgtcgtcgacggcagcccgacggcggcggccaccgccaccacgacgacgacgacggcgtggccccggccggacacgccgccggataactggtacgacgggacgaagaggctcagccctggtggccctaatccacagcaccactgatgaacacatccatccacgcatgaattttgttgacagtgatcatatatatcaccactgtcagttaattacttctaccacaccattctctccacatgattttgcatcgctaattttaattttatagcaccggcgaagtaccagatcggagtttaatttctcgatcgatgtgcgtgtgtgtgtgtttccgagttaataaacctactatataggcagaccgatatttctgcagacagggactaaagatgggcgtcccaagagtgacagatgttgatttagcacttgatagaagtgtgatcactgaaaggaataaacgagagctatgtatgatcagttcgaactgatcagtaatttttcctcaatgttcgtgaattatgttctctttcttttttatatggaaataattaaatcctatacacaacaagatgcagtcagcctcaatatgtgatgacatgcactgaaacttttagttattcatgtttgtgatgacatgcaataaattttatgccaatcagcctaattaatgagtcttcttgcaattgaattttgagatgtgccgtgttgaacgtactcttaatttggagatctgagctgagtggtaattataatagtcaaatatagttttttgtttctagtcgctatagcttacatgttcttggagttcctttttaagcgagaaagtggaatgtttgtttgatccataggaccaccaaggatatgaaattatgcatgctttttaacttttaatcgtcttatgatccgggaaagaaacagcacctctgtcctcttgttctttccattcaaaagaaaatataaaacaatagagtttgaacactctgtgtcatatgcctcaaatcggattaagaaaggcatgagcaatggagaccacaaataaatactccctctatttcaaaatataagacacaactacttttcttagatgtttcataatataaaaagtgcatacatgcatgtaattaactagcatcttttctccaccaattattatcttgaactctttcactctcaaaatctctaattctattggatgcatgcattatatttcttaagatgatttcaaacgaagaggtgataataattgtttcttagtctttggtttaatgatggttatgccttattttggagtgagtagtgatctcattatgtcatgtggactaagaccacacataagttatgggcttcccaatgctgagtggtttgaagtgggcctattcaatccaaagcaaaccatggtccactgagcccatgaaaccactggcacctggcgggattatccactcaatttgatggactctcgtgaagtcgcgagtctccactcggtcgtagccatcacctcctcccccattgttggtattacttaactttatagataaaatttgcaagtgaacggaaaataccgatgtagcacttcacccgggagtattctcaggtatcgatttccacaggaaacgtgtgtgtcagctcttctccaggttcatccaaggacacaaagctaagataggcaaagggtagagaggattcactggtcgctttactacgtactcagatagggaggacttagtggtcttacctctacacctacctcacacctactgtgggatgcggagcaaagaccaatcaactatctactacgtacccagatagggaggacttagtgatcttacctcttcacccacctcacaccttctgtgggatacggagcaaacaccagaaatcaactatctactacgtatttggacagggaggacttagtgatcttacttctacacccacctcacacctactatgggatacagagcaaacaccgcctactgtgggatacggagcaaacaccggaaatcaactatctactacgtatccggacagggaggacttagtgatcctacctctacacccaaatcaacccttctgtgggatacggagcaaacaccagaaattaactatctactacgtatccggacatggaggatcttaatgatcttacatctacacccaaatcaactatctactacgtacccagacaaggaggacttagtcaaatcaactatctactacgtacctggacaaggaggacttagtgatcttgagagctgtcaccaggtctacacccacctcacgcctactgtgggatacgaagcaaacaccggaaacctctacacccaaatcaactatctactacgtacccggacaagaaggacttagccaaatcaagtatacacctactgtgggatacgaagcaaacaccggaaacctctacacccaaatcaactatctactacgtacctggacaaggaggacttagtcacctcacaccggaaacctctacacccaaatcaactatctactagtacccggacaaggaggacttagtcacctcacacctactgtgggatacgaagcaaacaccggaaacctctacacccaaatcaactatctactacatacccggacaaggaggacttagtcaaacctctacacccaaatcaactatctactacgtacccggacaaggagaacttagtcaaatcaactatacacctactgtgtgggataccaagcaaacaccggaaactgggataccaagcaaacaccggaaacctctacacccaaatcaacggacaaggaggacttagtcaaatcaactatacacctactgtgtgggataccaagcaaacaccggaaactgggataccaagcaaacaccggaaacctctacacccaaatcaactatctactatgtacccggacaacctctacacccaaatcaacggacaaggaggacttagtcaaatcaactatacacctactgtgtaggataccaagcaaacaccggaaactgggataccaagcaaacaccggaaatctctacacccaaatcaactatctactatgtacccggacaaggaggacttagtcaaatcaactatacacctactgtgggatacgaagcaaacatccaactatctactacgtacccggacaaggaaacctctacacccaaatcaactatacacctactgtgggatacgaagcaaacatcggaaacctgtacacccaaatcaactatctactacatacctggacaaggaggacttagtcaaatcaactggacttagtcaaatcaactatctacctggacaaggaggacttagtcaaatcaactatctctacacccaaatcaactggacacctactgtgggatacgaagcaaacatccaactatctactacgtacccggacaaggaaacctctacacccaaatcaactatacacctactgtgggatacgaagcaaacatcggaaacctgtacacccaaatcaactatctactacatacctggacaaggaggacttagtcaaatcaactggacttagtcaaatcaactatctacctggacaaggaggacttagtcaaatcaactatctctacacccaaatcaactggacttagtcaaatcaactaccagacaaggatacgtacccggacaaggaggacttagtcaaatcaaatcaactatctactacgtacccggacaaggaggacttagtcaaatcatctatctactacgtacccggacaaggaggacttactcacacaagccccagccatgcgcgataccattctgtaacgtcccgcctaggaggacttactcacacaagccccagccatgcgcgataccattctgtaacgtcccgcctctcctaggtcgggcccacttacgcctctcccagatcaggcccacttacatctgtaacgtcccgcctaggaggacttactcacacaagccccagccatgcgcgataccattctgtaacgtcccgacctggacaaggaggacttagtcaaatcaactatctctacacccaaatcaactggacttagtcaaatcaactatctaccagacaaggatacgtacccggacaaggaggacttagtcaaatcaaatcaactatctactacgtacccggacaaggaggacttagtcaaatcatctatctactacgtacccggacaaggaggacttactcacacaagccccaaccatgcgcgataccattctgtaacgt

SEQ ID NO: 40774 - DNA, 19935 bp, Oryza sativa
gtacccggacaaggaggacttagtcaaatcatctatctactacgtacccggacaaggaggacttactcacacaagccccagccatgcaggataccattctgtaacgtcccgcctaggaggacttactcacacaagcccagccatgcgcgataccattctgtaacgtcccgcctctcctaggtcgggcccacttacgcctctcccagatcaggcccacttacatgtgtaacgtcccgcctaggaggacttactcacacaagccccagccatgcacgataccatctgtaacgtcccgcctctcttaggtcgggcccacttacgcctctcccagatcaggcccacttacatctgtcgtgcttttataggtcttttctgcacactttgtcctcacccatgcgcacccgggaagaatttcccgatcagtcacccatccctaaattgctctaggccaagcacgcttaacctccgagttctttggaatttggctttcggaaaataagttgcaacttgttgagacgggtattctattaatcctattaagtcctgggacgggatgtcacatatattcaattaaagcagagtaattaacaagatacaaaaagtaagaggagattaccgacaactccggaattcctccgatttcttctaccttactctctcccaattctaatatacaataaagtacactagagcctcttgtaattcatgtcatgcttcaagtgtgtgtttacaagtgagaatgagaggggtatttataggtagagaagtgccttgggagtgtagagatgctccaagcatccaaagagcatcttctcttatgtcatgccaagtgtcccttctgatgacggttggagcactggaaacggtcataaccgtcatggggaggttgatctctaccgaactcaacttgggcctgggccagcggcctctgtcagggttcggccaaaccctggccagctctgttggccccggttttcggcctggacactcattttgggcccctcattctattggtcaagatggaaggcccatttggaggtgtttaattgggtttctgggtccaaaatttcataagtttggatacgcgtttgattctcctgctccttcgtgtatatttcttgtcaacttaggtagtttgtcacctgcataagaatatgtactaacactcgtggaaattattagaagtaaaccttaccactatgttggatgttctacatttatggctttatgcaggtattgacggtgttaatttggtacttaacagtcgtcaacacccatccctccactgaagtcatctttgtcccaatcgtctcctcccatttcctgacactgaagcctgatcaatctccgtcaccatcgtttcctgcctaatcaccactagagccgatattggagccaccgcctttctcattcttgccgtccgattggtgtcagaaacgtcttcttcctcatctttgctattggattggagctggagctggaggccaccaagcggctcttcttgtagatcggtgaggtcaccgagtagatttgcttgtagatcagtaaggccgataactaggtctgctcggaagctactcgtcttcacggtgatagcaacaatcttctcgttgtcaatagtggcaccaccgcacaacagaggggagcaaaagaaggagaagggaatagattgcgttgtgtgtgtgtgtgtgtgggtgggggggaggggtgggggggggttggggggatgacctaacccaacacgcggatccgtgccttggttctaggcttcgcgagctagcgtggcgagggaaggttaccatgaccttagcaggttacacagtcgactcttagccccacctaccgaggcaaacttaatgtatgcttttttattttggcctgtgaaattaaggttggggcctaaaataaaaatggcatgcattaatataagctaaggggcctgaacctatataaaaatccttgtctagtatatcttttacctcaatcttgggtgtaccatgtgtctgggttacgggtaaggtatactctctaccctttgatatacgtcagatatcagtatggtatacttgcgcgtatacagacattttcggcatacgataaggaaattcatcatggagttcacagatggaaggagtcctactcggtcagaactgggtcgtcattgtatcgtgccaggtccgatgtctccgagtcctacttggagaccagttgacctgcgatataaaagggaccccccggaggacataaggcatcgaatctcatagccgacacatccaccacagcctacgaagccggaacatacatgagccaagtcgccgggtgatctagtcgtaccaactcgactacgatctcgttggtatcatcgagttccactattccttttgtaatctgtgatttccatcatataatcccatatcaactggattagggctattacctaccaaggggcctgaaccaatataatccctgtttcctgtttgcttgatgtcgtactacatagatcgtcgtaccagcgtaccccaataccctctatatccggtctacgggtatcccccgtcgacagtggcatgccaggtaggcgcacctggtgctcaaggttctactactatgacatccagcttcgtcgacaacaatgtcaacaccaacctcaactaaggagttcctacttcaacaacgctggtgtggactcaagtcggcgaaatcgtcttcccggtttacaccacgatgccgatctcagctagtccatcaatggccggaaacgagaacgtagtgggtacaacccagaacaactccctgtcgaaggaccctcccgccggagcggagattggaacgtcgacgacatccgagcccgagaaggatcctagtgcggccaaaccttgtctttttgacaagaatcacgagccgacgaggatgacttccgaggtgacaaggtcctggtgtcctatccacaaaaccagaaaacacaccttgcaagccagctgggtttttctcaacgtccacgctgaaattcgtgcctgcaaagagcgtggaattcagcgtacttctccaactcgtgatgtccattgtcctattcacaaggcaaagaatcacgacatctcaagctgcaaggtctttctcagcgccatgaagacgccacctcctaaggtccagcagtcacgcatccccctcagggataaggacaaggaacaaggagcgacgctgatttcagatcgatttgttggggtaatcgatatcgatccccacgaaccatcagtcttgcacctgctcgaagactatggcttatcatcaacgagtacgccgcgcgaggttctggctatcgacgagtccggcacgtcagcgcgcgctaatgcggaagcggaaaatcaagtgactacaccagcccagcatattagggtcgtcaacgcaatactgagggaaaccccctacgatcccgttctgaacgacgatctcgcacgttggacagaatgactacgggaatcagtgaccaacctcagcaacgcgttcgaagaggtcgctgccgcagcacacccggaacagccaccaactggtgatgctaacggtgaaaaccctgaacagcgggaatcgcctcatcgagccacccctccacctcgcggcaccggcgatctccgcgatcacctgaatggccgccgagaggcgcgacgcacacgagacaacgagaaccgttcccgacgtcacgtctcttcacggcgtcacggtaatgaagaacgaggaggccgttcgagtgaagaccgaggccgtgataaccgccacaaccgccacgatcatgacgatcacgaacggcgggtgctgggcgatactggtcaaggacgtcgccataatgacggcgatggtggagatcggcgctgagacaacaacgggagacaacgacaggattctcgagaacccagccgacgtcctcgtaatcgtacgccggaaccaagcgacccatcgtcatcatcgtcatcctcctcatcctcatcatcagatagacatccacgaaggacgtatgatcgccgacaacccaccgcccccagcgctgggtgtagagctttcggtcgttcacttcgagatgtccgatggcctaaaagattccgaccaggaacaatagagaaatacgatgggagtaccgacctagaagaattccttcaggtttcttcaaggtacactacgatgccggagcggacgacaacgcgctggcaaattacttgccaactgcattgaaaggctctgcacgttcatggctgatgcatctcccccctactcgatctcttcgtgggcagacctgtggcagcagttcgtcgccaacttccaaggaacttacaagcgccacgtgatcgaggacgacctacatgcgttaacgcagaactcggatgaatccttgagggattatgttcggcgctttaatgagtgcaggaatacaatccccgagatcaccgatgcttctgtaatccgcgccttcaagtccggtgtcaaagatcgctatactacccaggagctggcaacgaggcatatcacgactactcggagattattcgaaattgtcgatcgatgcgctcacgcggacgacgcactgagacgcaagaacgacaaaccgaagaccggaggagagaagaaatcaaccaaggatgcacctgagtcaagcaagaagaaaaatcgcaagagtgggaaaaggaaagctcaaacggaagttctcgcaacagaatacgcggaccctcccaagcgcgcagacccacaaagcagcggcacgaagaaaacatggtgccctatacacaagtcggacagacactctctagaagattgcctcgtcttcaaaaagtcgctcgcaaaacacatggcatcggaaaaaggcaagcgagtacgcgtggtcaagaaggacgctgaggcggctactcaggaatcggactcagcatacccagattccgatctccatgtctcacacatcttcggaagttccgcggcatactcctcaaagcgagaatataagaaagtggaacgtgaagtctgttcgatgtggcagggagctgcgcccaagatgaagtggtctgaacagaagatagaattctctgaagaagaccaccctaagactgctgtcatcccagggcgatatccaattgtggtcgaacccactattcggaatatcaaggttgcacgagttctgatcgacggtggcagctcaatcaaccttctcttcgccagcaccttggacacgatggggatcccacgaagcgagttgacacccaccgatcaacccttccatggaatcactcctcagtcatcatccaaaccattgggcaaaattacgctgcctgtgactttcggccaagcaaataacttccgaacggagaagatcacctttgatgtcactgaattcgatacagcatacaatgccatcattgggagaaccacactcgcgaagttcatggccgcatctcacaacgcatatcaagtgctcaagatgccgggaccgaagggaacaatcactattcaagagaatgctaagctggtagtgcaatgcgacaaacggagcctcgacatggttgagcacatgcccagcccacctgccacagcagaaccacccaagaaagtgggcaagatgaacaagacgctgaaaccagacggcgcaatcaagatcgttccactctctagtgccaaccccgacaagaccgtcaagatcggggtatcactaggagagaaataggaactcgcgctcatcaccttcctccgcgacaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaagccatacgagaagagctcgacaagcttctcaaagctggtttcatcagagaggtactccatccagagtggctagccaacccagtcatggtgcggaaggccaacgggaaatggagaatgtgtgtcgatttcaccgacctcaacaaggagtgtcccaaggatcacttccctcttcctcgaatagaccaactggtggactcaacagccggttgtgagttgttgagctttctcgacgcttactccggctaccaccaaatcagcatggcgaaagaggacgaggaaaagacagcattcatcacgccgttcggggtattctactatgttaagatgccgttcggactaataactgcaggaaacactttccagagcacggtccagggcacgtttagcaaccaactcggaaacaatgtcgaggcctacgttaatgacattgttgtcaagaccaagacaagcgactcattgattgatgatctgcgggaaacgttcgacaacctccgacgatatcgcctcatgctcaatcaggagaagtgcacgttcagagtaccatcgggcaagctgctcggtttcctcgtttctggcagaggaatagaagcaaattctgagaagatcaaggcaatcgagaacatgaagtcgcctacaagactcaaggaagtacataagctaaccggatgcatggcggcactaagcaggtacgtcgctaggatgggagaacgaggacaacctttcttcgccctgctgaagaagtaagacaaatttgtatggacacaggaagcctacctatacttgttgcccccaacctaatgaagaggcattctttgcactcaagcgctacctatcaaatccccctgtacttgttgccccccaacctaatgaagaactattcatctatattgccgccacgccatattccgttagcactgtcattgttgtcgagagagagaaggtgcaacgaccagtttactatgtcagcgaagctctccacgacgcaaagacaagatatccacagatccaaaaactgctctacgcggtaatcatgacatcaagaaagctacgccactacttccaagcccatagggtcacagttgtctcctccttccctctcggtgaagtcgtgagaaacaaagacgttgtcggccgcattgcgaaatgggtagtcgagctaagctaatttgatgcccacttcgtgccacgaacagccatcaagtcccaggtactcgccgatttcgtagccgattggaccatgcctgataacaggtcaaacaaccaaatcgacaacgaaacatggacaatggcgttcgacggtgcactcaacagccagagagcaggggcaggattcatcttgacatcaccttcgggagatcaattcaagcatgcaattcacctcaactttagggcgaccaataacatagccgaatacgaaggactactcgccgggataagagctgcaactgctcggagtcaggcgactgatcgtgaaaggggattccgaactagtcgcaaaccgggtgcataaagattacaagtgctctagccccgagttatccaagtatctcacataagtcaggaagttggaaaaaaggtttgatgggatcgaggtccgacatgtataccgcaaagacaacatcgaaccggatgatctagcacgacgtgcgtccagatgagagccacttgaaactagcacctttttggacgtcctgatgaggccatcagtgaaagaggcaagcggcgaagatagcccggtcgcccccaacatcagctcgggggctacaaaggcagagcgcgccattgccgatatcgagaccacagacgactggcgcaccccactcattaaattcataagcagcgaagagttgcccgaggacgacgcagaagccgagaaaatatcccgtaatgcaaaagtgtaatgtatgatcggcaacgatctatacaagaaggcaccaaacggggtactcctaaaatgcgtctcgtccgacgacggcagacacctcctcctcgacatacatgaaggggtctgtgggtcacatgctgccggtcggacattaattgaaaaagcttttcgacaagggttcttctggccaaccgccctcaaagacgcctgtgacatggttcagcggtgtgaagcctgtcaattccacagtaaacacacaaggctaccagcgcaagcactccagactacccctctcacttggccgttctcgtgctgggggctagatatactcgggccattcacatgaggacagggcggctacaggttcctattcgtggcgaccgacaaattcactaagtggattgaagcgacacccacgggggaaatcaaggccgacaacgccatcaaattcatcaaagggatattctgcagattcggattgccccaccgtatcataacggacaacggctcccagttcatcagtgccgatttccaggattactgcatcaggttgggagtcaagatctgcttcgcctcggtttctcaccctcagagcaatggacaagtcgagagggcaaacggcatagtactacaaggaatctagactcgcgtctacgacaggctcatgtcacatgacaagaagtgggtcgaagaacttccatcagtactatgggccgtgcgtaccacaccgacaacgtccaacaaggagacacccttcttcctcgtgtacggctcagaggccatgctccccaccgagctacggcatcaaagtacacgagtacagaagtattccgatgaggatcaggaggagcatcgaaacaccgatgtgaatctactcgaggaacatcgcgaatgagttgccgttcgagcagccagctaccaacaggcccttcgccattaccacgagaagcgcatccgtgcacgcacgctttcgatcggcgactacgtcctccgacgggttcaaagccaagcagggcgaaaggcgaaacaagctctcacccaaatgggaaggaccgtacacgatcacacaagttctgcggccaggcgcattcaaaattgcagacggcgatggtcgcaagttggcaaattcctggaacattgatcaattacgtaaattctttgcataagtcaatagtatccatacttgttagacatcttacagcttcaataaagcctattttcaggtcaagaccacaatcaaagtgttccttcccgatgatcccttacccaaatgacacctagcattgaaacctatcctcatgtccctttacgccgtcttgacaaggcctccgaggaacctaagggaaagaccatgtaagatctagtcgtataaaagttctcaccgtgcgtatcaaccaagacgtgtaatcggaaagaaactttccaacttcacggttgggggctaggatcagtgcttgttcaaccgaggcaggtcaaaggtccaagagccttatcttccgagaagaattctccgatgacaaggctgggggctagggagagtgtataactcaaacgactgatcaaagtcgcgaagtgagaagacactcatacacactacatccagagtaagaaagcttagttagatagatttcttttctatttcacaagtacttcttacaattccatcaaaatccaaagttatattacactttttcccctaagacatctgtcacaggacacggagattaccaggaaggccaatgctagtccatcgactggaagaccttctctgccagcggcgccatcgacttcgccaggccatttatctccgtaggagttctccgagaacgagaaaacccttcgcggaggaactcgaggtgcagctgcggacgatgatctcgtatgcaagccaacacatgcccctcggcatatcggcttgatcgaccacactcctgcttgaaggcctcgtcaatgcgttgaccgatgctgtcgagctgggcgcaggccccattcagccacgagatgtatccggccgccgattcctcgggatccccacggggtactcggagctctctacagactcttgacatggacgtgcagcaactcttcagatacgagttgaaccacacctcacgacccccgagtgtctctacggcctggtccttttttacttccagcataattctctcgagttccgcgacctcaaacttcgtccttcaatactggatgcgacgatcctggtcagcaagcgcactctcgaggtttgctcagcatggaaacgattaagtcaagctgctcttctctcccgagaacacaacaaatcaagtcgatccagacggaagggcaaaggatatgataacaaagacaaccaacctaaaggagtcgtcgccattctcgtttccacaggcaaactttgatctacatcgcacctcggcacatgtggctcggacgcaagtgccggaacgatcactggcaactcaggctgcccgctttgctggacatccttgacatcaacgtctctacaaactacaacaaagtactcaagatcataatgctaaagaaagctaaggtgacgaccgcacacataaaggtagttggaaccaataagagttttacaaagcatgactaaggaatacaagagagctaagatcctactcttcaaaaagcgggaggatggactcccctagatcgccgacctcctccatcacatccatgcgcgcatcgctagccgccccctgatccaatatctttcacagatcgagttcaggttgcgtcaacctcacacacgcaagcacatggcacgcccaggtatatatcccgttggacgtctcttttctgatcctggccgcgtgctgggaggggatcacctccatcgctgttgccagttccgcgagcaaagatgtcagcgagaactcgtcgggattcgccgggatggtggccttgacgccgcactccccggcgagctggtgcagaccggtgtaggtgacccacagtgagccacagatctccgacaagtggttctcaagcttcgacatacggtgctcgagcccttgccgttgtcgctcattgccagccactagctcccgcatcttctggagatcctcgcgaacctccgccaaatcgcgcgctagccggtcggcgcgctcattggccgacaacgtcgccgccgccctcgccccttacccaaatatgcggatacataccaattcacttgttggcgaaggtcgcgtcatttaaagttcgacgtgcaagaccgtacctccttgcgttttagttcatggattttcctcccgtctccggaggtgatggagcgggcgtcttcggcttttccttccacaccttctttgatttcggtgcggaagatggcttcttctaagccggctgctctaacttcttggccggttcaggtgattttactagcgtcctccaataacggttcctgggcattgttgtttccttctccaggaagttttgcatgaatttcacaaggttgtccgtcttgggtggctccacttcgaccacttgaatattctacgggtttggcccgtacttgattctaaccatggagcattgttccgtcctcggttgaaactcaaacttttcctccttcccgttgaactgttgtgccccgatcgaacaggtgatcgtaggacaccccggatctttcttcttctccgggaacttgtggagtatctggttgctgcattgttctgtcagcttgaccacctccgttgttgggagcagtctcttgttgttgagtatgtccttgagataacgggcgtatgttggcacttgcatggcgtccaacaacggcacgttgatgtggatcttctggattacttcaacaaaacgggcgaattgctcgtccactgacggtttcctactccgttgagggaacggcagcaaccgtatgtcgtattactcctgcggcactgtcttttttggctgaacttccttgtcagccgagtcattagatggcgcttcttttgatatccctttagttcctgcagggttaggatatggcggatcacgagtggacttacctcctctccttgtgatcgccttgacattttcaatggaggagtcgggttgccccggaatcctcccagattcatttgcagggactaaagatgccaactgagctaactgggtctctatcattttattgaagctcagctggttttgaaatgtggaagcaaagccatctaatttgacatttatgttatctaggatcttatcattggcagcaagctttttgcttagcgaatcagtggttttagcttgcgcaaaaacaagatccttcaaggagggctggttagagaagttaccgttaatgttacctccttgataatatgggcatggttggttccacccttgacctccttgtggacggtacccgttgttgttgttgcccatgtacatcgcctcctcacgggtttccgggcaatcattcccagaatgacccgtgccaccgcagacttcacacgtaacgtgtgagtccaaggccttgacggtgcctcgtggccttttctcgtggtcgtccaagcgtttcatgaggaggttcagcttggtagcaagtaacttcgtctccttgacggtgtgcatgtctcgctgacgggtctggagtcgttcctcgctccaacccatattgaagaccattttctctattaattcaacggctccttgaaccgtttttgagaagaaatctcctccaggtgatcgcgggacattggggtgagtccattataaaaaaattctgcaggatcagccagccatccatcccatgatgaggacaggcggccatgtactcctgcagtcgttcccatgcttccggaatagactcatcccttgtctgctggaaactggaaattcgtccacgaacggcattggttttgcccatcgggaagaacttcaagaggaatgccgtagagcatttatcccaggtattgatagtagcacggttggcataaaaccactgcttcgctctcccgaggagggagaacggaaacagtcgcagcctgacggcgtcgggactgacgcccttgatggtgtacgtgctacatatctccaggaattgttgcagatgagcattggcatcctcattaggcttgccacagaacgggctagcctacgccatcgtgatgaggctggacttcaagtcgaaatccacgtcccctatgttgacctgcggcccaatggccacattatcagtagagggagcagcgaactcgtgaagagtcttgctggccatcgtcttgaaggtcggtggcgcaggtacggctggtttatctgtcagtagagttttctgcggagcaacgactcgcggcctgacgctccggaagaaagcttctggattttctttgaagttttccggcaggttgaaaccagtcatgcactaccctgttttcacaacaacaagtgaaaacaaccaaggttagtctacaaaggaaatgattatacagaagtaaatataaagtattagttcaagcaatcgctattatgaatcttccccggcaacggtgccagaaatgcttgttggtatttcttaacgacattactagaaatataatccccgtcaacggcgctagaaatgcttgttggtatttcttaatgacattactagaaatataattcccagcaatggcgcagaaatacttctggtatattatggttacagagttcatccgcaagcgcacagatataccattgtagcatttcacccgagagtattccaagggtatcgtatttattttctcccatgggaagatcatgtagagaaagattgactaatagtttatatattacttgtgataatcatattctaagtaggggttaagataatctaagggtagagtgacacacaagcattaacaactcatcctcattataaatgatctaaactaggtgtaaagaaaagagaaagagaatctattcctatacttctaatatacatagtatacatacattctagttaactgatatactagctaataccctctatccgatgccctcctggtacttcgagaagccacccctgactgccgagttccttacgacagcccgtcatgaccatacaaccggggctaaatacggaggaataccctcctcaggaaattaacttaggattatatataggcgcgaaggaatacccgtactgagttgtcaccatcagcggcccacctctcatccgcaatatataaccccaaataatgatatctcgtaatttagacaccacgcctaaattaccagatagtactctaatatcatcgtcatgacatagagtaattgcaaaagcaaacattatacccgcaccaaaacatctcccagataagctagccgtatattcattataacatgaacataatgtaaagtaggtactcatatacttagaaagtattccaataccataaatgtatttagaagagtattctaataaaagtacaaagcttataaaagaggaaaggaaagttactagagccatacccgaactcttccgaaggcttctggagttttgactcctattctatttctattccaccagctaaatactactaaactaaacttgagagaaatgatagagctattgcttgaggtgtgtgtgtgaagtgagaagagtagctctttttataggcaggtaatgacggttgtgacggttggaatgatcagtaataccctccaaccgccattggggatcaatcccagccgtccatccaaaccctgcatccatcggcgccacgggaggttcagccgaaccaccaggttcggccgaacttggggctggcccaatctagcccaatttcggctggtggcctcgtctattgctccactccacagacttgtgaattttggcccaattcatcgtgtcaattctgagttcttggcctattcacacacaagtctggttatcgacatcgtccgattgatttatcatccgagtagatatcgattctccttcactttattatcattctctgcaaaaaggttagtagacctaatactagtggaatattattgttctaacatatttatgcattgcaagcatcactagttctcctttatttttgtagtattgacggttgaaactgatcgataatgaccgtcaacaatagccctagtccagtttatatgagattgatgatgatgagaatagattacaaagagagtaaagaaacaggcgataccgacgagatcgtggtcgaggggttcgacaagatctcccggcgagttggctccgtgtactccggcttcgtaaactttggtgggtgtgtggacaatgagatgcgatgtctttagcgtgtccttaggggtcccttttatatcgtggaataccttaacctccaagtaagacttagagatatgtaaaccgacacgatataccagagattctaccctttccgagtaggacttcggcaattcctttactcatagagatattttccataatctgaggcaagtttccaatggcgtatacgggaaccaaccgtatatatacgtgaaggtataccttatcagtatatttcataagtcgtaggatagaggggtatgccttatccgtaaccctaacaatctgatccgtaatttcttttcttttctctttttttgtggactatgtgaatcttgttcttctctcatttgtatagtgacatttgatacgtgaatcttgttcttctcatttgtggaaatgtgaatattgttcttctcatttgtgtgttgatttgatttgtattgtgattaatacgtgcaaatggtagctggatgggatttttttcaaatacttttttcgcccaatattattttcacaggcggactacttaacggagccacctgcaaaaatcttattttcgcaggcgaacaaggtaaaaaatgattgattttcataggcgtttaggtgcaagcggaagtgatggtcgtctgcaaaaatgtgttttgaacgcctacaaaaacgtttttttctagtagtggggggtggggagatgcatagcctaatagtgaacctagggatgttaatgagtcaagacctagggttctttaactactctcatttatttttaagatcaaaacgaagtttaaacccaaccctcaatttgtttttaagaaaaaaaaaggtaggcacttcaattaccacccctagggggccccgtgagtcgtgagtaccatgtaacaacgggggatttaaggttattagttcataaactggctgaacaaatcatgcgtggggcaatttgattgaagtaatagattaacaaatgtggaaatttttaaaaacaaaaagacagatagaacctccctaactagttagtctcccccaggtatattcttagtcgatgaacctcccctctcccttgtttgctggatcagttttgttcgttaattttttgtatgagttgggttcgttatttttttttatcagaaaagtcagttagaagtcatagttttctatttgtcttcctctcattgtgcggcactccggcagtattcaaacattatcatgtgttgtggtcttcacattacggaccaactggtactagatgaaattatggattattacggagtatgaaattaagcaccttcgtgccaactgccattgaggtactttcacacataatcaaagacaggcagtgtgtagaacctttgtggcaaatcggagaaggtaggatgcatcccgacgtgaatgtggtctaggttcgtgatagcagagtgcacacatatcctgaagcagatagaaatttgactagctcgctcgcactagtctcgactaaagtcgaactaactgaatcacatgaattatattaggtggtgttcttttccgattaggatacagattttatctcgatttttattagcacgtttttaaactgttaaatggtttgtttcgtagcaaaactttctatatagatgtgttggcttgaaatatcaaatttgtaacaattaaaactcaactaatcatgtgataatagttttcttatttaccctaactttatctttatctttatgttctctaaaaaataccaccataatggtacggtgttattgcctgcagctaactacgcgctgtgagtaagcataagctgatcaagtcaaatccgtgtaaatcacaaaggttaattaatcgatctatgtgcatagatcgagctggttttacttctatgagggtatgtccggccggcccgggagagaggagatggggcaaataggccggcggggaaaaggagaaaaaacttgggccgaaagtggcctgaggacacagaagggatttttatttgtttttcaattcaattaattgatggaatggactttgcattattaaaattacttcttaaactgaaaattcacggcaatttctatagagtaatttagggtaaggagaacattaaaaaatatgttcagccatgattttttaagtaaattttattctcatttaattcacttgataaattgctttaacttttaatataaatactataaattatttattaaataatttttaaccccaaaagaaaatcaggacgtaacaactgccaccacggcttcaccgtgctgaagtccaccactgaccactgctacccctctgccccgccccccaacacacacacacaaacacatacccctactggatctaaccacttccaagctcatggcgaacagagctagaaggctatgagatccgagggagggaattaagtaagaacactgcctggagatctgaccgacaccggcacatttgcccacgtcggtatgggcctcattatcacccgctagcctaagagaagaagaggcagtggcggtctagaagggaacacagggatctagtggagaagctcctcggcagcgttggcaggatgcaattgagaggggatagatagtgctgttagacatagaggaacaactctcttcagtctcagatagtagtgaagaggagaggcgaagacggcgagataggtgagcgagaaggagagaggtgagagccagggagggagaatgaggggtggacaaagcctattgaattgaataatagaggttggtagatatttttgtcggtggttcatccataggtacaagtttttgaagaaaaccggtaatgatgactcacctatgcatgccaatttttaaagaattataccaatgactcactcttaggtgccatttttgcttaagaaaatcagaaataatgacccacctataagtgtcattttttttaacaaaccaatactaatattattactgcaggttttattgtataacatactaatgaggtgttatagatgctggttttaaatttgaggggccgctcaggagaaagggagaggacggagaatacctcacaagtatcggttttaagttaaccggcacctacaatacctgtccctgtattaggattacattacattattgccaaaaactcatcacagtatgaaaacaaattgacagaaattgctgagaccacgttacgaaaacacacattaacggaaattgctgagatcatatatagatctgcattattttcttgaccggcttcgatcaagtgcaaaccaacatcgaaatgattcacacatgcacgcggagattcgctgaattcaaacacatacacagtcacacacacagacacacacacgagaaagggaaaattaaattccggaccggccggttcgtggttcgccggtgttgttagagcttaatttattattagggctgtgaaatcgggtggataaaacgctgtagctggtgatgatcactgaaaagaaacacgttgattatcagtggtgctgtggattaggcccacctgggctaagcctcttcgtcccgttgtacgccgcggtgatcgccggcgtcagcctgccgccgctgacaacgacagcggagtcctgtagccagcgccggccgagcgggacgctgccggcgaggcgcggcaggcccggcgtggtaacgactaggaggaagacggcgcagatgaagaagcacattgcaagcttcgccattgctgcctagctagctaatacgttcgtgcgacgctagcttcctggctaataatgctgtcttttggtcgatcgatggcttgctaggtacttagaagctagctagagaggtgcgtcgatttgcagagctccaccgtgtatttataaccccaatgctgaggtgcatgaatttttaagttagacatgttcaagttcatggttttgcttacgctgatgcgtttcagcacaagagctgggtgatgcttgtcagcataagcaattccatcgttttgcttctaaggaataatggccgattagtggatctagggtggcatggtggatcaatgaagggagtaaatttatttgagagattatatatgtattggtgcttccctaaacgggtagttattggaaaatttgtaaattgagaactaaattattgagcatatgataaattagtaactcactagccagtcctagtactgattagtgagggcacacaattaaatccattgatcaacactaaataggtgtaatgtcctgcctatgtggccgtagatgggtgttggcatggctggggcacactaccgatggctgatcagcattcggcctaataagcaagccgataggcatatgctgaaaatcagcagttgcaacagcgaatcgatgaagccgggtgttgtgtgtggcccaacccgtctcaagtaagtacctggtttgataccgtctctaggtactgatttgtaaccgatgggctactatcctactaccacctcgagctccatgaccacaccaataacgacatcaagaacttccagagaacttccagaacacctatctcaagaagaagttccctaccaagaagcagtactcactgtcgtcgagctcttctctttctcctccacatccatgcatgacaatactgttgtctcccacattcgttgcaaaggaccagtggggagtgcaagccgcacactagtactaaaaggcatatacagatcggcactataggtgctagaacagctaaaaccaacacttatagtgtttttcccaccaccgcaagctgaaaatacaaaaaaagacacatttacacgattataagtgtctgttttaaagaaaaaccaacacctatacaatattataggtgtcggttcttacaaaacactgacacaaaaaaccgacctgagatgagcgtgacacctcccccagtcccctgtccttatccagtccccagtacctagtcggcccctccc

SEQ ID NO: 40775 - DNA, 14102 bp, Oryza sativa
  unsure (1)..(14102): unsure at all n locations
tgctgtggatacgacggcggtggcaggttggcggtggcctcaggcggatccggcggtggtggcggcagcagcgggcggctccctccaccccccctctcgcctccctcccgtggcagatccggtggtggtggcagcatcagcggaagccgtgggtggatctggtggcggtggcggcgcccgagagcggatccggcagcaacactccctccgccccctcttgcctccctctcacagcaaatctggcggtagtggtggcatcgatggcagccgcgggtggatccggcgatgctggtgtctgctgagggtggatccggcagcggcggctccctctgccgcctctcttctcccttcggcggcggggaagtgaagtttcgtgatgtatgttgttgttgttgtagttcttggatgattattatgtgattttgtgataattgtggttgattttggtggcaaagagtggttgattatttggagaagcagggtggatgtgctcgttgcatcggctcgaatatagccgatgcatcaagctgtttttttttggatcgtggaacctcgaatgtgtcggttccaaaactgacacctttgagaacaccacaaatgtgtcgactaataggtgccagttgcgaaaatcggcagctatagctatttctgtagtagtggcatatcaacatcgacctccctcggcacactcagcgtgatgccctctccatcgagcatatgaacggcttgtatgtcactgttgtctggctccacccaacccaaaggattatgagtgggcggacacccctgaggagaggggccaccgccaccaccaacaaccacaactatagaatatatttttgcatttggccaaaattgattttcgtaggaaaaaatcgcccttcaactctaccatcgctgccagctatcgtcgtcacccctcccggggctagggtggcggatccgctaccttcaagctcagtcgtcattgcccaccattgtggtcgcccctaccgtggtggagagcggtgccgtcggatccctcgttctggtcgctccagccggatcctacagccaagggcactgccaccacttcctgagcccgccactgcctctcccggcggcctctacactagatcccccgtcaccgagcttcccgccaatcctacccaatgctggtcgctcctaccaaccgccggttgccgaccaaccagctgctctagccacacgcatgagagggagagggagagtgagagtgagagataagaagggggagaagacgataagaaaggagaggtggaggagtggagaggattttgcttttatatttagtttgcagtgatttgtccaaacagacctcttaatgaggcgtatgcgaagatcttatttttgcatgcaaccgctcaagaggcccgtctgaaaaaatgcattttcgcatgcgaccttttaaactgaccttggaggaataatttttgcacgtaggagcagctatgatctgcctgcaatcaaaagagtagtgaagatagcgacacccgatgctgtggcagagaactcatctacaaggacgttgtcggaaccctctgcctgcctctagtgtaatcgatccaatgcatcgcgcgcgaactccaacccagtgcccgggccaccgtcgtcgttgttcatgctcacgtacaagagcggaggcctgggtgccgctattgttaacgatcagagttgtggaggcgaagagctctaatggaaaaatcgtttttcttgaggcagacgagcgtggtccagtcatcgtctatagggcataccatgggggatatccggaacataatacctgtgtataggcaccaatgatttttgggtatgtacatgcatttatttcgtcttattcaatcgtcatgtgcacatctgaataaaacataagcatgcttaaagtccctctaatgatacaacagaccacaataaaataaataataattaagtattttaaataaggtgtatctctaaaattttaaatgtgtcgtacattacaaaccgctgtagaggttgatagataaaacaatagaccaacttctaagtggtgaaaaatgagaatattaatattatattttggattatattgtttcagtgggacaacgctacagtcccctataggtttcccaccttctctccctccgtctgtctcacatgaaggtgggtggtgcagcagctaccggtttacatagaagacacaccaattatactgacaatatcttataaaattaaaaattaaatgggtaccgcgcacgttactacggaagaatcatgtgataaaatagtatatatgagttacagattcttctttctaactattctactgtattttcttttatgcgcttacacatctctcccgtcctaaaatataaggaattttaggtggatctgacgtatcttactactatgaatgcgtcccaaaatccccatacgttgcatgtgatttaaaatactctatacaataattactagtgggtgatgacgtggcatacttacatctaatttaaaatactctatatattaattgttagcgggtgatgattcgacatcttgcatattgagctttacgaggtctgcgagcacacgattagttcataaagtggctgaacaaatcatgcgtgggggcaattcgatcaaagtgaagaatttttttaaagaaaacgtcagatagaacctccctaactagtttgtctcccccaggtatattcttacacgatgaacctcccctcgccctagtttgctggatttcttttatcaggaatgtcagttttgttcgttcttttttttttcagagttcggttcgttattttctttatcagaaaagtcagctaaaagtcatagttttctatttgtcttcctctcgttgtgcggcactccggtagtattcaaacattatcatgtggtattgtggtcttcacattacggaaccaactggtactatatgaaaatatgaactatattacggagtatgaaattaagcaccttcgtgccattgaagtacttgcatacataatcaaagacaggaagcttttagcaaatcagagatggttgcatgtatcccgacgtcaatgtggtctaggttcgtgatagcagagtgcacgcatatctgaagcagatagaaatttcaatagctcgctcgcactagtctcgaataaagtcgaactaactgaatcacatgaattaggtggtgttcttttccgactaggataccgattttatcttgactttttttgctagcacgtatttaaactgttaaatggtttattccgtgaaaagctttctatatattagtgttgctttgaatattaagtaaatctattttttaaatttataataattatgcgctaatagttttttttacacaccctacctttatcttttatgttcagtaaaaaactaccaccttaatggtgttatcgcctataactaactacgcgcgcgctgagtaagctagcataagctgatcaagtcatatccgtagaggttaattaatctatgtgtagggattgagcaggttttacttccacgagggaatgtccggccagtcctcggactcccctcaatcgtgtttataaatctgaaatatcaattaaatagtaatatactccctccatcttaaaatgtttgatgttgttaactcttttaaaaatgtttgaccgttcgtcttattcaaaaaatttaagtaattattagttcttttcctatcatttgatttattattaaatatatttttatgtatatatatatatagttttacacatttcacaaaagtttttgaataagacgaacagtctaacatgtttaaaaaagtcaacggcgtcacacgagacggcatgtgctccattccatacgtgccgcgttgcacgctgttgtatcttcttttgtacaacagcaagtatgggtcctgatgagcacatgattccattgcatacaaacgttactccgcaagttgttttgcaacatccaatcactagaaactagttcaaaaaatatatttaccagaccggccaaaagtggtttttgtgtgcgtaactacagtccgtctgcccggaaggctgtgcgaaaattgctcattttccatataggtagcgcacccatacgcgaaaatccaattttcgcgaatgggtgtttatgtcgtccgcgtgcaaaaataaaaatccgaaaaaaataaaaatcgcaaaaaagaaaccctagctaccgccagagggctcctaccgccgccaccagatccgggcggcgccgccacccaccgcctaccggattcacgagacagagctgttgtcgccttcttcgatgcgcaggggagcctgccaccatgcttcgtcgctgccacacgccatcgtcacgaggcaagcgtggcagatccagccgtcaaggatccgtcaagggcccggtggatgcagatccgcctgccatcgagccaccggccaagccctccacctgtcgctaaccgtgcctgcggcccactgctcgtcctgtccagtgaggtgagagaggggaaagtgagagaggagaggagaagaggaggtgaacgagtggcgaggaaataatgaggagaggaggtaagagagataagtggataaggaggaaaaattttaaagtgttaagagggaaatgaggagctaactcagactttagacagatcctcaagaggccctaatgcgaaaatatattttctcttgtggcccctcaagagttccgcctgcaaaaatagacttatttttgcgtgcggccccttaagaggttcacctgcaaaaatcattttgcaagcagtcctcttaaggaggcgtatgtgaaaatggaggatgattttacagatgcgataagttacggtctgtctgcaacctaaagagttatcgtctagaaaaaatcatttctgtagtagtgagagctcaagcccgacaattaaatttataggtgagcttgttcctaagtacttctttatgtacttttgaggatagattgttacctaatgattaggaactatggagtggaccatggagcacttggagagagacgttcaagtcgagatggagatctaaatcatatcaagttcaagtctactttgggccccaagagaaatccacactaaattcgttgtgtaggatgcattcggactttgatttcgacattctacatatgtatggaaagctaacgagaccacctttcctatggatctagtcccatgtcaaaattccacccaagtcaatggggattgttgaaacaagaaggtgttaagaatcagtccgagtgttgcgtcactgtctttgggcccgttgggccatgtaccgtattggagtccaatagggatgcatccagaggactaaggtcgaccccagaacctatatattccatagccgcctttgagttagggttaggttttgcttagattaattcttgtatcgcagtttcatctctagattggtttgtggaacccaagtttgagttcttgattaatcattcatctgcaattgagtttggtctcttttcctttacatatgcaaatacctctgcaaatgagaacacatgaaactcatagtgcaaaaatgtttgttcaaatatataacacgtgaatctctcatagaaagcatgcagctttggtttatgaatatgtaatgtagacatggtcatatacgaattagtgatctcattatgtctttgattaatcattcatctagaattgagttcctgtttttcttgttcttgcttgtgttcttcgattcacatgtaaggattaccgttctcgtgaggtcaatcaggtttcggcatggttgataaccaaaggagacattgtgttgcgattgtagggtttgcatcgtcttgatcagaagccagatcttgtgtgtcaagtttccaccaaatcgatagttatcttcacctgacaaaagatcgggcatccagttgccatcaagtggtataagagctttaggtactgtactgttaggttcgtcttcgccctagtattatttttgcttttatccaatagtccacgagaaagtaaaaaaaaaagtagtttgcataattctgtttttccctgtcccagaaccacgtttagccatttgcataattatgtttcagagtccgtagtgttgagtttctgtccaaggtcaagttagtttagaatcgcgttcgtagttctagatctacatgttgctttgtgcgagagcctgccatgagagatcgagttctacttggtttcggattgctagccaccttgtgttaataacccgcttttgcaagccctcttagataggttgcaaaccaccttctgtgaatcaccttgctttgccagccccaatgttagcccgcataacctattctgcaatttgcactctagccagagcttcaacagggtgtgcgtgaaaccctaacttgtgcacatatttgaaaacaacaactcaattgcagttaaatgatcaatctagaactcgaagttggggttccacgaaccgctctagttgcgaaactacaatggcagaattaatctaagcaaaacccaaccctaactaaataatggctactgaatatatagattctagggttgaccttagactcctggacaagtcccttttggactccaatatgatacacggcccaacgggtccaaagacggcgatgcaatactcgaacagattccaaacgccttcttgtttcgatgattcctgttgacttggtaggaatttggacatgtgactagattcattggaaaggtgctctcgttagctttccatacatatgcagaatgtcgaaataggactccgaatgcaacctgggcaacgaatttagtgtggactgctcctggaacctaaggtggactcgaacttgatatgagttgtacctccatcttgatttgaacgtctctttccaagtgctccatgttcctctccatagttcctaatcataattaaatcattaggcagcaattattctcaaaagaagtatttatttcaaccttgcaaaacaacttgtggagtagcgtgtgttccaaaggagtgatgtcctcattaggtcccacaggccaccgcatctctagtacagtgtgcataggttgatgcttgtattagcctggcattaggcatatatgtatatatgtatcggacatcataccccacggcccatgggtatcagccctgataccatattgttgtcgaaatgacaaccgcatacgtcgaaagacgtggttactcaacagtggttggaaaagaagtaaagtgtattaatttgagaatttttacttgggatccccctattacatggccctatggggctatttatagcccccattacaggtcttactactagggctttggttatgcaagggaatttacatggttggccttatgaaagggacatttacatgggtacatagcgtaattgcggtccatgggcccttagcgggccgacaggttattgtcgacccaattaacccctgggcttgatgggccaggatagcttcttcggctctccaagagtcaaacctactacggcgaagtcgttccccttcggcgtacgctcttccccttgcgcccttcgcccagggggcctctagcttggctgcgattccctgcctctcgccgtcctcgctccatagtcttcgacatgggaagggttcgcctggcccaaatcctcatcggtcgcatgctttcggcaggtttggtcgaagggcctcatgcgatatcgccaacaagcccctcacgggcaagagtgagataggagcttcggccgagaccgtgcaaaccatgtgatatggtatgtggcgccccctttcgaccggtgctcctgccgaaacctacatcattcctgcaagtaaaatttgtttgtttctacgcttagagaaaatttctttgagaagaaactcctcttcgcattcgctacaaagcatcgaagggggggttatttagtctcttttattactatgaatagtaatgggccctgtgggcttttccttttccgtttttgggcttttactgttcggcatcgtcccgatggaaatttaccgtttcgtctgccctttgacacgtgtcagaactcgattggttggtaggcgaatggtctcgctacggggttatatatacccccaaaccggcctgccattttttactctccccgtgctctccccttttttaccgcttgacacactccgtgctctcttcgctcttctgtttcttcaacttttttgccatcgccgtgctcctagcctttcggctttttgcctctcttttatgtgctacgagcctaatggctcaccgcaagcctaccaaggccgggtcaactggcgaagatcctggaagccttggcgaaggatggtcatgcttccttggcaaatcacttgtcaaagaggccgacttgggcgtactggtatcatccggttctctcacagagggccaaggatcgtgcgggggtgaggccgttgttccctcgcctggggatgggcgaacggttgtcttcgccgcatacttcgctgctggtcttcgcctcccgtgcgataacttcttgccttcggtgctttcgatgtatgaggttaggcttccccagcttagcccgtcggcgttcccgaagctggcggttttcgcttggatgtgccggacctgtgggttcgcccctatcaccgagcttttcgccgctatgtttattgcatgcgcctcgaccaaagacgtgcagatgccggcgggcccgaggaaaaccgttttcggctgcgtgaacttcatgctgcggccggagcgttcagatgcttggccagtgcccgcatcgatggcgaaataggacaggaactggatgcagaaatggttctacattagcaacccttactccgccgaagatgctcaggcgagctggctgctttttgagcgttctgccgtctccatcaacgcgaagccgaacgtggagatcgacgggactctcgagtcccggcttattctccttcgcaaggttgcctggcggctgagcacctgggatctttgcgaggagttttgtctccttcggatttcccctctcgcccgtgtgtgggatgtttccgtgaacgagggcgaagaagttcttgggcttccccgcctagttgtccccgccggggccgatagtaaggttttttgtttttgacttaggccgtgtacttccttcatgaaagcgctttttaggctaagcggttgtgttcctctctttttcgcaatgcggactttggacgacgctgaaattgaggcatcgaagatgatcggggctctaaccacagccgagttcgcccgcttgctctagcgccaagccgacggccgggtgaatcgtgtctatactggcgaattgccgagccaatcgaacccctctcgtgctggtgatgacgaggctgggacttcaaaaaagcgcaagcgtgcggtcgcgaaaggtggccaagtccgaactcgccatagcgcgaaggccgccgtcgaaagtgatggggaggaggaagatgaggaggatgctgatgctggttcggaggaggatggctctcgtggttatacccccagccctacccctgcgaaatccggggcaggctcccatgtttcgcctacgcgaccacaagaaaccgtcgtggcgaacacccttctggtgatctccagcacagccgcgaaaccggtgatggatgtcagaaggaagaagaagaaggggaaggttgtgcaggtcggccatggcttttcggacagcgaagggtccgacgggacccctacttcgccggtgttgcggcgcgcaacttcccgtggcaggcgcatgtctccgccacccactagcgatgccgaagcggcgacgggcggtagtgcctcggccccggccgctagggcgaacgtcgctgaagacgaacgggtcgaagtggtcccttcacctattcgtcaacgagaggggaaggccccggcggttgaagcgagtgtttcggacgtgacgattaccgccccacatttcgtccccgccgactttgccacgcgaccggagatcattccgttcgtggacggggtgtgccaggtcatagcgtcgaccgatggccttgggcttttcaccgaactgaacgagttcggcgaaagctatgtggctgtggagagcctatttgtgcgggtatgacttatttttgcttgctaaattttgctctttcgctagctctctaacgtaatgtgtatatatatatatatatatatatattaccagggcctcgccgcgcatctaagtgccaagaagtccgcgttagagcgaggagagcctatttgtgcgggtatgacttattttttcttgctaaattttgctctttcgctagctctctaacgtaatgtgtatatatatatatgtatatatatatatatatatatatatatatatatattaccagggcgtcgccgcgcatctaagtgccaagaagtccgcgttagagcgactagatgggtaccgccttcgccttcgcaagtcctaagaagatcttcgccacaaggaagacgaaaggcgtgtggtggtggtgactttgaagaaggcgaatgctgagaacagatagcatttcctctggccatttgcccttcgctgcctcctcaagccttttttttagtgcttctaggattttgccatttgtacgttcggcgccccatttgactcgggtgcgcgaccgacgcgaacctaatttccaggttaagcctttcgcacatttctctgaacttgtcagagtcgaactgcttgccgttgtcagtgatgaactcttttggtgctccgaaacggcaaacagtgtttttccgtacaaatttttgcactactgccgaaatgatcgctccgaggggttcggcctcaatccatcgagagaaatattcaacagccacaattgcgaacttgtacccgtttcgtgccatcgggaacggcccaatgatgtctagtccccatctggcgaagggccagattggcgcaatgggctgcagctcatactggggcacggtttggcttcggccataacgctggcaactttcgcacttcttaatttgctcgacacaggctttcaacatagtgggccagtaaactccttgtctaaacactttggaggcaactgttcttgcggcttggtgcgcgccacatagcccctggtgtatctccttcgccatttcctcgccttcggcgaatgagatgcagcaaagcaagggttgaagtaccccaaagcgatagagctggcctgagaccatcttgtactttgtggctctgagttgcaagcgttttgcttctgcttcgtcttccggaagccatccagtttcaaggtgtttcacaaacggggttcgccaatcgtatgggtcttcacccagttccacttggtcaattgtcatgacttccaagctgtccatgggcacacatggtgtgtataagacttcaaaaaagatgccaggcgaatgtgagccaccacaagcagcagacttcgccaaggcgttagcttcctcgttctggcctctaggtaaatgttcgactgttatgccggtgaagcatttttccatggaccgaacagcctccaaatacttcttcattccatcttcctttgcctcgaaggatttgtcaacatggcctgctaccaacttggagtcggttcggattagcaagcgtcgaacccccaatgctttcacctttcttaggcctagaagaatggcttcgtattctgttgcgttgttggttgtgtcaaactgcagccttgcagcatatcgaattggcacgccattcggcgaagtgagtactgccgcaatgcctgtgccccaatgcgaccaagaaccgtcagagtacatcacccagggctgttcgataggctcgggctcgggggcgaatgctggtgtccatttggctacgaagtcagctagcacttgagacttgacggcagtgcgggcaacaaaatgcaagtcgaaaggggatagctctgccgctcacttgctaagccggccagtaacttctttaccccggagtatttcgcccaaagggtactgtgatggcactatgactttgtgggcctgaaagtaatgcttaatcttgcgtgaagccatcaccagggcgtaagcgagcttttccatttcaatgtatcttgtcttcgctccttgcaatgcttcggagatgaaatagaccggtttttggcctgaatccgtttcttggacaagagcagcactgactgccactagcgaagctgccaggtatagtagcagttcgcttcttgatgctgggctgatcagagctggcgggctttgcaggtattgttttagctcgtcgaacgctgcttggcattcgggagtccagttgaactttcccgcgccccggagggttttaaagaagggaaaacctctttcggctacctttgagaggaatcgactgagtgccgcaattcggccctgagcttttgtacttcacgtacgctcgacggaggcttcatttgctgaatggcatcgattttctcgggattcgcctcgatgcctctttcagaaacaaggaaacccaacagcttgcctgcgcgaacgccgaaaacacacttctcaggattcagtttcatacccgctgcacgcaagttgtcgaaggtctcctgtaggtcggatgcgtgatcgaaagccttgcggctttttatgacaatgtcgtcgacataagcttccacgtttcgccccaactgcttgtaaaggatcttgtacaccaacctggtgaaagttgctctggcattccttagaccgaaaggcatcctgagttgacaaaaggtgctgaacggtgtgatggaggctgtcttggggatgtcggctgggttcatgcgaatctgatgatagccggaatatgcatctaggaagctcatgggttcgcagccggctgtcgaatccatgagctggtcgatccgtggcaagggaaaatcatccttcggacatgctttgtttaagtctgtgaaatcgacacacatgcgccatttgccatttgacttccgcaccagcactggatttgccagccactcaggatgatcgatctcttgaatgacccttgccttgagcaatttttggacttcggcttttgcggcctcctggcgatcaatagacatcttgcgtagcttctgtttccttggcttggcatccggcttgactgccaagcgatgcattattagatctgccgaaactcctccgacttcatcagggccccaggcgaagatatgaatgttctttttgagtacctctaggatgttcttagcttcttcttcgcccatgtcgctccccagtgatacgagcttcgtggggtcggcatcatcaatctgcatcttgactatcttgccgtgaggggcgagctttggcgcgtgcttcgcccggtcatgcggttcggcctcaacattgtgcactgctctattgattatggccaaatcaccttttgaagcaaccgaaggctgaagccccttgaccacgatcactcctgccgggccgggcatcttgagcttgagataattgtgatgggaaatgacttcgaacttgttcaaggttgcacggtcgaagatggcgttgtagttgtatgggatgtcgacaacgtaaaacaatacttgctcttcgcgtctgttttcccctgtgccgaaggctactatcaactgtgcttggccaagaacttgaactgcttctccgccgaatcctcggagcgatgtcggtgctggggtaagggcttgggtagtcaaccccatcttggcatatgcttcggcaaagatgtgttaacagtgaaatttggcaagcccggagtagtcatcggcttagagtcagcatcggcttcgaagtcctgagattagccgatgagagttgtcaagtcgtcagttgtcggattcttgctatattcggttaaggaaattgatctactaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40776 - DNA, 7212 bp, Oryza sativa
  unsure (1)..(7212): unsure at all n locations
caaaaattttgggggcaaaagttttggcattgcaaaagtactagttggtgtttaaatgcatgttaaagttttgccattctagcactaaagtgagagagaaagagagagggagtggtcccaaagcactttttggcacaatttgctattatgggctagcaaatgccaaatgccaaattgccaacttttgctactagtgtttagatccaaaatgataaaaagtgctacaaaatggtaaaacttttgccattttgaaggatctaaatagggccaaagtaattttcactgagcggtaaaacacgcaccttacaccatacgatattttgaagatccgacataccgtatgtaccatccgtttcatcacgctgtaaaccaaaggttaaagtgttaaaccacacacggtagggctgccacgtagtcacgtagatatatgcttcttgtccatgtaatccccggcacgtctcggcccaccgagcacgaggcgacgggcctccatccgaggatcgtcacgttgcctttcagattccgtggcccacgcaccaccaatgagcccacatcaccgcacggagaaaaggacaggagacggaggcactgccccggtggtctctccctgcccgtgggacccaccacctcccgggcccacctggcactgtggtggatagccgcttgataggttccgggcctgacgtggactaccaaataccaattgccatggtccaatatggggtccgcgatctgggcctgcattgattcggccattaaaaaaggttatcgtctcgtcgacgtttttcatgggggcccaattcgctagtaggttgaggctgctgtcacgccagcatggcctcgtccctctggttgacggtctcaattttgtcactttcatgttactcaagaagaaacccaagttttcgtttttgcaaaaagttcacttactttcctatgtaaatgagtgtttattgaaatgtttagcaagactagtacaagaggttatagacacttacagtccaaaaaggagagaaaaatccgtccattagcgtccggatagtgaagtactaccacaaacctcgctgaaaatgatcctgattctaggagattgctgacagtactcgactatacaaagcataggataatctgtccgtctctgttacctccttttaactatgataacgttgcttttgtaaggttcagaaagtcctcatgtctgtatccttaaaatatatatcgtatggttttgctaattttatatcgatcggccacaaccacaagtatatcatggccacaatagttttatatactattatatcactgtttatttggttcaggttcttaatcggaagtcacttcaacgtcatgcgaccgtgcttcacgcgagctctataaaatactactgcaaagcacgattgtttatccatctaggtttcacatagctaatctatatttctgtgcaccgagatctaaaatattccaattataaaatgcatgggccacaagaaatctaatgctggtaccttgaaaccagtaaaaatgtttctttctttttaaaaaacatatgaccggcttgcagatgtagtataaccggatgtacatctcacaacttgacctggtccgttgcacgaacgtcgctgctgaattgctcaccacgtctagctttcaccaaactcgtactttccatccccgtttgtcttctctatcgcgatagcaaagcccgtactccgtgaagaacaagcaaaacgagatgagtatatcgcgatcgcctgatacaatcacagtgtactacgtgacactgtgacaggttcaaattcgtgcggagcaaactgaaaatgtcactgttccttccaccactagtagtagaagggtgtgtttacttcgcaaattttttttgtcatatcgaacgtttgaccggatgtcggaaagtgttttcggacacgaatgaaaaaactaatttcataactcgcctggaaaccacgagacgaatcttttgagcctaattaagccatcattaatacatgtgggttactgtagcacttatagctaattattgactaattaggtttaaaagattcgtttcgcgatttctatccaaactgtgcagttagtttttttatttatatttaatgctcatgtatacaaaaattcgctgtgatgttactagaaaaaaaatttaggaataaagcaggccgaaaccacagtacggtactagtaagtctgattattactccatgctgttacagaaccgggaggatctgcttcgagaaacgaacaaacgcagtgacgttcagatcagcgagtctattttactctttctgccgataattatgcggacacccccagcacattacactggttccattcacagaccggcagtagcagccaccattgtcaccggaatattccactcggtgtggtcggtggtcaggagcaccaaggcaaaagtcgcgagagaatattccggcaaccatatcgatgattttttcagttttccactgcaccacctaccactagcagagtagcagtagcaagtagaacacatcgcaacacattcatcaaccttctccatgcacttcaatggcatgcaagcagcaaagcttatacaacaaccctgacgaatcatcgaaacagatggcactgaacgctgcacgagctgctgtaaacacaggcagtttatgtcgtactctctggtgttccggctcacaataactagctcaccgtaccggttgttcctgcgtagtactcctactacaaccagctgcagtagtattgaaatctactgggagttgtgcacagggtttgtaaaacccccgataacagcatggttaccgtgcttatcatgggttaagtacggtaaaaggtaaaagaaaaaccgtagtaaccttcttaaattcaaataaatttaaaaaataattaatgataaattttacacggtttcgtgctgttaccgtccttaccgccggggcgcggtaactctagtcccggcggtttgggaaactctggttgtgctctgatcccatcacatcgccatggtgaaatcacaagcttttgttccaagttccgaaagggaacgacgctttcgcggaggcggccggagcaggcggcgccgtggccgtggaaagcgcgaagccaaagcaggtcgacgtcgtcggatcgctgtccgcgaggcgagagtcccggtcagtgaggaagaagccaacggctgctcctcgtggccgccgggcccaccgaacagcgacactgttcaggccgtgggccgttcgttgagtcgtccccttccttgctcagccagacttcctcaaaaagtcctaattaccatcctactgctagtgacatatttatggtccattttggatggcatatgcttacattagagctcagatgagtttaagtagggaagtgagagctagaaattggagaggtaatggagtagtaggattttactacactgcagtgctacagctaatgtgcgcgagaattggcaaaagagactagagaagtacgtagaggtccattttttttacaaaattgcagataagaccctgctttcctgcagaattctttattcccccaggcatagtgttttccaactctctctctcggctgcggttacgccggatttgcttcagttccagtgctccgtgggctcggcccaccacgacgacagcggcgggggctgatcgtcggcgaagaacccgccgcacggctcgtcgtcgtcgaggaaccccgtctcgtcctcctccaccttgaggaaattgccgtggaagaacacctcctcgtggctcgccgccgccgctgcgcccgcgcccgcgcccgcggcgggcggcgcgccgagaaacgtgcacgcctccggagccagcgcgtccgtcgccgcgggcgcggcgccggccgcgtccacgtcgttcagcaccgcgcttgagtcgctgtcggacgacccanatcccgccgccggtggcccgtcggaggccgccggctcctccttcaccgacgtgaagctcgccgccgcctcctcgtccccgagcttcgccttcagctccttgatctgccacaattcgcgcgaccaagaagccatcagacattatgcgcgcaaacgaaacgactgctcgacgcagtcacgcagagcaacagctcaggcggcacggcagggcagcgactcagtcggcacgtacctcggcgaggagggcgtccttgtcgcggcggagcgcgtcgtgatcgaggcgcagggagtcgtaggaatggcggagcgcggcgtagtcgcgctcgagctgcttggtcttccaccgcgcgcggcggttctggaaccagacggcgacctggcgcggctgcaggccgaggtcgcgcgccagccgcgccttccgctcaggctcaagcttgttctccacctcgaagctccgctccagcgcgcgaacctgctccacgctcagccgccgcttcttctccccgccgccgccgcacgccatcatctcctcctccacgtccccctccgcctccatcccaacccctccatatccatcatctaatcaaaacacgcatgtacaattacaaaacactcaatttcccgcacatatcacactacaccatcacctccaaagaatgaattgccacaaaaggaaaaccaaagaacaaagattaccactagaattagccatcgtgacgagcgatgggctgcctccgccgccgccggcaccgccgggtcgcttcatgccgagttctagtaaaattcagtgaacgcctggtcgatctctctctctctctcactgcgagaagacgacgggcacagaagcgtaggaatgacgcgggtgcctccgtcgctgagtcctcgccggtcttaattccacgctgcgatccatggccaaacaccacgtagccaagtccccggtccaaatgctgcctagaattgcaattttgttgcgcggtttctcatgatccaagaaagggaccaggggatgagagtgtggagtgtggagtgactcttcttccctccctacctctctctctctctctctctttctcggtttcctttctgttttcgcaagacggcgcgctgtaccctgtgtgtattaataaaggcgagagagaccaagagagaggagaggagaggagaggggggcgctcgggttaggtagagagggggtggtggtgcggttaggaggtgaccagggttaacgtgacgtgcgtttgcatgctcatgtgcaagacagtacgaagaggcgcggccgttctttgcgttgagtccagtaacaaccgaacgaactagcgcgagtacgacgactgactgtactcccggcactgaaaaacgactgaatcgacgtctgatctagcgtccaaagtcgaatggatttttcacctttcgtaggcattagcttcactcaccaatggtgggggtgcttcctgcgttggtcatggcctaaagtttatcaactttgctatacgtccaactcatgtgtccgacgcatgtacgactgaaacggcagaaaaaacgagcaatgacagcgtcagatatgactacgcgtcgctgagcctcgttgttgtttgcttgcgtactgtgctttctatacactgaggccagaggctagtccggctgagacatgtatcgatatagcttaggttgctattaaaaggattcactccagatgttagattagtttaggccttcaggatatgaaaccaatatattttcacagccataacatgcaagtcctcttaaaaaaaccataacatgcaagaaaaaatgattgaccagacttgatagaaaaacaaggcaccatggcttcaatttccatatttatgaccaaaatcagttgaaaaatcaaatatggccatgtatatgtttgcaagcatggaaaaacaagagatgttgaaaaacgaattgagataaaagattaatagaattgttcatggggcctagaaaatcagagcctaaaataccttctgttagcttcaacctgaatactctgttgcggttgccgcaaaaaaaaattctgattaatcttaactgattggtatggataggagacgaaggggattagaatgagggtttagggtgagaaaggaaatgtagaagatgaaaagtcatggatgtgtatagagtaatatcgagaagaggaatcgacgtcggaatatggagcttcggctggagttgggcttttaaaaggcccaacaatcacagctcacgctcacagataacgccgtcgactagtcgtatgatggtcgtacaaatccgtcgtgtgtatagcattttcgaaagtttatatagccctacgaggactggaacgaggcggtggtcaaggttcggtcacgcccatgcttgcacgcacacaccgtctcacaccgaatcggtaggagactaggaggcggcaaccaagacgaactactcctccaaccgaatgctaatccgcgcgtaggcaagcgacggcgaggcggtggcggtgagaaatgcgcggattcggcgacggatcggcggtggaacggttcggcccgcggcccggcgagaggcgtggagaagagcgcgcggatggtagcggcagcggcagcagctgctctgcttctgctgcctgcttcggttggtcggggcatcaaaagggggaagtgccggtaaaagccaagcgatacggagcgcagctttcctggggaatggtggagcgcgcgactgcggagctgcaggtgcacagtaaaaatcctcgcggaattgcggtttggtccctagattctgcggtaatacccctactggtgtaggagtagtagctcccagacccacaacgagggacgacgcctcacatgtcgggtgctgagaaagtggctttcgtgtggatttgagggaacaatagctgtgtttgcacgacacatggtagagagattttaacgtggcttagtcccagtttagtagagctctaactttaaaatttagctctagaagttgggttagagtggagctgtggagtagctaaaattcagctccacatctgtagttcatattgtgatagcactctacctaactccgctcctattttaggtggagctgaaactatttgtctgagctctagctctaggagagattgaactggaactggagctgtgccaaacagacccttaaaaaaaggtgaaaccacatactttctccgtccaataaaaaccaatctagtaccaaatatgacacattccagtattagaaatctggacatacatatgtccagatttatagtactagaatatatcatatccggacct

SEQ ID NO: 40777 - DNA, 7592 bp, Oryza sativa
gctatccatggtttcatgcaaaagtaaatgtctaataatagcatcagccattgtcagcaaatgttagtttacacagctatagataaattgttttagtgcatgtgctattttcgtaggtgataatccaaccctacttgcattgtgttactccctccgtttcacaatgtaagtcattgtagcatttcccacattcatattgatgttaatgaatctagacatatatatctatctaaatttattaacatcgatacgaatgggggaaatgctagaatgacttacattgtgaaacggaggaagtccatgatatacagagaagacaaacttgagtttgttccttcaaattcactagatcccaagctcaaaactatgatacaggcaacctgggaggtacaaatttacacgagctcatcaactcaagaagtacttatcacctccacagttacaattgtcaactcatttgtctcagaaggagattttctccaagagctacttcagctctctggttatctggtatacgctttctatcaaaagacatgacacactaccagctcccagctttgctgaggctgcaactccctttgacagcaaaatcatgccaactcacagtggtaacacagcactactggagcgcccattccgtgagaagaagaacccctgcccactgctcgacatcgatctgccaatcccaaaccgccctgcctgacaagaggaagaagacgtccctgttgcatccttctctttcacgctgaataacttcatctcttgaccattcggaaattttcgatcaccccgcatggcatcgtcctgcgcttcaggcacaaccaccaggaataacggtgagtccatggacgccgagcgccgtattggcttgggcatcaccctcccaccatcctctggtgaagctgctgtgtcctcactttgagtgtccgaagaggtgtcagaatcctcggagacatcggcacgtgattccgatagcgagatttcatcaaacacctggtgctcttccgcttgcccaccaccctccgcctcaccttcggtagccgtggcggggagatcggagggaacgacgactggggatctgcagagcgggcagttgacgtgtgcgcggagccaggtgtcgatgcaaggcgcatggaacggatgcgagcagcgcgggaggaggcggaccaactccccgtcgcggaactcgccgaggcacaccgcgcagtcccctccccacccaactccggcgcggtactccgcggtggctatggacgtgatggtggcctcgtccagccccaccgtgcggatgtaccacacgtggtgcacatccccgccgccgccccccgcctcctcatccccgtcgccgaacccgtcgtcgccggggagcggcgcggtcgcggcccggcgccggcggcgcaggacgacgcggcggcggtagagcaggatcgtggagacagagagcgagatgaacaggaaggcggagaggagtgagacggtgaggaggaggcgtacggggaggtggtggtcgtcgacggccacgtcgacgcgcgggaccaccggcgacggcggcgggggctcggcgatctcgtagcagctgccgcctgggcagaccgggtggcagtcgagcgggtaggccgagcagtcgacggtggccgtcccgttgacgcggctcggccgctccgggtacaacatggcggcgcggaacacctagcgacgatccggcggtggcagctcggcggcggcgacggcggcgcgcatcggtgtgagtaccccgcggcggcggcggcggcggtggtggtggaattggggtggaaacgtggagtggattggtcgttgttgttgggtttggtaaaggtttgggggggaatgcgtggaggtggagctggaaagcacacacgctacgagtgccaaaaaattaaagcacagaatgacctaatcttttgtatgcagtcactgatactgtgggtccagattgccaagacacaaattggggcccactactcagtgacaagcaatcggtttttgctgtaacgtatggtcgtgcacatagcagcaggcggcgacctcggtttacggaaagtcaaaggcgataatcctaattttgaatggaaacactgcaggcgaaaggaaagctgaaggagttattctcccgtatctgtagaacggcagtagcaagttgaagagatctaccccgttggttttggcatctgacggcctcagttcgttggtgagagaggcagcgagatttcgttagtggccctatttggggccatgacagtgaagtgtcactacttaatactacgagtaatggagaagacgacgactgcacgggttaattatgtggccgacagtggacgactttgtgacgccgccgctgtttagggtaatttttgtccgacggaatcgggttggctctgttaggcaatatatttaatccaaatcctaacgcaatcagtgggagatcaatcgcaaaatcaccatcatcgataagctttttctgaaactttccaccgccaagtatttgatggtctctgaattctccttgcgattttgaaacgacactgctgcgtttgactgggagtactggaccaagaggggaggactaaaatatgacccgggccagcataagaattgctgggccgtcccgaaggagtacgtgccaagtcggcccatcaggcccacgtaaacgggaggtaattaaggtctgcgtcacgaaagcgattgattgatcatcaggtaatcctcatgcgtaaattgtactcgttcctcttcctcctctactactccaagtcgtttttatcgaatttttaatgcggatgactaatcacttcatcagaaacacgatagaacacggcaataacatatgggtcgtttcttccctccgtccacctaccgcttgttcccctaattgatctctccccatggcaaccctcacgctgccggcgaccggagccgccgcgcaacccggccaggaagacccaaggtatgcgttcccttggttgcttatttctaaagaattttacctttaaccaaagttggatgtgaaatcgagtgatttgttggatttgctccgtctcgatgcagcgggatcaagaatcctggcgatggtgcgggagattcgagcggcatcgactccgggtatgtggtctctgagcaagaacagcgctttctcttgcttgatttttggagaattttaggtcaagggcttgtattaagatggttggtttgtgtggtcagatgggttgttctggggaaatctgacatagttccggcggatttggctgccgctgccgctgacgccggccaccgacagcttgggttctcgccgttaccgatgcttccaatttggtaggaattgggggaagaaataccgtattgtactgctgttctgagaaccattgcgattgatatctctcgtatttttctcagggtgcagatggtgcttggaggcgtagtctacacggccgtgccgttctacaatagggccaggaaagccgaaggtgcaattacacaaatccaatacctggttgctttagagtttagacccaatacaactgctaatttgcaaatgttataggagtaaatcatttccccttagctcattaattgtttgtgatcgctttagatccatacaactactaatcttgcaaatggcattggagtaaatcattttcaccatagctcactaattgtttatcagttattcatatcaactaccccttaaatggcatacccatataactctacttgtgttgctatgttagatgaggtgacaaaaaatgtggaaactgcattggaggttgtggagcacgccgcggaggtgacagagaagttagctgctaatgtggccaatgctctaccagagaatggtaccctgcataagttggccgaggaggttgagtacattgctgagatagtggataaggatgcacagaaggttgaaatcatcataaagaaggtatgtatgtcaattgttgtgtatatatatcatcatgtcaaggatatgtatattagtaatgagaatgttatgtccacggtacatgattagcatgctttctgtttagatgtagtagaagttacagttagaaacatcatatgcaattacatgtttctgaccatttcagactattgaattggcttttgactaaaggttagtttgttgttgcttgcaaggaaccatggacagattcaattctttttttcagcagcttcataaactatgaattggacagattcaattctttttttcagcagcttcataaactatgaattagacatggctttgggctggggaaagcatatgttcactttgtactgggaaagaaaacaaagagagttggacatggcttctctcgaaacaagctttggtagctcaattataaattttcaagagaactctagcatctagatgagatgaaaaacagcttgcttttgttactgtatacactatacatagtttcttgttgtcattacctgaattatcaatattaaatttgactgtttaccattatcctgttcatgttgcagattgaagatgtcagcaatcggatagacgctgctgtggagcctgtcattgaagagctcgaaaaggaattcaaaccatagccaagcatctggtggatcagaaggcccaaaattattcttgttgtaaatatcgttattttctattttgttctttctaagcatctattgtgtacatatatattgtgatgccctaaaatgaaaccacgccgtagttctagcaagactaggtgatggtgtgttggatgctcgaagctgaagcatcctgtaatctcgttgtaaaatacaactgaagatctaaaacagtatatcggattgaaacttgaaagaacatattcttctgctgttgtttcatgcgtgctaaattactcttttgatgttgctaattattttttccctttgtttgaagggaggccatgaaatattaatcagggttagcacactcaaaattcagactgattggattgtagtaactcgactatcaattgccttgccaccaaaaatctagtccagaaatctttatgtaaactggaagagaagtcaatcagatttattacttcaatattgacattccaagatcatacttctcacctagcttatgaattcaactgctcttctcacttcaaagtttcaggcgaaagagactctgtaatgttttccgtttcagatatgcaaagcatgtctttcaatttgcatgcgtggtacgatcaaatatgttcacatttgtggatggtatatttgacctagagatctggcatgggaacgaaccctctacgacgattagccaagattctcgtttgtctgcctgaaggaaaaactgtcagatgcatcagcttcataaagcttgtcaattcaactcgtctgctcatttaacagtctcagcgtgtctgtcgagtgaaggagacgagaaatgcctaggggtcttccggctagctccacaaggtggtgggctagacgacctggattcaaagcctcacccctcctaattatttgatattaggtccttccctaatattctagtttttcgagtgaaggagactatgccatgtttgtttttctgatatgcacaacagcacaagttgtcttctttttgcggtcaaatgcagtatgactatgagcagacatggttatattatagacttgaaatgtttgcattggtgagtgatgacaggcgacgaggagttcaatctgcactcactattccgccgccagctgccggagcaagagctcgggccacatctcagaatagtgaggtgttattggtgttgacgacgatggtcaaggagggcggtaggaggaggatggccactgaggtggaggaagaggacaaagcgctgctgggatggaaaaacggatctgggagatactaatatttagcccttatgcgtcaagatcatccctcacacggaatccctaggctacgtatctgaagcgcgcaagctcgatctaacagacaaacaagcgaccggttgagagaaatcccatcgatatgagttgcacgtgagagccatctccaacagcctccctaaatctcactctccaaatatctatttatcaagtcaaaatcgttgtttgctccaacagtctttccattcaccctctctactctaggtctatagaaaaaaatggtggaataatttgcatgggacccactagcaataggtggagtgagggagggcatgggcaatggtggagagagaaaagggaaaaagatgatgggcccacagatgtctagttcgtgtggatggccaacggctggccaaatttggctagcttgagcccatctttagccattgctattttttggctagggggatagccattccgttggagtacattttttgtccaaagttgttaaaatttggcttggagagtgggatggggaggctgttggagatgctctaactacgtaagtcgacatctcaacgcacgtaatccacaaccccgttgttaatcctccaataatccaactccctttccgacccaacaaatatgggcgcagctggttagtcgaaacctgttccggcctaactaaaatgggccgcacgtaactccgaataaaggaataagtttatataggtctcttaacttgacggcgcgtttgatcattatcattgaaccttaataccagataccatgaggcattcaactgtcaaaaccggtggacggcacaggaaagccgaaagctatacaagctcctcgccagcctacttcatcatcgccgtcgggcacaccgcatgccgcgcgtcgcgcacggatgcatcgaggtggcggcacgggcatgccacgccattgcccgctgccacaacgctgctatctgacccatcgccgctcctcagggacacctgtgtggtgaggcttgcgtcaccgcacccgcgctctccaacgcgctcaagcgggcgcgtacacgcaccaccgccgcaccggtagcgatggtgtcaagccagatgaccaccacatcggcttcgagatgaagagggatgtgtcgcttacatgtgaagccagagcagctcggcctcacagcttgcgtggtcgctaccaccagtgttgccgccgacgttggcactagcctaccccctttgtcaccctcctcgttggcatggatgccctcgccatccaagtgaagagaaaaagagataggtgaagagagagaggagtaaaaaggccttgacatggtgaggcccacgcttacttaacgctgttgctcgggtcaaattgctacgtcagacaaaccacccgctatattgtcatgggacctatattacaccagttttgatagttaataaacccattgtatatgttattgtggttcaagaatgagtatcgagctcgttgtcaacttaacgtgtgggccccacatgtcaggtctccacgtcaactctctctttcccctcctctctttctctgtttctctcctttctccctccctctcgctctctgctctcgcagggcatggggatgccggcgctagggcgcccacggcggcgcgcgcggccggggttggcgtcgtcggcggcggcgggaaatgggttgtcatcgtcgtcgatgttgtcgaggaggctgaggaggtcgtcggccgtggagatgat

SEQ ID NO: 40778 - DNA, 3982 bp, Oryza sativa
ttttacgaggccaccgagccgctgaccaccgggaaggcgatgttgttgggcgacgctggaggagctcaggcggaggcggcgctggcgccagcgtcggcctcgcccgtcaccgcgtcgtcggccggatctcctctcccgcctcacgcccgttggcctcgtcaggctctccgtcaaaaaggttgcggcgaggagggagtcggtagagggggggacgggaggatgtggcggcactcgatctctccgcggcggagagtgcggacgggaggatgcggccagcggaggcggcgtgcgagcgaagcagagtggagcggaagcggaagcgcggcggacggcggtggaggcaggcaacgccccacgcggccgcggcgctgtcatgggcagcccgcctcctcccgcgcgccgccccttctccccgccggtcgccttgtccccatcggctgccggcgccgctccttctcccttccccttgtcccagttggccaccgcgtgccatccttctccccgccggtcgccttgtccccatcggctgccggcgccgctccttctcccttccccttgtcccagttggccatctcgtgccacccttctccccgccggtcgcgccatcctcctcgccggcagccgcccatctgttcgttgtcaacttgcagagaagcgagagagagagatgaggaagggagagaagaggggaaagagggagaggacgctgacgtggacacctgaaatgtggggcccacgtgggtcccgtgttgactcagccgccacgtagaccaacactgggttaaaaccaccgaaagacctctggtgaccggttttgcatagttaagggacaccgtatatctggttattgcggttcgaggatattttttaatcccgatgacaagttgagggaccttcggtgtaccttttccaagtcttaatccacgttcaagggccgcatgcaaccggcccaactattatggtcgatccaaaactacgggtaccaatttaacatgtttctaaggtgtctaactgaaagaatgcccaggagagtccatcgtggccatggaagctcgatcggacggcgcttgtgaacccaattgtgtcttcctccctcccccaccaactcaccatggccgccgccatgtgtcccctaaccgacaccgcgaacggcgaacacccgccggttcgatgaatgaccacctccatgtcttcccttgtcatcgatcgcatcccgtgagaccggcagccagagctcctgccggtcaatttgacaaggcgtgcggcaccggtcggaggccggagatacgcagagtcgtcctctgacgaagacatcgaagtacatccatcgtcagcggaagtacaccgttcgccatggccaccgccccccttacgtcggcgaggttgacggggatcagaaattcagaaccctgtgttacacattgtcctttcgaacccgtacatcttggcgaaagtttcgccgtctccgataagagcgtcagcgagcagccattgctgatgtacatactacacacagatcacaagaatcttggtaacaagtatatctgtactaggggttgcagtggttgcagctgcaccggtgtccgtagagctcgggagtccttatctagcgtcgctgctgtgagccggccgtgatgtcatgtacctgcacccggtggcgttccggcgtgtttgtcctctgcaccactcacccgccggtcagcgcattaggtgaaaccgcgaaagtgaaacagtgctggactactgctagtatgctcgatatccgatcgatcgagctgcccccgtccgcccgtccgtcctgcagagagacacatcaccgtgtgtggaacattcagagagctgcggcaaagctaaccgtagacatcacctaacccatccatggctttgtttgatcgtatctctggcgctttggtatcagttccctgaacagccagcaaagcgtcgttcagctgcgtaacatctccttttcagttttcatttgccgatccgtggatacatggattgcttgtccaaaagcttatttgcagctagaaaaatgtggtatatgttcctatcatggaaaaaataatgcgacgggggtgtgactctgcgtgtactgcacagagggagggaatgctaccagctactgaaacaactttgcacctcctggaagctttgagttgcaccaaaggcattccaattacttttttttttcacatctgagcaaatttatagtggtttttagaaagaatccgatcggaaaaggggattgacaattcgacattggccaactctttatctggactttgtcacttgacttattctctggccgggcgtataaatagaccctgcctacaacctccgggcaaatgtgcagcagcaacagtatagctgagattggtcatctgacatccttatctccctctccctccaagtgcctaacccaactcttcccgagcctttttctgatcattggacaaatggccgtctcttcagccgttctcgttgggctactcgtcgtgagttgcgccgcggtggccgcagccacgaggtacaccgtcggcgacggcgagggctggacgaccggcgtcaactacaacaactgggccaacggcaagttcctcacccaaagaaaaggaactgggtaagcaaagctcagctttctctcatcactaatacatactccatctatcccataaaaaacgaatctagaatcaaatatgacatattttagtattacgaatctagatatatgtatgtctagattcatagtactagtaagtgtcacattcagtactagcttaattttttatgggacagagggagtagtcgcttgcacatatactcacagtctcacacacacctacgtgctgggaaaacacatgtgttggtgcagtgttcaactaccaggcgagggcgcacacggtgacggaggtgagccagaccaacttcgacagctgcaacggcaacagcccgctgagcaacgacaacgggggatcgaccaccatcaggctctcctacccgggcatgcactacttcatctgcaccatccccggccactgcagcagcggcatgaagctcgccgtgaacgtcaacggtgacccgtcgtactctgccgcctcttcgccggcggcggcgagcgctgtcgccgccgcggcagcgggggccctgatcaagctcgcgctgttctgatggccgcggtgcatgcgagccagggtagagacagtgcgtggaagccatgcaggttcttgtcgatcggccgttgcacgttggtgactcgtgcaatgaagctgaccgtgtttcttctcgtttctcgtgtgatttggtcaccgtgcaactcgtatgtagtaatcaccttagtttggtgtggtgattctaaatttgcttgtgccactggtgtatcgtcgtgtttgggggctctggttatgcatgccatggtttgtgttggtgaaatttcttatggtgggtataaataaaaccaagcatgttaaaaacatgctggtggtaatggtatagtcgtggttgtataactataccgaagtttaattacttgacctttgtaatcacagcttgacccctcaactttagcctttgctctctatacttgttccagcagttgaatccctgttgggtgtatacatccaagtgaatgtagaagccagatttttaattcattttctaaaaaaaaattccttgttaggccttgtttgtgtaatcctcagtcacccaactagattaagggggtttcaaggggattagttaattccacactaaatcccctgcaattctatataatccctttcttatgagaataaacgtataaggccttaagaataaatatttccctttactatcctccagcaaatcacactacacgtctttttaccgttggtgttctaaactctcgaagggttatcctcccgttatttgcatgacatccaaatggttatgaatttttttaaaaaaaaatcaacaaaacatattagtatatgataattcactc

SEQ ID NO: 40779 - DNA, 1756 bp, Oryza sativa
cagacaattggcatcattcccctcaacgtcgattagcccatgaatggcaaaaacaagggcattacttacctgggaacgcatgaatttgacggcacatttggatcccggattctaaccgggcagaagccaaagctagtgaaatgatgtatggtattggttgccctgcacagcattcccttcttccgaaatcatttgcgtgatcagtagtgatagtagaaaacagcgatcacgacacacacatggcatggcatgtgcacacgtaccaaggtatcgtcccgtaccatccctttcaccaccaacctggctcgttgagtcgtttgtaccatcgtcgtcggatcacacatctcatcagaccgcgcgctctaccactctgtttccgccgttccgcggctgtgttcgattacacttgtcgtgggtggctaattacagcatggttagttagaagttaacttaaaaaacttaaaacttaattaatatgatttttttcaaccaacatttctataaataacttttaaaagaaagtattcacctcgttttaaaatataagggattttgtttctccatattcatggttttatgatatgtcacatccacctaagttttagaacggagggagtattatttagattgtttggagaatcgtgcgtgtgaaaaactaacgagtactccctccatccctaaataaataaaactatttaggtaaaaatgtgactttagctagtacaaccaaactgaaatcgcattcacatcgattgttttttttggacgtgagtgagtaaaagttagaaaaggagagagaacgaactacctaaacagctgacgaccccgcgttgcatctgctgtgctgctgcttgccgcgccgcacgcagccgtccgtgacgctgcccccccctttgcttgcctacagctaaataaagccgcaagccggcaccgcgcgcaaaccgccgcccgcacgaaaaggacgggagaaaaaacacagcaaaaacaccgggaaacccacgcgcgcgtcgcgtcgcgtccgcctccgctcgcgttgcgcctccgcctctgccgtctgcgggctgtcgctgccgcgaggatcgggcaccaccaccggcacgtgccgcgcgggcctcgcctcgtctcgacatctcgccatcgtgcggcgcccccaccgaccgacccggtgcccgtaatctatcgctgcctttcgctgctccccagctggctagctacaggccttttcacctcacgggatcgacgcagctgagcgaaaatcccaccggaaatgctgtgaaatactgggccagcgtacgtaccaataattcctcttatttttagatgggagtattaaaggagatcgaccagatctggagcacagtgagtgcatcatcagctcagatccatcggtacagcaacggatcgatcggctgcagtacgtgtacataacccaaacgaaaacgggggctcaaagatctgatctgctggtacgatgatgctgcaaggggtaatggagaaagattaaaaaaatggggtgagtgcgcttggggaaaataaaagagagtaaaaagtccaaagtgaaaggaatattgaacaacgggagatgtatagtacaatggaggagcagcacaacaccaacccaaccaaccaatctgtccacgccacacgcccacacacctactgaatcgaatgcctgaatggaaaaaaaatgcccaaaaaaatggaagaaaaaaaagatagagagagaaataaaataaacagctcagggctgcaggaa

SEQ ID NO: 40780 - DNA, 999 bp, Oryza sativa
cggcggcggcgctggggggaggggtcacctcggcggtgggagacggggccaagcctgccggtgacggggctggtggcgagctgatctccggggtgggagccgcggccgcgggcacgggagccggagccgaggccttgggggcgggagccggagctgaggccttgggggcgggagccggagccgggggaggagtggccggggcctgagccgggggcgctgacaccggcgcaggcgtcggcggcggcgtcgccggaggaggggacgccttgggagcgggcgtcggggtggccgccggggcctgagctgatgcggcggcgaagagcatcgccatggccaaggccacgatctggaagcgcgccattggagtagagtgagagagctagctggtgctagggtttgggaggagagtgtgtgcttggggagaaggtggctactagcttgaggtggtgtactgtaatggtgtccgagacagtagaggtaggggagcttataaagaagtagaactgtaggagatgtggtttactacatgaaaaatacaggtattatcagggggtttagtgctaattttccaacactctccgttggatcggaatttgacggtcgagatgcagttttgttgcagattgtcggtttggattttgcaagcttttaaacctttcttttcctggagacaggaagcttcatccgaatcatcccaagtgtgttacggccccatcgttgggattattgggggtataagccaaacagtatatttacaaataaaaaataatttgtatataaaacttttatatactgtttttagcgatctaaaaacaaaaaacaaagtttaaaaaataaactacgatgaaaaaacatctaaaattaactccaaatctaagattaaaaagtcaaatttaagtataagaaaaagatgaggctggaagctcctcaaaattgtagaaaatctttctcacatgttttctatctcaaaaattgttttatatatttttgcgtgattat

SEQ ID NO: 40781 - DNA, 5102 bp, Oryza sativa
tggctacaacaatatttaaagggtagaaaatggtatatctcacatcctatcttactataaagttatctcccactaactccttaagcttaacatgtaaagatgccacatcattatccactaacaagatgccacatcatcatccactaacaagatgccacatcatcatccactaacaatcatcacatttaaacatcatgcaaacatgctatatctatatagtttttataatttaagagcttttcaaatacaaacatattaaattatcatccaacataattcacataatgtttcaatgtatatctttaatatgttttatgataccctatatacttatatagttcatactcacttagtgcttaaatgattaatctatggtctaaattatatttctctttttttcttttaattaagtcatatcacatcaattgttattaattgatgggtgggagaggaggcagggcaccctcctatctgatatgggccaagaccccatgtgaagcccattaggaagattccagtccaagatctgtccggtcgagagaatcaacgatcaacgagtagagaatagcgattcgacgactcggcttcttccttaatcctcgtcctatcttttcaacttcacatcatatgcatgggagcggccattggcaaagtgatacaagacgcacgcggtgagctcctctccataatttgtgactcacccttcaatcgagatcacgtgtatctcagccattgagcacgcagcacaccaaacgtcgccatcggacatagcacggaggtgtgtttcttctccattatcccccaatacagcaaaatatcctaattgcttgacttttagttttctcatttcttttatttgtacggtagtcatttgtccctaatttagaaacatagataatatatacatttagttgattggtgagtactggatttttttttatttcctatcttaatttcagccaagatagaaaggaaaactctcgattgcttgcctagttacgttttttttatggcaaaacatatgcagcctggtttatgtgatgtttgcgtcttggaggctgcaggagctatatgaacacttgatccttcttttctatctctaaaaacattttggttaattatctagctacaatggagccatggaggttatagtgtgttacactagatactgtatgtatctggttgttacggactttggccgtttggtcctgtggcttatcctccccaaatctcaaatcctaacttcatccctgataatgatatgattctaaatagataaatagtaataatattatatgattttaaatagatgaaaaaatagctttattttagaataagttattatattaaatatatatatatatacttcctccgtctcataatataagggattttgactttttatttgcactgtttgaccattcgtcttattaaaaaaatttaaaattattatttattttatttgtgacttactttattatacaaagtactttaagcataacttttcgttgtttatatttgcacaaattttttgaataagacgagtggttaaacagtgcaagtaaaaaaaatcaaaatctcttatattataggacggagggagtatatattttagaaccgtggaagtagagtaaaaactacttgtacggtagccacttgatcgatgccgcagccacacgcaaccaacgtcgtgatctggcgccggccaggcggccagcgttgcacgggatcacattcacatccgcccctgctgcgcgctcatgcggcgtacgcccagcctccatgctgtaccggccgaccgcgcgagatctcgtcggacgctagccgccgcccgcgagagccgacccacgcgcgccgtcacgttcgtgcggtacgtggtgattaagttgggagaaattatccccggcgggccgtccttcgcggtgaaaactcatgcgatgtgcgagatatgcgtgcggcgtgccgatcgtcatttcgtggccggttatatgcgcgctagtagtacgttgctggtcgatgctgctgcaggtgccggttgcaacagagaaccctggaatctttgacgcggtgtcgcgtgcgcgcacagagcatactgcatgcggcactgtgctggtttacacgagtacaggaagaggaacgtacctacgtgctacgattactgttacagacgccgacctagtgacaatggcacggtgtagttactgcagaggacctgatcccccgtgggcggcgcggaagttgcgtagcaacgaataagttcacctatcgtataacatcctaatccccaatataaaaaatataatcttcacttctaaactatacagctatgcaaagtagatcctatggtagaaatctttactgacgtggcatcctaatcagaaaaataaataaataaatgggacccacatataagtgagaagaaaaaaaaattagggcttgcgctctctctcttcccccctactgcttggtttgcttccccttcgaaggacactaccatggcacggcgcggggtgggtgtgtccccggacgggccgcccgataactatggggacgtcgtcgtgcaggagcaatgtcatgcggcgcactggccacaaacacatcgcggactacctcgccatcaaccagaccatctccgacaacaagtcctacaccaccgccctacggcgaggagttcttcgtggctgcggcagcggcgaggaggagggcatgctgtcactcccaccagcgccacgctatatggcgtaatagctctaatcctgcatacaaaagatccaccaaatgaaacaaaatgttggcattttcatccagcgcacgaacaaatccaactaggcaccacatcacatccatggcaattccagcacaagaaagacctgacagttaaatgagcatgtgatctatgttagaaaacgataggcaaacaaacgataaaaaacaatagatcaatcacagaagacacgagatttaacgtggaaaacccttccaaatcaggagagaaaaaaccacgggcggtagccagcaaaatatcttcactatatctgaggtgaggttacaacgccgcacggcggcttacaagaggtatatatatggtggaaccctaaaaaggatgacgatccgtttcgtgggagctccgcccccgcacctccggaggtggcctttattaaatatatatatatatatatatatatatatatatatatatatatatatatatatatatactccttcttcctagcggataatccatttgcatctaattcaaccggctgaaaatcaaattgcttcatatgttgcttgcatgcacggcaggtgacgcacctgattttggtaaacatttgaactgcgagtgcatgcatgcagttagattcaaatttcataagtacgtacgtacagcagttactttctactcgcagcatatatatgtaccctattgaaaaccagtatatacgataaaaggcagtttatgcctatgataaaaagaagtatatacccgtttgttgaaaaagctgtacatactgtttaggatatcaagcagtatatactgtttttgttaacgtgcagtatatgtctcattggagtacaaatatactgtttttcctatagactggtatgtgctatactttttttaatttttcatgtacaagtatatgctactttttttttcattgcagaagtatacacacacacactgaattcggaattaataagtatatactgattgcttcttcttaattgggacttgcatactggaatgacccaatataatgagtatatatatcagggttttaaatcttccgttatagctctttgagaagggttctagctatttgctctcatgtactatttagctgctatagctccatttagcccgctatagctgccgctatagccgttttagaagctaaccgctaaatgccttagtccgctatttaaaacagtgatatatatactgacttttttcagagtaagtatatactaacttttctcggagtgagtatatactgatttcttcttagaacgagtatatagactgaatttttctcggaactcagaacgagttcatgaaatgagtatatattgatttctgtaagtatacactgaaacaatatacatactttctttcgacaaaggtagtatatataccactaattcgagatagtagtatatataccaaattcactgcattactagtatataccactttacaggtaatgtactttgattctttcagtagcaggtagtgtatccttcaaataaagcagcagtatgtactactttgtgcatagcagtatactgttttttactgtttgttttaggaggcagtatatatatctattcactactacatatcggaagaaattttacagagaagcaatatataacaggccacaggccacagcatggcagcatcattagataatccgccgtcgctgccttgcttgacgcatgtggccatcgctcgatcatgtcgctgcctgcatgagccatccaggccttcggttcatagctggaagctaggacgccgacacgccgttgccgcttggatccagctacgccgcttctgctttagaggctggcactagccgcgcacggcgtcgctgctcctcagaacctcgcgctgcccatgtttggactgcaatctttgggcctggcgtgctgattgccggcgccgccggtggtcgttttgcacgcccgccgacaccatcgcgttgaacgaaaggccgcaccagggaacgacgaggtggatttggtgccgctgcggatgaatctcgccgccgtcccgtcatcgctgaatcacgccgccccctccgagacgccgagaggtagatatatatgctgctgaaaaattcagaatgtattcagttctctgggagttggaacaaatgcattaggtgtcgcctctgactttcggcagatcgatattagctctgaacctgaaatcaaataaccataaacatggtgcagtacgtgtttctacaggacgttgttgccgtgattcattgactagacacaccatcgttgatcgaggatccgtgtgagcagctgccatcgttggacggtttggccggaaacctctgccatgattgatacggttctcgtacgat

SEQ ID NO: 40782 - DNA, 746 bp, Oryza sativa
attgtaattttggttttgtaaatggaatgggtagcacatattatcaaggaggcagcttaaacatctcagagtcaggaatgacagaatttacttgtggtgctgatagtttatatataatattagggaacaagatatacctgcatcctcaagaatcctcgcacgaatctacaatatggcatggaaactttcttattcaccaacacagtgagaaaactgacaaatgacacaaaatttagctggatgataacatactctgggaatcgtccttccagaattgacatgtggaggtctctacttaactgaaataaaagtggatgatcaagcggtgacacttaaaaagaaaagttatgtggaaatattcattaatatacccgcatcataaatgatagattgtgatacgacagcagttgggaacccatagcatcttttgtgacaagacaatgcaagtaagcacgtgtatagtttttgcagacctgaaaagatagtcaagttatagaacacgaaatagaaacagaaaaagaaaaagaaaatttcgaagcagtttaacactttgttcccagtagaacgaagccttaccatacatggacaggtcggatctatcggtcgttcatcagttgccattgcgttttgtttcaacttcagaacaccctaggagatatcacaataaggttgcaaatgctaagattagaatcaaactcagaggaaaagagaaacaaaattattgtgagcttgcttccatatgttaa

SEQ ID NO: 40783 - DNA, 723 bp, Oryza sativa
ctatgacataccctggaaggttccgctcaaccaagcccttcacgcagatatctctggaattacaaaaaaaaaaacactattgattatttcaattatgccttaaaggattgatatattacatgattagatggatgaactcacctaagaactggatctaatcctccttgtacaatcccaaataagttctggacatcaggtttcttatgagctatatgtattgacaaaagaaaacaccagaccttagctaaacatgcttagcattattgtaaatgttcttttcttaacgccagtaaaatacatagcagaattagagtcataatcaaaatgatgctaagctctaacttaacgacaaaaatagtgaaattaaacgccagaaaagtatgaaatacgggcagtggcaagtcatattgataaccataccagcaatgcacctatcaatccaacgaagggtacgatacatagcttcctctatccttgggccagtaattgtggtcttcacaacatcatcaagagccattattatatcagctccaatgttgttctgcattcatgttcaatggataagcatacacatgataagatgtaaaactaccaaatctattggcgcaaaactctaacttttacaagtacaaatcttgtctagaaaaggatgcacctgaatatggatagattcctcaggtgtcaagagcatgggcttcccatcaacaggtgactgggctgcag

SEQ ID NO: 40784 - DNA, 1541 bp, Oryza sativa
ggccagtctatacggttaaacattataattattaaaaaactttatacaacttttaaactttacaatagttaattcattcatttctatcctcaaatattatcacaaaatcatacacaaatatagtataatctatcctcccttcatcatattataaggtcacgtttagttgttaaaaatttttaccctgcatgtcacatcggatatatagacacacatttgaagtattaaatatagtctaataataaaacaaattatagattccgctagaaaattacgagacgaacttattaagcctaattaatctatcattagcatatgtttactgtagcaccacattgtcaaatcatggcgcaattaatcttaaaagatttgtctcgcattttcctggcaaactgtgtaattatttttttttctacatttaatactccatacatgtgtccaatcattcgatgtgataacacgaaaaattctgtttgggaattaaacatgcctaacataaaattttgttaagaaatcaaatcaaacatagttacatagatttggtagtgtccaaatcaaaatcataccgggtaatttctcactgtggaaccaaagcagtgagtagaggcagacaagccattaaacaaagtgcaaatgattgactaataagagcccaattaggcacctaaattacagcgtccctgtaacaaacagcagcttgagctcactgcgctgctcaccccgtactcgtcgtaatactttttttaatctcttctcgaacaaactccccctttttatcacacacacactctctctcctctctttctcgcccgtttgcccaccaccaccaccaccaccacctcccctttcccattcgaccaaatcggcgaggggaatagcccccccgcgcgccgcgcctcctctggtcgccggcgatggccgacggcgaggcctcctccggcgcgtacagggagttcaaggcgctgacggaggcggcggaccgcaagttcgcgcgcgcgcgcgacgtgccgctctacggcggcggggtggaccaccacagccggaaggcgttcaaggcgtacacgcggctgtggcgcctgcagcaggagcggcggcgggagctcgtcgcgggcgggctgcggcggtgggagatcggggaggtggcctcccggatcgggcagctctactacgcgcgctacctccgcaccgccgagccgcgctcgctcgtcggcgcctacgtgttctacgaggccatctacagccgcgggtacttcgccgccgcggcgcaggtggtggtgggcggcggctacaggcaccagggcctcctgatccggtacaaggagctgcggttcatcgcgcgcttcctcgtcgtggccatgctgatgcggcgggccgaggcggtggaccacctcgcttcccgcctccgttcgctcgtcgaggagaccaagtcggcataccccgtaagaagcttagctcctctcgtgctttgaataggggaaccccgagttaagtttgtgcgcttgctgttttgtattttaggaaacctaaggagtaaggagacc

SEQ ID NO: 40785 - DNA, 4312 bp, Oryza sativa
atccgggtgaacgcccgcgccgagagaaaccgccgccccggcgggctcctctcgtcgtcgtcctccgaggacgacgacctctcgccgccgctgccgccgccttcgatcccgacgtccgccgcctccatgccatctgcaaaatcagcaaaatgaacccacacattaattaatttgcacacgtatgaacccagatgcaatgaaagataggagtataacgtaccgagcaggttttgcagccacctgatttgcttgagggtcggcaaccctgctttactccccgacgagaagacggcgtcgcacgcgtcgtacaaccgctgcaccttggtttggtggtcgtccatggccacgcgctagctgtgctgccacaggaagcgaagtgacccggctggttttaactttcacacatctacactacacaaaacaaccgagcaacctgcacttgtacacacgtatatatccagcgcgtagtacatacgtgcgaccgcagaaagctgacggtgagcgcgcgtggcgattgagagataactgtgcaaatgcaagtgtgtttcgtgtagtgactacgaagctttctacctagcttcgtgacgtgcgttcgtgcgttatgaggcaggaagaattcaagaatttcaaggggatcgaagggtcgcgagggcgtttaccggcggtacaaaccgtgggcgattcgactttacagggggctggctggctcgctctgcacgcacgcaccggtaggcgagctgtgcgatctcctctgctcgtgtacatattgtgtggcttgatcgatgcgagagtggatcctaaatcctcgagaagatattttctgtttatatgtatgtcatttaaatgactatgaaaaaaattaaaaaatataataagataattaatatataataaatcactctataaaaataagttaaaatttaatttctacatgttacaacgaaaaaaacaaattaaactatgaccagttaacgtatattcacagtcaaatttatttttttcgctataacttgtagaagttaaatttgaccttgcatatttgtgaaataatttatcacatattaatctatctttttaatttttttaattattttcatgacatgcaaataattagagattagctagagttaaaaatagttttccgttgatacggtcatcacgaaactactgttcgcgatactaaacaatcggcgaatgcagctgggtaaataggaacttttggtcgcatggaatccggacacggccacacgggccattttatttttcggtttttccatgtgggcgtcgctgttcggttctgcgaaaagagtttgaaaacggcgtaaaaataatgtacgctaaattcttgcaggggattgattgatctgaagaggggcagacgagcttggatgcttggttgcctggttggaacttgctactgcgggtcggttattttatatcgatcggcatgcaagattacaaaaccatgggaacgctgcactgtgcatgcttatccgttaagcatgcggcccaggctgggataatactactcacagaccgggtcgttcttgggcagcagtttaatactagtagtatattcaaaaaagattttgagtaaaaaattcagttttagcagcaagccattgggtgcagtcgtgcagagcggtttatacgctctggagctggagcaaggtcgctgccctgtttgcagttggcatggcggcgatcgatcggagcacaaagttcatccatcggacaacagattgacccatgatattacgccatgcaacgcaactccaagaggacaaagacagagaaccaagaaaccgaagcggaagacgagaacaccggcgccgtgtcgtgcgcaaccactctgcggctcggctccgtcgtcgccgaccgtttccgattcacgcggaagcggcaaaacgctctccctgccgcgccgtctcgcgttccagccaagcgagcctcttgcctcgtcccgcgcgggggttcggagtagcttttggctactttataaccatccgattacgggtgcacggtcgcagatcgtggcttaacttaacacaattgcgtgtatttttgcaaaacgtggcattggttggcgaggcaacggcgagttggtgacgctggcaacggtttccggctccggcggacggcggcgagctgctggagtaaagtggtgtgtttgcaatccccatgttcccaacccctctccctcgtttttcgcacgcgtgtttttcaaactgctaaaccgcagcttttcttgcaaaagtttctatacgaaagttgcttaaaaaaacaaattaatccattttttaaaaaaatcagcaattatttaattaatcacgcgctaatagactgctccgtttcccgtgatcactgttccgattgggaaccgcttctagcaaatcctgctcatgcttgaactaagaccttgtttagatcctccaaaatggcattttgccattttgtaacactttttgccattttggatctaaacactagtagcaaaagttggtaatttggcatttggcatttgctagtccatagtagtaaattgtgccaaaaagtgctttgggaccactccttctctctttctctctctctcactttagtgctagaatggcaaaactttaacatgcatctaaacaccaactaatacttttgcaatgccaaaacttttgccaccaaaatttttgctatttgccattccaaatggatctaaacatgccctaactaatctgaaattggacagacgtgtttggacaaaactctgaatttgatagcggcaattagtgcgacatgtatatcagaagttcagaactaagagcacccgcaatggtaaaataaggtgctctctataaaatatgtacatctcagcaatagactagattaatagtaaaccacctcaatagtatgtctacatgggtatctatagctctctaatccattccctcatttttctctatagactatctctaggttagtagatagttgtgctctctctctcttcatttaatctctttcaagtagaaaaatatgctgatatggatctcttgtagagagcctatagataaccattgtgggtgccctaagctaaaattcctctgaaatcgttgaaaactgtgtctcatccacaatctttcatcaaagcgtacgatataatagtttcttatcacggtaaactgaaacaagcgagagtcagatatttaccggatgaaccatcactccgtcagttcgtcatcagcggaagatagcaacaagcattgcagcaccaaagtctaaagatcagaccacgtcacgatctgccggcgacggtgggaattggggatgcaggaggttcaaaagttttgcaaacgaaccctcttttccaagtctatttgcccattacaactcctaagggggttcggaaaataaaactccgaaccccattggttattttccaaccattggatcacatgtagtcctcctctgacctctcttcttccccacagaggcgcagacacgctctgtctctcagtcttgagacaagtgcgaccgtaaaatcaatctatgattggtgaactacttatctgaatgaatttagagagtcgtatttaagacaaaattatatatgaaacatagcaacagcaaatagagcaacgagtactttttttttccgaacgcacaaagggattacgcgtcaatatattagaagaaaaatagttttaattacacaacgcaatcggccaaacaggcctatgccgggaggtgggggaggaaaaaccaagaggctactgctaaacataggctactcaaaacaaacgagagatagaaggctgagccacgctacacttccagtaaaccccaaaagctgtaattcttctggaatcgtagaaaattgtggatcatctctaaagcactcatcaaacatgcattcttatctcaaaacactgaaacaagcgacagttacatactcaaatgaaccatcactccatcagttcatcgactgaaacaagcatgaactgcaagcgaactcacgatctgcatcaccagcggccgtagccgacggcggcaatgacgacggtgggaccggtgaggctgggaggtgcggaaacttttcaaaacgaaccctctttttcaagttatttacgcgttacaacttttcccaaggggtacggataagaaaactccaaaccccttgggtgttttccaaccccgcagaggtgcagacacgatccagttctcatcaccggcctcttcgattccaaaggttccagaaacttctacaaccataggtccctcgtcgcaatggaggttaggagacttggggcatgcttagctccac

SEQ ID NO: 40786 - DNA, 1800 bp, Oryza sativa
catgtgttttgtcctgtcggtcgaatcaatcagggtgcaagcatcacataggtgaaatggctgtgcagctctttcactatttgatcaatcatgcttagatagaaacggtaaaaggtcaatcaggtaaaggaccctgttgtagaatcttttcttgggtcaatgagaggacacagcttgcgtcctattttcatttctttcttatcgttttcttggtatcgttttgctttgctttgctgatttgatgttcatgtttgtgctttcctttaaaggcttctatcttgtttattgtaacgaactgattatggtacactgaaactttttaaacccatcactttcaagtgcccaactaaaggcctgattgagcattttcttttgttgggcttctattcctttacatggtatctgaacttctcgtaatatttagaatttcggtatacacagcagaataaaccgaagaactatttttagagagggctttttggctatttgcatgaacttcacttggttgatcacaggatggaggagcagaatgaacgttcaggaaagtaacgggcaagctgtgtggccacaagatggggaatctttggtattttggcagtaattggtgcttcacaagggaaacagaatcctcgcaagaaggtattgaaatagctcctgtcaattgtgtcaggtcctaaggaacatggtagcacccacaaggaatgtcatgtgtcatgtctactatgcaattgttctctagctagagcatataagtattcgtagttttattttcaaacgtaacgtacacagctaaccatgcatgcgtttcacttgcacactccacatatgaacaaatcagtccattattatgaaatgattcaacactaatgattaatgaaactgctaagtacataaaggcacaataatattagtttgcacaaggaagtggcttcacttgctagaacaactaatcatcatcattcatacatgctagtaaacgtagttggttggtatgctaattgctaatctaaactacagccctgctcttcttgaatcttctcaatgatctgatgagcggcggttgcaatctcatccacagacgtaagctggcaatcatcctccacctgccattgacgacgagatcacttgagatgacgatccattggcaggtcaaacaatggcccttttttagggaaccgcaaccttttagctactccagctgagctccattaaagtaaacagatgggggaatttggagcagttgtgcaagacaaagcaagatacaaaatgcacggaaacctaggcaccaacaacttgtttcagtgtgatattgctaaccagatataggtactatgcatcttggattgagagccacacatatgtttagtttgcaatcagatcaaattgtttagtaatggtactagatgtgaggaatgcgtagtagattgtagatttgtagtagtcgtacttggattttttttttaccttgaggctgaacgagtagagaaccatgtggccggcgctggtcatgttgaggtggagcacggtgagccggtggccctgcagcgccaccaccagccggagcagctgcctcggccgccgccgtgacagcacccgcaggttggcgtggctctccaccatggtcacctcgacgtcggccaccgccgacggcttcgaccctgacgcctcggcctcggcggtgcctgctccgccgtcgtcacggccgtgcaactcgttcacaacgggagccaccggcgccgcggcggcggcggcgctcatcgagtactgcgggaaggtgaagaagctggcgaacggcgccgc

SEQ ID NO: 40787 - DNA, 1911 bp, Oryza sativa
ctgcatcatggaagaaatacacactgacatatgttcatacttcatgggactaatagcattgttcctttttttcatgaatttccagcaaaatagatgctggcatacattctcatgggagttgagtgtttgatgacacattattacgaaacaggaccttgataaatgatagggtgaccatagccaggtcacgctcacatgaaaccgagacgacacctcgagctttgctgcccccagagggccctaagccctagcccattcattcctacagtaataactggaagaaattcctgaatgccaaaagtggcctcatctgccaaagccaactatgattcggcagttgttattagacattctctatacctgttgcctttttgaagtgcagactgctaatgtgatcaacctgttattaaccaaccaagccagcattggtggcattatttttatgctctcaactactaacttttctaaggctttgccttgagcagaatggaagagtatggagcaattctgtattttggtcctgtaaatggcaccccttctggtacaatatcatttggtgattccaggttggtatccacctacaaaaagattattagagcagatttagaatgacaataggagcggaaaggtgtgagaaaagagtgatcaaatccagccagaccaatcattgtaaaaattaaaagtagctaatgagcaataaactccaaaccagttttagcaggattgctagcacaagtaacaaccgtatacagcttttggttgtagaactgtatcagtactacctatgtctattcctgagaaattttgtggaaacttgtatatcttcttttaagagttggtatttgtccgagcgtctaatgtagtaaaattcagaatgagtactggcagcacttctacatatttagaaattacaaccacaccatgctaggattatgtaggaatttactttactatacgtaagaaatttagcaatgctgaaaagtatccataccacacggttccaacatttatggtgtggtggtgggggaattacagcgtccacaaaatagtcatgtgcattgaatgccaaatagatatctccaccagagttgtgatcatgtactctacagtaaaatggcaatgaaagtcagaagccaagaatttggattttggagcatcataaacaaataccataataaggtgcataaacgaaagtgatcaacaaacttacgtgaatgccaaaaatttgctttcctggttctcccaacaatcctcgtgccaggtgacatcgttctaccaacaaggaagatcacaatacaatgaagaacatttgagacgaaaaaaaaactaagagatgcaactgcaaaagctgcaaagtgtatatttgctgtattatactattctaatcagacttgactgagaaaatatacttggaatttcgacagacaccagcagctattttttgagaagatgatgaaatgattgtcttcaataaaccagttaattgcaatgatagcacttctaggtattacttactttattaagaaacctgtctcgtcttaatattgggttgctgtgacgaaactttatcatctctgagaaaaacctgaaatggccatctcttctttgttccaactatattcacatggattcggagaaaacaaattatatatagatctgccaaattcataaacatattcctggttgaaaactaaaatagttacggtaatgcaacctgttcccattggaaattattaatgcaagtatcatgtccatagctattgttgttcccataacgtgtatgaccatattcatcgcccatcaacatcattggggtgccctgatatatgaaaatggtgattatgtgataagtttatacatgatgcacacataaaataaactgtaggttacttcacaatggggctgcaggaa

SEQ ID NO: 40788 - DNA, 947 bp, Oryza sativa
gagctctcccgcgcagatgaggtcaacggcggcgggtccaccgcggaaatggtcaacgacgacgactgccaacggtggagagagaggaagtcggcgaggaggtcgcggaggggcgcggggagcggacgcgggcacgaccgtcgccggtgccgtgctgccatccaccaccgtgctgccgtgccgccgtgcgccgtgctgccatccgcgcccgccttcgtactgccgtgctggtgctgccgtcgagacgaggacgacgagaggacgaagacggagacggcggaaaatgtgacggattggacggaaatcgtgatggagtggcatggttcttattttaaaaatttgcagtggcatccagccgataacgcaaatatgtgtggcatttttttgatttgccacatttgcagtggcatggatccaattaaccctaaaaataattatttctgattcaaagagggatagccatctatggttgcatttggaaagttctgcacagctcatagagctatttggatccatcttgacattgaagcttcactactaggggcaatcttttagttctgttgaattacaagacattaaatttcaacaaaatcaatacaagacactaaatttcaacaaaatcaaactatgtcattctctttatgactatacctttaattcatacaaagggttgttttaataataaactcgaccaagttttctatctttacagtaccctacatcagtcagatgtatcaatttgatgggatatgaaaataagcatctttttgcagtttcatggaatcatgatttcaatgtacaaaagaaaatagatattcggtaaagcaggtaccttcaacaccacagttccagctaaagttgtcattgcatccatcacagccaccttctccattagcatcattgtgctatatgattttgataaaaagaaggcagattagcatacactt

SEQ ID NO: 40789 - DNA, 1810 bp, Oryza sativa
  unsure (1)..(1810): unsure at all n locations
tgttgtggtggcgggaaaggagaaaaaaacacaatttttgcgggggtctttttgcccccgcaagaggagggtctttttctcttttttgccccgggtgtaatggaaaaaaatttacccgggtttatagggaatttggtccccctcccacagggcccgggcccttaaagaggggggggccccacccctttttaaaagggaagaggtttctccggtttgaagggccctggcccccgtggggctggggccttccctcctttttgtctccggccaattaagccaagttagggggccgggaataagattgtcctatggggttcaacaccaagggttcattaactcttgggggttcncgttaagtaacaagcagggtcttatgtgcctcggggcgccttaaaccgaagaagaattgatgtagccttcaacttagtgaaggcccgtcaagcttcatccgtccaggtaaagggccaagagcgcttgaggagctaaaataaggggagcgcttcttctcccagcctcaatatgaaccgacttaggcgggccatgcaccgggtgacacattgcacatccctaagtttactggggggcgcatccgctttatagctcgtatcttctcggggttggcctcgatacctcgggcagagatcaagaacccgagaagcttgcccacaggtacaccaaacacacacttatcggggttcagttttatgcgggcggagcggagattctcaaaagtttccgctagatctgagagtaaagtctcttgattgcgcgtttttacaaccaagtcatcgacataagcctcaacattacgtcctaattggctacccaaagaaattcgagtagcgcgttgaaaagtaggacctgcattctttaacccaaaaggcattgaagtataacaataggttcctacaggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatcagaagcttaccgttcgccttgggaacgaccaccgggttcgccagccactccggatggatgacctcacggatgaatccggcctccagaagtctcgccacctcctcgcggatgaaggcttgacgttccggggcctggcgccgcactttctgccggaccggccttgcgctcggncgtacggcgagacggtgctcaatcaccctcctggggaccccgggcatatccgncggtctncatgcgaagacgtcagcgtttgcccgcaggaaggagacgagcgcgtcttcctatttgccgtnncaaagaccaccgattcgtgtggtcttggacaagccgtngnccnantgcacccttcttgaccggnaccctatcngacgtggctattncgctgccttcggggccgcggggggcggattgtgcccaggctttngtggcacacttngggctttgacaacaacgcgaaagcggtccgnacgcctgttcattacaanggagcggcgatattgaggtcccattgccagagattggaccgttggggccccggatattaattttgagggtaggcgattggacccgccccattgacttaaccaaaccggcccttcccaaaaacccgtttgtaggcaaaactgagtcccccccatttaaattaccccgttcccggcgcgaatttgcgggccccccaggggcaccgggggggtatttcccctcagctgaag

SEQ ID NO: 40790 - DNA, 2515 bp, Oryza sativa
  unsure (1)..(2515): unsure at all n locations
agcgattgatggaccatctnnnnnnnnnnnnnnnnnnnnnnnnnnnnnnnnnnnnaaagctataccgaaaagcccccctgttggtatttcttaacgatattactagaaatataattcccagcaatggcgcagaaatactcctggtatattatggttacggagtttatccacaagtacacggatataccattgtagcatttaacccgagagtattccaagagtatcatatttgtttaatcccgtgggaagattataatagagagaaccgtactaataatttatatattacttgtaataaccatagtctaagtaggggttagtataatccaaagggtagggtgacacgcaagcatagaactactcattctcatattaaattatctaagctaagtggaaagaaaatagaaaagaatctatttctatacttctagtatacatactgtacatacattctagtcatatgattaacaaactaataccctctatccgatgccctcctgatacttcaagaagccacccctagctgccgagttccttacgacagctcgtcatgaccatacaaccggggctaaatacggaggagtaccctccccaggaaattaacttaggactatatacacgcgcagaggaatagacgtactgagctgtcaccatcagcggcctacctctcatccacagcacgcctaaactaccagatactactttaataacatcgtcatgacatagagtaattgcataagcaaatattatacctgtacctatgcatattctagataagttagcagtataatcagtataacatgaacataaaataaagttggcattcatatactcaatatactcagaaagtatttcaataccagaattgtataaagaaaaatattctaaataaagtacaaatcttacaaaagagaaaaggagagctactagagccatacccgaactcttccgaagacttccggactccgatttctattctattcctactccactagcttgagactactaaactaaacttgagagaatatgagatagctgttgcttgaagtgtgtgaagaaatgaagagagtgagctccttaaataggcaggtaatgatggttatggcggttagaaaggtcggtaataccttccaaccgcctgtcacgcccagaaatttaggccaaatttccagactatttttgtgtataaaatccctatccaggactagctaaggtacacaaaatgacaagtaataaacagttccaaacgtaaataaagcgtaaaaatacttacagaagaggcacttagtcctcacaccgaaagagaacgacagcagcagaaaaaggcgatcctagcggggcttcagctccactccacaggcaaaactcaactggggtctgagccttggtcttctaacttcgtcttcagctcagaagcactacacttctaaaaagggggaaataatagcaaggctgagtacaaccaccgtactcagcaagccacaccaacgatgcaggcgtgcaaggggatataaggatggcttgtggctatttgcataaaggcgattgtaaaacattttattgagcaaaacggtaaaactgttgagtaattaaagtaatattaaatctccactgatcaacgctacaccacgttgaacaggcccaaccaacccacctgaactacagtgcattgggtcgatttattaagtatgagactaatcacggtgattctggtcgatcgcccataaccgcgggcacggctattcgaatagttttactctggccagaggtgcacaactatacccacaagacacaatccaccagcatgtcaccgtgcccggccagacacgtcaccatgtcgagtgattgtgacaagacccttcatataacccgctctgaccaagcacaccacaccttaagtttcatccccgcccctagcaggcagcgggcagtcccctctcgtgcctaggtgaatccggaagcaacagaggtcgtcgcagggaccgccccgctccatcacgcccacccttgcctggatgcgtcagccagagaaaagctatacttcaagtcaggcagttacctattcccgcttgtggcaagcgctgtatgtcttccagtgcatcccgcgaactggtccttaattgccatgggtgcgaccagcaaaaccatgcacccacagcccaccattcagtcacgttttagttggatacttacgaccaatgaaacatggtcgggtgtctcgagcacgcagctcgtcatgatactaacaggtctaatactgcaattatcccatcaactgagctagtggtaattaagcatggctaagcatatggttctagctgtgtcacataagtaacatgagctagtcgattctatcacccaaggtnntgacaaaagagccagatatcccagtaaaccatggcgccaagcaagcnnngatgaggtaaactcnntgatcccatgggggtaccgaagctcgaattcgcgcgctatagtgagatcgtggtacatctatncagtnnntcaatggcggccg

SEQ ID NO: 40791 - DNA, 1255 bp, Oryza sativa
  unsure (1)..(1255): unsure at all n locations
cgcgccttgattgacnnnnnnnnnnnnnnnnnnnnnnnnnnnnnnnnnnataccttgaggtatctgaaggatcataaaatttctctgactaaatatataggtcttaagtctgaattgcgcacacaactgacgcttctgttgtacatcaattcccagagctggagaagcacatcgaggatgcccacgtcctgatcaccaccccattccacccagcctacatcaccgcagagaggatcaagaaggccaagaacctggagcttcttctcacggccggggtcgggtcagaccacatcgatctcccagcagccgcggcagcaggtctaaccgtggcggagatcaccggcagcaacaccgtctccgtggctgaagaccagctcatgcgcatcctgcttcttctcaggaacttcttgcctggtcaccatcaggtaatgtgttaagcttcactagtccttttacaaccctatctagccctcgtatatttttagtttaaatagaaatagaaattcagtttatcctattttaaactcagtccttgaatttcgcagactaaaatgttaggttttttattatcacccatcagatcgttaatggcgaatggaatgtcgcgggcattgcccacagaacctatgatcttgagggcaaaactgtgggcacttgtggtgctggtcgcaatcgcaggctcctgcttcagcgtctcaagccctttcacttgcaacctgatgtaccatgacnaggtgaagaatgaccccgagcttgagaaggagaatggtgnccaagtatgaaggaggatctcgatgccatgcttttcaagtgtgaagtccgtgtgaacaacaatgctttttacagagaaaacaagggtnattcgcccttcattggcgtcttggctaattggttccaaaattcttgtgtagcaccatgtgctaaaatgaaaatggaaggccgtttttgtccaagggttgtttaacacacaaaggatttttaaaatgtaataaggaggtgtgcaattttgaacaaacagtctcggggccaaaaatgggtacccaccggtttgttgcccccttttccaccgggggacatcttggggggaccacactatttaatatttttttaacatttcgcaaaaaaaacgcccgcctgtgtttttttattggggcccacaaaaaggtgggaaaaaaagaaaaatatttttttttgggaaaaattttcccccaaaaaaccacaacaaaaacggtgggaaaaaaaaagaattgtgtgt

SEQ ID NO: 40792 - DNA, 4187 bp, Oryza sativa
  unsure (1)..(4187): unsure at all n locations
actgcccttgtttgcgtacnnnnnnnnnnnnnnnnnnnnnnnnnnnnnnnnnnnncggctccttgtctcttcagggcgccggtgcgggggtcacgttgacctctccgagcggtgacgtcctcaaatacctggtccgcctcgactttcgagcgaccaataatatggcggagtacgagggactccttgcgggactcagggtggcagctggactggggatccaccgcctcttggtgttaggcgactcccagctagtcgttaaccaagtctgtaaggagtaccggtgctctgacccgcagatggacgcttacgtgcgccaagtgcggcgtatggaacgccattttgacgggatagagcttcggcatgtgcccagacgggataacatgattgccgacgaactctcacggctcgcgtcttcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaggggagcgctcccagctcccttagattgattgcttggatcgctgagatccaggcgtacctcgcagataagactctacccgaggaccgcgaagagagtgaacgcgtccagcgcatctccaagcgctacgtgctagtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggtggtgcagggcgtgccagttccacgccaggcaaacccatcagccggcccaggccctgcagaccataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacagcccggtttggagtgcctaaccgtatcattacggataacggcacacaattcactagtgaactcttcggcgactactgcgaagacatgggcatcaagctctgcttcgcctcacctgcccaccccagaagcaatggtcaagtggagcgcgccaatgcagaaatcctcaaaggcctcaaaaccaagaccttcaatattctcaagaagcacggcgattcatggatcgaggagttgccagcggtgctctgggcgaaccgaaccacaccaagccgagcaactggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcagcgccacgtccgggcccaatcactctgcgtcgacgacctcgtcttacgccgcgttcaaacgcgtgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgagggggggtcgggtgtcaggtttcgggctcgggccaaccccgcacccccccctcgggtgtgcagggttggccgggggctgccacacatgcacattctcattttctcttatttcagtatttcaataaaagcagtttcaaattcctaagggctgtatctgtgccgttttttcctttttgaagaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcctttcgaggactgggacttgggcacgggcccttaaatcaagctaagacgcaaaaagaggaccacggcacagatcatcctcatctcatccgcatagcaaaataaaattaacacaaagaattttttcatcatttttgattgcagattataagttgatttatacaaaaaacaggcctgaaggccttagaagaaaggaaaagaaagaaattgaagattggcgggggcctgggggctcaatccgatgcgcctgggtcgccggcctcgtcttccacgtcgtctgcaccgctggcatcgccctcctcgtcggagttgggggcgaacgcaacccgaggggccgagccctcgaagctgtgaacgatgtggtcggcggcatcccggacttgtgcgcgcgcgctgtcttcagtcccaggtgggacttcgtccagcgccatccacagagagaagttggggtcctggcctngatagctcgcaaggacgagctccnccgctccttggcgagggtccctcgaggatgacttgatggtcttctcgagttcctcggggagctgctggagagccccggccatcttcgagaggcgctgggcaaggcctcccaggttggcggcaggctttattgtctgccctttccagaggcccgcctgccgaccggcgcgatcaagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcggcccgctggtccagcgcggccctctcggtgcggacggattccaaattgcggcgcgcctgctccgtcagtgccgcctcacggagggacaggctgtccgccaaccgttgcgcctcggcctcggcctcttcgagagcccgctcccgctcggaaagagcgtcctcgcggaggcggagtgcggactcctcttcggcgcaggcagactcgtgcgccgccagcgttgtctcccgggaggcgacggcggcctcgtggtctgccaggtccttcttcgcgacgcaggcgcgctcttccagcgccatggcgcgcgcctcgagggcctcctcacgccgccggagcgccgcttcggcctccgttgctcgctgctctcgggcggcggcggcatcaaggaccccctgggcggcgtcgagctttttctttagctccgcctcccagttcccgtgttgaaggcggagggtgtcctgcgcctcgttcatcaccgtggtggcgatgagggcagncccccgcttcctccttcacctttcgagcgatctccgccagcgccgtcttacgggcctcaagatcagagacgtgccggcggtgtgcctttgcggccgcttccaccatggcctncaccgagtgccgncctttctcgacacgcgcccatgcggngtngagctccgnacgcttcgncctggagggccctcaactgggcatttaacccatccaacaccgcngtgtttgcggcggctaaagccttgaaaagggctctgcgctcaacggggccacggaagcgtggggaaaaactgccttgagaaaaagccgcgcggttcggccccgccatggagccgccggcctcaagngggggccaccccggacctggttggtccttggcattcccccaaggaaggggcccaaagaaccggccccgggaattttcngagccccccccgaacctgtttgtccgggctatatccccaggggtggggccaaaccaggggcccccggctctttngaaatggctttgaagggccgggccttaaattggaaaaccgagggggttcctccaaaggttttttggtttggagaatggggggcttttcagagggttn

SEQ ID NO: 40793 - DNA, 2306 bp, Oryza sativa
  unsure (1)..(2306): unsure at all n locations
cctgcccttgattgacgtacnnnnnnnnnnnnnnnnnnnnnnnnnnnnnnnnnnnncgagttgttttgtctggatcagccgaccgagacagagcaatcttctttaatcataaatgaccagaaaaaccataccagttcatcacaatggaccgagtcagagtcattacatatttttcattgttgcgcacaggattcaccatgttcttatgggaaatatttttaactctcaaatggttatgattttgaactctcatttttgagagagaattaacaagcgagcgagcaatcaggccaaaaaggagaaagaaaaattatttttgttaatttgtttttttaaggtagggtggaggagtcattacatgatttttttttatattccctcgttgattatatgctgttcaaatggttatgatttttttaaaaaataacaacaatacaaattagtatgtgatagatcatttcacgagcatgtaggattaaatttaacttctgtaaattacaaaacaaacaagtttaactgttaatatacattaaatttgttttttttcaacttaggaattgaattttatgtatatatttgtaaaatgatatattaatttatttttttaaaaaaataattatttagatggcacacaaactagaaaaccaccgcagttctcatatttcttgtcctatctgcacttgcagagctgatgctgctgggcttcatatccctgcttctcaccgtggcacaggcgcccatctccaagatctgcatccccaagtcggctgccaacatcttgttgccgtgcaaggcaggccaagatgccatcgaagaagaagcagcaagtgatcgccggtccttggccggcgccggcggcggggactactgctcgaaattcgatgtgagaataacaccagctgccggcaagcacaacctcgatgcaataactaatttaactataattgatttttcttgggttttctgcagggcaaggtggcgctgatgtcggcaaagagcatgcaccagctgcacattttcatcttcgtgctcgccgtgttccatggtacctactgcgtcatcaccatgggtttagggcgcctcaaagtgagtttgtcgttctgtccctcatgcacatgttttctctagttctagcaagattgtcagtccttcaaatggattgtttcgacaagaaacccaatttattaatttgccagtaaatatataataattggtctttcttggttttagatgaagaaatggaagaagtgggagtcacagaccaactcattggagtatcagttcgcaatcggtagtgaattaagaatctccctaactatttcatttcagaacctttatgataatgtcttgaaagaggaggagcaaatcagctgaaaaatatgatcgatccatgcagatccttcacgattcaggttcacgcatcagacgtcgttcgtgaagcggcatctgggatcattctcaagcacccctgggctcagatggatcgtgagttatcaatctccgaatacatgcttgttttttattcttgcaactggcctagctgttccaattcaatccatattttttgaaaaaaaaaatattcatgccgtgtttgttgttaggtagcattcttcaggcagttctttgggtccgtcaccaaggtggactacctgaccatgcggcaaggcttcatcaatgtatatactaatcaaacctgaccaattcaacattgatgatgcaaacagagaccaggtttttttttcgagtgtgcattgagtaatggttttagcttcttctcttttgcaggcgcatttgtcgcagaatagcaagttcgacttccacaaatacatcaagaggtctttggaggacgacttcaaagttgtcgttggcatcaggtccgtcctcgctttattaattataggactcttatattcaacattttttttataaagaaacatatttagtctccagttgtgtatgtgtatgtggatcttgacacatttggctggttttgcagcctccctctgtggttcgtcggaatccttgtactcttcctcgatatccacggtaatccttgtcctatttcattctgttttttactctcaaaaccttgttctgaattggtcttataatcaccatcgattttttttcaactttttccccgcgtgtaggtcttggcacacttatttggatctcttttgttcctctcatcgtaagagcgaaatttccctgtccaaagaaacagttaacataattaattatgnnnnnnnnnnnnnnnnnnnnnnnnnnnnnnnnnnnnnnnnnngatggatcaatcaatgggcgcg

SEQ ID NO: 40794 - DNA, 1271 bp, Oryza sativa
  unsure (1)..(1271): unsure at all n locations
cgcccctgattgacgacnnnnnnnnnnnnnnnnnnnnnnnnnnnnnnnnnnnnctttcttgggtggctcagctgtggcgggtgggttggacgtgtgctcaaccatgtcgaggctccgcttgtcgcactgcactgccagctttgcgttcccctgaatagtgattgttcccttcggcccaagcatcttgagcacttggtatgcgtggtgagatgcggccatgaacttcgcgagtgcagttctcccgatgatggcattgtatgttgtatcaaattcagcgacatcaaaggtgatctgctctgttcggaagttgtttgcttggccgaaagtcacaggcaacgtaatcttgcccaatggcttggacgatgactgaggagtgattccgtggaaaggttgatcagtaggtgtcaactcgcttcgtgggattcccaccgcgtccaaggtgctggcgaaaagaaggttgatggagctgccgccattgatgagaacccgtgcgaccttgatattttgaatagtgggctcgatcacgattggatatcgtcctggaatgaccccagtcttggggtagtcttcctctgagaattcgatcttctgttcggaccacttcatcttgggcgcagccccctgccatgtcgaacaaacttcgcgctccactttcttgtactctcgcttcgaagagtacgccatagaaactccgaagatgtgcgagacatggagatcggaatctgggtatgctgagtccgagtcctgagtggctgcttccgtggccttctcgactacaagtacttgcttgcccttccccaatgcgagttgctttgtgagtggattttttgagaacgaaacaaggcttctaanggagtgctttgtccgatattgtgtattaagggcaatataattttctttatggctcgcccctctaggggccttggtggtttgggcaggttccacgttatttgtgtgtgaaaacctacggtttggactttcctatttccccacttttggcaacttttttcttggctgaattcccgaggcccttttggctggttttcttctttttgggttgtgcggttatgggcgctccaaggggccggccctgtgaggccgattgaacgcacactttacataagttttaagggccttgttatctcgctttggccaacacctcggggggggggggggtccttttcacacacattttaaaagcggggaaccggggggatggtatactcgggattttttttttcctcttatagacaccaaaattttctttgttg

SEQ ID NO: 40795 - DNA, 2227 bp, Oryza sativa
  unsure (1)..(2227): unsure at all n locations
cgccttggtcaaaaaaataggggagaaaaaagttgtagggggtcccccccaaaagagggagcccccatttttgtgtgaagagggggtgaaaaccccccattatttttccccccccgagaaaagagagggggtgtgggggttgttgaaaaaatggagaaattttcaaccaaccgggcgggggggttgtccctttatattgagggcggggccaaaaagttctcttttaaaaaccctgaggtcccggaaataaagtgagacaccctctccccaatgaaagtggcaatggtgtgccccagggttcttggaaacctaagtcttctccccccatttcgtgtgtctcggggggggggccttttggttgggccccacttttcccccggccgggaaaaaaccaccgggggatttgcctttcgggggtgctggcccctcctcccctctaacaattccnttggccggttggccaaagttttgtgattgcgccccatcccccaagttcaatgaagaaagtttttgtgaacgccccacacttgccggatagggccgctccttgctgggaacgctggccctccttcttttttgtcgttcccaagccttcccctttngggttggccggcgaggcgccctcgacggccgagnacatgaccctcgtcgtcggacggactgaacctctctttcctcctcctgtcccgccgccctgaccgagcggcggacccggggccggccgaagctgccacatcggaaccggaggggttccaagtccaggcctcctccttgcgagccactcggtccgcgagctgaaaaagctctgcggtagtctggggctctttggaggcgatcttctcgagcatgcggttgtgccgcacgccccccctgaacgcgtagattaccgcgtgtgcggggatgcatggtatggtattgcggacttgacagaaccgctgaatgtacgatcgaagtgactcgtcgtcccttcgctgtacagcgtgcaagtccgcttcctcaccggtgcgcggatatgtgccctggaagttcatggtgaactgttggcacaaatcctcccaggagtggaccgacgcggggggcaggttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccacgtccatgtcgaggtgacactctggacgaggaagcgccctccgttgcgtgggcagcacttcggtcattgcgccggcgcttgatgctggcgcgggcgtcctgctccccacgcagatcttcccgggtcgaaggagtcgacgaaggagtggcagccgaacggcgaacagcggctgccgctcgtcgtgccctctgtcttgacgacgcggagccggtggtagcagcaccagaggccttggtggcggaggaccgcccaccagcatctaggcgctgccgcgccgtcatgaccaatttggccacatcgtccagccatcngtgggctggagactccgggtcagggacgacaggcggatggcgtaagagcgcgcccgcagcttggagcgcgccctgnggcgtgctgccgtcgcgtaaacgaggaggcgacggccccattttgcgttctcttcattgcccggatcgtgaagccgggtctttccgacctttgagcacctcccctgcttaagactttgcctggaaggggccgtgaatacgagcttnacgggtgggttcggttcccgtngnggccctacaatggagaagagtcggcgcctttgtttgtcaacccttaggttgacaagaaaactttgcgcccggaaaaatcagagctcaaaaaaaaccctgaccccctacttgggcccaaattagggcggggggtttttacgggagacgcacgggccccctttgcggtttgcggggggttagggaatacccaaccttctttttgggggaggatgcccttttgaaaggccccaacccacccttttttctgttgggccccctgaaaacaaacccctcctctggtttggggttttttttcgcggccacaaaggcgcccccctttctcttttagtttggaggcg

SEQ ID NO: 40796 - DNA, 1689 bp, Oryza sativa
  unsure (1)..(1689): unsure at all n locations
agcgccattgattgacagaacnnnnnnnnnnnnnnnnnnnnnnnnnnnnnnnnnnnnttccagctcgttcatggggtcttagttgcataaataagacgatgggacctcggtacctcaggccttgcagaagcaacaaggttagcccgtccctggtaaatattttctggttcattagcttcttgtaaaccatccttgaatttgctgttaacaccatctaaatggcacgttccgtttgtattgtctatctgcggaagaacaaaatttcaagattagaaaaggttcactgcaaacaaaagttacggcttaattatagctcatgacttcaaaatttcagtagtaaagatttagcacttcgaatcgaattcttacaagggcggctgcatttttcaagtcctccagattgaagttccaaccactgattcctcgtatgtactctttctgaaaagcaaaagtcagtaatagcctattggtcaataatacttgaatctatatgcaccgtgcaattcatgactacaataagtcatttctatccaacacagttaaatatataaatacaccagtaaatatataaatgtgagatatgagcttacttatggtcaaaatatgagcttgctattagctaactatagttcttattattatttaaaaatatatatatttgccacagttgtagaaatgcagtcaccatttagttaataaatccaataaaactcaactcaatctagcacatgtagaaaggaaatgatgaaaaacaagctagcaaaactatttgtttaatgatatcattaaatcaagaaatgtggatgaacagatcaacaactttaacatatatatctatctctagtctttgcttcaacataggcaaaacctagatctctcatcacatgttaactccaatgacatgagatctctagaaaatttcactgactactccatggaatggctagaaatcaagtcattttaggacagagtcacagagagagtagtattctgacaatattatttcttagaacaaaagagcagcatctaacctgtgatagttgctccttgctctctgaaccaagcttattactaagaagcaagtcagcctcttttccctgcaattgagtataataaagattagacaagtcaaatcaaattgaatgccatctcataaatagtgatttgcaccttcaatgtcctaaagcgttcacccagcggggggaggccgtcaagaatacttcgtgcaagaaattcagctgtacgtgcatgcttaaaaaaagaatgcttcaagagcttttctgaagatggacgcttgcgtggatccttgactaagcaagttgcaaccaaatccttgaaagactacaaaaaagaacagttatgattaatatacagtataagtcgtcgtcaaaaggaacatggtgaatacaacaaacctttgaaaatcgcttgtccctctcatagtctagacctggtggtgcattttgcaaggtcataagcaatacctacaatgtgataaatgtaccgctatcgttatctaacctcatggacctttattaagaataagatcaccacctatacttcagtgctaaccttcattgaagggtactttgaaaatggagcatgaccatgtgctagttccaatgccgttannnnnnnnnnnnnnnnnnnnnnnnnnnnnnnnnnnngatctgcacgcaacaagggcgt

SEQ ID NO: 40797 - DNA, 1061 bp, Oryza sativa
  unsure (1)..(1061): unsure at all n locations
tgcgccttgaatgactacannnnnnnnnnnnnnnnnnnnnnnnnnnnnnnnnnnnaatccatgcccaatcttctgctagtagcctagtacaaattgttaagacataatattaagatgaacagtactctgtgggggactttgtttagaataattactataatattggaccattataggtattttcattcttttttgagaataaagcccatctaagattcagatgtggcactaaacttctgggtgcataaccatcccaaggtgaggcatatgcgagtcagtgattgttcccaagccttaaatcacactggctgtcaattagctgtaccctcaatataacacaggagcaacaaaaatgtgatgcctcatgtctctccattaatcatgtgtcatcccaatgtctctaagtctaaaacatggacaggtgaaatgtgattgaatttcatattgagtccagtgcaacgcattatgcaaattctgtgctgctacatattatgcttccactctaatagaatggtggagattcaatattacctttacatctctgtgaatatgcccttgggagtgtaggtagacaagagctttaagaacctcccgcaaaagagttgcaatgactggctcctcaaacccatctggaaaagaagttttcataatgtgcagagcagatccagcggccatgtaaggcataataacccaaagctgatgaccatttgtaaacgagcaatatgctcgaagaagatttggatgatcaatcaagctcatggtttgtacttctcgtcttatcccatcctaaagaatggcaattccgtaaggatagaaacacaagctcaccaaaatgtaagcagctgatttgaagttagtatgtttagtgacaggaaaagcaatgaactgaaggaggtgatactatgcacttgtggcacaaaaagaaatgttactttctcagnnnnnnnnnnnnnnnnnnnnnnnnnnnnnnnnnnnnnnnnnnnnnnnnnnnnnnnnnnnnnnnnnngggtaccgagctcgaattcgccctatagtaatcgtgtacgtcaaatcaaggggcg

SEQ ID NO: 40798 - DNA, 2593 bp, Oryza sativa
  unsure (1)..(2593): unsure at all n locations
aaaaaggggtgaggccctgttgtcccccaatttaaggggtggtaaaaacaggggggggggccccccccctggggagaaccaagggaccccccccctcgggagggaaaccaaggggggcccatctcacctggggcaagattcccaaagggttacagcccggtggcattggtttttcctaaaccctaatcattaactcccgtgtcaatgcccgacaagccccccggaaggcctagggcataattctcccgccaacacacggttcaaggctagaaatcgggaccccacagacccaaagtccgggttgtcaaggggaaccactcgcttatggtatgtcaataccagaagttcggcaatccccttggaatatgggtttccatcatatatcccataccactggattaaagctattacctaccaaggggcgtgacccagtaaaatccctggcttccattggcttgaagtcgtatcacatagatccctcgtaccagcgtaccccaaataccctctatatccggtctacgggtatccaccgtcgacaggggcgtgccaggtaggggaacttggtgctcaaggttctactactatgtcatcaagcttcgtcgacacaagcgtcaacnccggcatcaaccaaggagtttctacttcaacaatgctggtgtggactcaagtcggcgaaatcgtcttcctggtttacaccatggtgccgatctcaactggtccatcaatgaccagaagcgagaacgccgtggttacaaccctggacggctccatgtcgaaggatcctcccgcagaagtggagaacggaacatcgacgacatccgagcctgagaaggatcctaatgcggccaaatcttgtccttccgacgagaatcacgagccgacaaggacaacttccgaggcgacaaagtcctggtgtcatatccacaaaaccaggaaacacaccttacaagcttgctgggtatttctcgacgcctgcaaagagcgtggaattcaacgtacttctctaacccgtgatgtctattgtcctattcacaagacaaagaatcacgacctctcaagctgcaaggttcttctcagcgccatgaggacgtcacctcctaaggtccagcaatcacagatctctcttagagatgcggacaaggaacgaggagcgacagttatctcagatcgattcatcggggtaatcgacatcgatccccacgagccgtcagtactacacttgctcgaagaccaggcctcatcatcaacgagtacaccacgtgatgtgttcgctatcgatgggaccagcacgtctgcgcgcgctaacgcagaagcagaggatcaagtggttacaccagcccaacacatcagggctatcaacgcaatactgagggaaaccccttatgatcccgttctgaacgatgatctcgcagagtggacagaacgactacgggaattagtggctaacctcagtaacgcgttcgaagaggccgccaccggagtactgccagagcaaccgccaactggcggtgccaatggaaaactacccgggcaacgggcatcacctcgtcaagccactcctccacctcgcggcaccagtgatctccatgaccatttgaatgtccgccgagaagcatgacgcgcgtgagaacaaaaaccgttcccggcatcgcgtctcttcgcgacgtcgagagaacgaagagtgaggaggacacccgagcgagaaccaagaccatgataaccgccataaccgccatgatcgcgaacagcggatgccgggcgatactggtcgaggacgtcgccataacgatgacgacgacaaagatcggcgccgggacaacaacggtgggcgacgacaagattctccagaacccggaagtcatcctagtaatcgaaccccggacccaagtgactcatcatcatcgtcatcatcctcgtcattagacatgcatccacggaggacatacgatcgccgacaacctgccgccnccggtggcgggtgtagagctttcagtcgtgctctacgagatgtccgatggcctgagagatttcgaccgggagcaatagagaagtacgatgggagcaccgaccctaaggagttccttcaggtctattccgcagtattctacgctgccggagcagacgacaacgcattggcaaattatttgccggcgacgttgaaaggatctgcacattcatggctagtccacctcccaccatactggatttcttcatgggcagatctgtggcagcagttcgtcgctaacttccaaggaacatacaaacgccacgcgatcgaagacgacctacacgcgttgacacagaatccgggcgaatcattgagggactacgtttggcgctttaatgagtgcagaaatacgatccccgagatcaccgatgcctccgtgatccgcgctttcaagactggtgtcagagatcactacaccacccaggagttggcgacaagacggataacaactgctcgaaaactattcgagattgtcgatcgatgcgctcacatggacgacacactgagacgcaagaacgnnnnnnnnnnnnnnnnnnnnnnnnnnnnnnnnnnnnatagtgatntgatcaatcaatcaanncccag

SEQ ID NO: 40799 - DNA, 1191 bp, Oryza sativa
  unsure (1)..(1191): unsure at all n locations
ccgcgncatgaagaatcgactactatanggcgaattcgagctcggtaccctcataaccaatataactaggagtgtaagtggctaacccgcgaaatccacttataggctaaaacaagccatcaacccgcttattttaacctataagttgttcacaactgacccacttacacccctaaatataacaaatccacttgatcaacaaatttggtctatgcagctcgatatgacgaatgacaccttttggtttccctctttgtaccgcagacatcagcaggcagcaagaaggtcgtgggtgtgttctacaagggtggcgagtatgccgacaagaatcccaacttcgtcggctgcgtcgactccgctctcggcattcgcggctggcttgaatctaaggggcatcgctacattgtcaccgatgacaaggaggggataaactgcggttagtagtactctccctccgtctaaaaattaagaagtatgtattttgtttcagtacaataaagccttcacataatacttaaagactacttttgaatacaaatcaaataagatcaaatttatgtcatgaaattaagagtaattcttagtcaaagcttatgttgntgaactgaaggagtattagctgtgatcaagaggtagtttctacgaacaatttcgataacttttttgagcatccgtagcatctatcagcatgtagacgtgtattttggntgggcagccgctgaanntaaatttatctatgttttcatgctggcctgatgtcaagttattcaaatcctgttgaccagttttgcgccaatgttcaacatgcatataattttttcctttttgctgaagcctatctggtcgtgaaaanataaccctataccacctatggtaattttctattctacaacctacaataggctaacatttttaccgaaattagacgctggaaccattcagaactaatacctgagtttctgaggactaaattttctgataaaatttgtcttagctggatgccccacaatgacgcttgtggcataattccaagtgggaagccatgggtgccacgttggtccaccatccaccaactattaccnaaaagatagaaggcaaaccgacttttttacggcggtggtaaaccatttttcccaaccggggaggttatcgggggagacgcggacaccttcgggttaacatttccccttt

SEQ ID NO: 40800 - DNA, 1223 bp, Oryza sativa
  unsure (1)..(1223): unsure at all n locations
cgcggcnattgagaatcgactactatacggcgaattcgagctcggtaccctggtccttcccacttgggtgagagcttgttacgccctgcttggctttgaacccatcggaggacgtaatcgccgatcgaaagcgtgcgtgctctgatgcgcttctcgtggtatcggcgaagggcctgttggtagctggctgctctgacggtaactctttctcgatgctcctcgagtagattcacatcgtcgctttgctgctcctcttgatcctcgtcagagtacttctgtactcgtgtgctctgatgtcgtagctcagtggggagcatggcttctgagctatacatgaggaagaagggtgtgtccttggtggacgttgccggtgtggtacgcacaacccatagtacagaggggaggacttcaacccacttcttgtcatgtgacatcaatctgtcgtagacatgggtcttgattccttggagtactatgccgtgtgccctctcggcctatccattgctctgagcgtgaggaaccgaggaaaagcagatcttgactcacaatctgatgcagtaatcctggaagtcagcaatgatgaactgggagcccttgtctgttatgatgcggtggggcaatctatatgtgcagaatatcccttaaataaactacaaggcgtagtgggccttaaattccccagtggacgtcgcttcaatccacttggtgacccgccgcgaatagaaacatgtaggcgacctgtcctcgtggaaatggtccgagtatgtcgagccctcagcacgagaccgaccaagtaagagggatagtctggagcgcttgcgcttgtacctttgtgtgttgctgggaantgacaggcttcacaccgntaaccatgtcgcaacgtntttgaacgagttgcccgaaaaccttgtcaaaaagtttcttgaccaagtgcgacgcccgnagtgaccacacataccctctgttgttcaggaataaagtttgcgctttcgccgagagcatttagaagagacccgttggggcttttggataacggtgcgaacttacgaaaattggttggcggtattttttggttttggtaatttgggcactggcataattagaaattgaggatggcttgcccccaatagggctcagtggnaaaggcgttttctttgaaccccaaccatgtggggcaaagggttatttccctctggttttagaatccccaagggcccttctgg

SEQ ID NO: 40801 - DNA, 2392 bp, Oryza sativa
  unsure (1)..(2392): unsure at all n locations
caaacgcgcgcgggtggagagaactcttcttctttgagagagaggcgtaagagagatctcctctttgttttttatgagacgccaattttctcccggggggggtttgtgtgggcacgaggggagacaaccccgccgagaaaagaagagagagnttttgttgtaggaaacactttttttctcggcgtgttttgccgggacgtgcgcacacaataaaaaacccctcttcacaccatttgtgttgtttttatcgggtcacagaagtctaccactctctttttccaagaagatatggtgcttccacgcataagccacccttcacccagatctttttctttttaagaggaggcccgtatatagagccccacccatttacaaagtattcctgtgaggccccgcactcaaaaaaccctagagttttgaagaataaccgttgtaaccagtggggttctctgcccaagggggatttaagttcgttctcctccccggcttggaaactccaaaaccatatatttccacgttataagcgcacaccggtccgggccttaaaaggaagggtttccgtgctccacagccccagcttagaagcagaccgatctttccgccaaaatctaaatgtctctccaagcgtaaagcttatgaaaaaagcggcctcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggacttgatggctgttcgtggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtagctttcttgatttcatgattactgtgtaaagcagcttttggatctgtgggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcaacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaannnnnnnnnnnnnnnnnnnnnnnnnnnnnnnnnnnnnnagagatatataatnncagct

SEQ ID NO: 40802 - DNA, 1713 bp, Oryza sativa
  unsure (1)..(1713): unsure at all n locations
agaagtatcgttagcaagtttaacaaaacgcaaagatttccggggaacccggtttttaagcccggggttcccccccctattgaggccctttttatattctgcaggggcggacttttgaaaccccacaagggctttttcgggttgggcctttgggccctttggaccaatttttccggggataccccgttttgtggaaaaccgatccccccttaattatttaaccctctccccaaccaaatcctttgccaaaggtttagttacagagagcgaaaggccccctattccaacccctttccccggggtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcttcttcacctgggcgcggatatgtgccctggaagttcatggtgaactgctggcacaaatcctcccaagagtgaaccgacgcgggtggcaagttcattagccaaccccgcgcctgacctttcagggccatagggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccaccaaccggggacacggggggctggcccccgtgcccggaccgaagtggcgctccggacgaggaagcgccctccgttgcgtgggcagcatgacgaccattgcgccggcgctcgatattgaggcgggcatctggccccccacgcacatcttcttgggtcggaggcgttgacgagggaatgtcggacgaacgacgggtaacgaccgccgctctccgcgccctccgcatcgacgacacggagccgacggtagcagcgccagagtctttggtggcgtaggaccgtccgccggcgcctagtcgctccggcaccgtcatgaccaagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40803 - DNA, 1203 bp, Oryza sativa
  unsure (1)..(1203): unsure at all n locations
cgcgccattgatatatcttnnnnnnnnnnnnnnnnnnnnnnnnnnnnnnnnnnnnnntatagggcttatgatcttgaaggaaaaactgtggggactgttggggctggtcgtattggcaggctcttacttcagcgtcttaagccctttaactgcaacctgctgtaccatgacagacttaaaattgacccagaacttgagaaagaaattggggccaaatatgaagaggatctcgatgctatgcttccaaagtgtgatgtcattgtgatcaatacacctcttacagagaaaacaaggttcctgatgatcgtattcttgtttgttgcaaaatcatatacatagtacatctacttatctgaactttgtatgattctttcttcagaggtatgtttaataaagaaagaattgcaaagatgaagaaaggtgtaatcattgtgaataatgctcgaggagcaatcatggatacccaggcggttgcagacgcttgctctagtggtcaagttgcaggtaccatcatcctttcatttcttatagcctacactgcatactagcatgccatcagatttggtctaaatctttctttttgatccatgaagtatatcattttcctggagcctatcatgcttcacatttaagaggggtgatatgaaaaaacttaaaaccaggacaactaacccagtaaagcagtatgtatgtcaaatatgataacttgttgttcacaattattgaagaatctttttttaaaaaaataaaagaacttctctgcacctatgtaaattagctctcttaccatgattctttaatctgtgacaaactactaaatgtcctttccttccagagaactaatattggtgtcctattgaaaaaaaaattataagaatgatgccgtattaatatttctatcttgatcaatatttcctttagcatgaaaacctcatcttccttctaagaaaatggggagatagttggtcccccaccaggaccaaggatcaccctgcgaancatgctaatattgcatggaccctaaatttttgactccaatgggcccagtcaggtttaatatggttcaacttaacctaggcattgggctaaaatttaaaaatggtttggggcaccccccaagtttaacaacttgggacattttgcgtttggagaaggaacttttcccccaaggcgcgttgtttctattacaatacaacacggccc

SEQ ID NO: 40804 - DNA, 1787 bp, Oryza sativa
  unsure (1)..(1787): unsure at all n locations
tgggnnattgattgtatatcnnnnnnnnnnnnnnnnnnnnnnnnnnnnnnnnnnnnnnnnntacggcccctcggctcgcgttcgccctcgactccgacgaggagggcggtgacggtggtgcggacgacagcgacgacgaggctggtgacccgggcgcgtcggagtgagcccccaggcccccgccaatcttaaatagctttttctttcttcttccgaggccttcgggcccccttcttgtatagactaatttaatctgcaatcaaataaagaggaaatttctgtgtcaattctatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactggccaagccgggagcgtggtgaccgagggttatggatgacccgattgtgggcctttgccgattcccccccggagttcaccacgccccggggcatggctcggttctgggccccttttggcgattttagccggcctgggccaccgagggcaggatcgagcacgagcgtgctaattcaagccaagattctttaaaaggaaacaatggcacagacacagtccttaggaaatcgaaaatgcttttattgaaatacggaagagaaaaaagataagtatatgcatgtggtagcccccggccaaccctgcatgcccgggggggtgcggggttggcccgagcccgagacctgacacccgacccctactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagttcagcacgcgtttggacgcggcgtaggacgaggtcgtcgacgcagagtgatcgggcccggatgtggcgctgatggtagcgccgcaggctctgctggtagcgcgcggctcggagggccgcgcgccgccttcgctcttccaagtagtcgaggtcgtctctgcgaagctgatcttgatcagcctcgcaacacatggtggcccgatgggacctcagggtgagctcagatgggaggaccgcctccgcgccgtataccaggaagaaaggcgtctncccagctgctcggcttggcgtggcttggntctgccaaagcactcgtgggagnttctcaatccacgagttaacgngcgttttgaagataattgaaggtcttgtttttgaaggcattgaagatattcggcgttgaccccctccaattggccattgtttttgagttggccgggggaagcgaaacaaagcttgaatcccatgtctttgcataatcacccgaaagctaactattgaactgggtgccgtatacgnaatgataccggtaggcaccccaaaccgagcatggatgccctgatgaatttaacgcggagtgcctatcgactttgtgaccggataagcttcggccacttattgaactgggaaagggcatacagttcttgacaccgccgtgcgcgcttaacggacccagatattggcccccatacgnaatggccacaagaagttggcttcaggctcgtcccgttgatgattgctggtagaattgtacccttgacatcggccaggntacccatagtgaggcgccgccaattaaacctggaaagcctttcccaaggggttagaggagggctcccatccttaaggtatggg

SEQ ID NO: 40805 - DNA, 2117 bp, Oryza sativa
  unsure (1)..(2117): unsure at all n locations
accgtgaattttccccgaggggttgaacaactcaagggcccatgtccctgggcgaancggctcggaatgggtccctcccccaaaatggcaaggccggttctgatcgggggcggttcaagcccagttgatcaaaaggttgattgccttttcacacggtcaggtacctttcggtaagcaaattggccgaggggtaaacgtaccaccgtgaccgatgcgctggaaatatgggcgcacttctgaaaagcatcagatagcgtaaagcatttttgggcttaaggtatcgggtcttgcgtnccgaagggcctcgctaacaagtaagcgagcngctgcactttcgncgggncagatcctttcgctannggncngtatctnagggcgcttcttcgtcgaaaagggcacgcgggtagcactcggcttctgtgccgacgacctcggggtcaaaaggcgacaaggcgcggccctcgcgcaagtggcnccgagcccgtcctgggggtcgggggcgcttggcaccgtcggacaagcaaggcggagggccagctccggccgtcgggggccttaggccaccgttcggctcgggggcctctcttccctgctctttctcgggccaagtcagcacagggtgggggtgcgtggagtgagggttgtcctcatcgcgctccacgaccaacgccgcgctgaccacttgcggggtcgccgccaggtagagtagcaggggctcatctggctccggggcgaccaggacagggggagaactgaggtacgccttcaactgagtgaggacccgctcagcctcctccgtccaggtaaacggcccggagcgtttgaggagcttaaataggggtagcgccttctctcccagcctcgatatgaaccgacttagggcggccatgcagccggtgacgcattgcacatccctaagcttgttgggggggcgcatccgctctatagctcgtatcttctcggggttggcctcgatgcctcgggcagagaccaagaacccgagaagcttgcccgcaggcacgccgaacacgcacttgtcggggttcagctttatgcgggcggagcggagactttcgaaagtttccgctagatccgagagtaaggtctcttggttgcgcgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccctgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacgaatgaatccggcctccagaagtcgcgccacctcctcgcagatgaaggcttgacgtttcggggcctgccgccgcactttctgccggaccggccttgcgcccggccgcacggcgagacggtgctcaatcacctccctgaggaccccgggcatgtccgccggtctccagtcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcttcggggcggctgggacggaggtgctgagcctctcgtcgccacccgcgggcttggacgccgcggcgaggtggtccgcgcgctgctccatacaagcaagcgtgactttgaggtcgccatggacggtgatggggccaccggggcccggcatcttcatctggagataggcgtagtggaccgccgccatgaacttcaccaacgcgggcctccccaggaccgcgttgtagggcannnnnnnnnnnnnnnnnnnnnnnnnnnnnnnnnnnnnnnnagttcgacatcaatcgcgg

SEQ ID NO: 40806 - DNA, 5624 bp, Oryza sativa
  unsure (1)..(5624): unsure at all n locations
ngccgacaccatggcaacacgtcgaagcttggttgatctcgagagatcaaataattggtgactatggttccgctcttgtcgaaagacatattccggtcaggttagatctccccatagccaaagtcgtcgagtagcttattgttggagaatctatctcttaaacccatctcattgaaatcctgaagcaccaaaatcctcctacctggtacgccactgtcgacatttgatgtcgcgattctggtatttacatggtatggggatcgttggtactagggtatacgcgagactgaggtaaaagagatggagacggagatttttatacatgcctttttatacaggttcgggcccctgaattatcaggtaataaccctacatcatgttggccgaagccgttgttgctctttattcatctagatcacacaagtacaatatgtggggtagcctatctaactgttgtcgacatggcggtctgaaggtctgactcgtagtcgataacagggtagtcttcctcctcgagttcgtgcccggcgagatcagagatagcgctttcgtctctcctgacagtatctggagacaccgtaggggactagccgtgcctatccctgaagtcgatatccggcgtcttgtcctgtcgtatgttggcttgtatgttgtggcttctgttgttccgtctatggtgggcgttggttgtgtcccctctcctcctagggagccttgtatttatacacataggtgtccccttgtccaagtagaactaaggaaaccaatatggatacaatccgagtagttcttgtcatttctatgtagaactctggttgtctttccttatccagaactcctcctatatccgcaggttgtttccgtataggacatggtatgtggtgggtcctgccgagatttagtcaactactattaggtacgtggtatccataaccttgacaaagatcaggtacggcctatattatatactatttaatctgtaaaacaaattcatctgacaaaataaaagatactcttaatttgattatctaattatatatgtgttacttagtttgtattaaaaaaaattgatgagctttagatcatctccaacatagagaaaaaacgagttccaatagactctccatccgaatggctaaacgtagccagcctcttccattggccaaaggtgggtcccaccatctctcccatcccttcttccggctccccgcccccccccctctctcttgctctctctctctctcgccatgtactggcccccacccgcaagcagtgatgacaccgacggtggcggatcaattggtggtgacggcactgatggtggagcaaggagttgtagcagtggtggcggagcaagcaacgacgatgatagggcagggatggatcggagggcctgctgacctttagcggcggtgtcgacgaggtcagaccggtcactggtgatgaatacgttctggctgcgctttcggcttcatcacagtctctctcatgactcatcatttggagtctcgccatccaccacaactgcactgttgttgctcgtcgcggtctccaccgtctctgtccttgcacggcctccaacgcctctttccccacacggattcgactggcggccggcaaagaagaagagagaggaagagaagagatagaggagagggtgaaggagagaaagaagaaggggaaagaagtagggaggctgacatgtgagacccactatcagattagagaattgtaatagagaggctattgaaatgaaaggtaaatttgactatctttttattttttggcaaatcggtcaaatgaacatttggaaagtgagatttggaaaggatgttatcggagatgctctttctaggaagtgtacaaatgaagtgatgaatcgtggtacggtctcgtggatgcatccactaatgtttaaattttgatgtcacaaatattacccatacactatattagtgattcgtcgttgatatcggtctcttcgatcagcttgtgttggttaagagggtgtatgatcagttcacgcatgtatgtatgcatctagcttgtatcaataacaagctttataataagtattgcaatttactcttttggaagacgtacacgcactactacaaaaatcgtttttctgtacgagggggtcggtaggttccatgcgggccgcttgtggtggcgcctgcaaaaaccgcccccccggggcgggttgattagccgcatgcgaagatccattatcgcatgcggctggttaagacagccgcatgcgataataggtctattttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggtttctaccacaaagacataggtaccgtaagatggctagattgttcgataatacagtggagaatgacactgccccagtagcaaaaggtggtacatacgtgtatgagataccaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagttttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatgggggtaccgagctcgaattcgccctatagtagtgtgatactcaaattcaagnnggttcacngggtccca

SEQ ID NO: 40807 - DNA, 5721 bp, Oryza sativa
  unsure (1)..(5721): unsure at all n locations
tggatgggtngnggttgagaacatgttactctaggcgaattcgagctcggtacccgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggtttaacagcccgcatggaaagatctttttcgcatgcggccggcttatgcagcccgcatggaaagatctttttcgcatgcgggcggcttatgtagcccgcatggaaagaactttttcgcatgcggccggcttatgtcgaccgcatggaaagatctttttcgcatgcggccggcttaacagcccgcatggaaagaactttttcgcatgcggccggcttatgtcgaccgcatggaaagatatttttccatgcggtcccttaagccgcccgcatgcgatgatctgcgcctatatatagggagcgcggggagccaaaattttctaagtcccagctcccgcgaaaccctagccgccaggctgccaaaatttcccaagtcgccgtcgccgtcgtccccgccaccgccggctcctccccaaagtcgccccgccccacgccgtcgccaccgccgccgtcaggacctctcccccctcgcctttgccgtcgccgccgccaggacctctcccccctcgccgtcgccgtcgccgccggcaggtcgccgtcgccaccgcacggaactctcccccctcgccgttgccatcgccgccgccaggtcgtccccgccgccaagtcgttcccgctaccgccggctcctccccgaagtcgacccgcccctcgccgtcgcagacgccactgccaggaccgttgccctccccctctccgtcaccgtcgccgccgccaggtcgccgtcgccgccgcacggacctctcccccctcgccgttgccatcgccgccgccaggtggtcgccgccgccaggtagtccccgccgtcgctcggtaacatttactttttaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattggcacctatgttaaattgtgatttatgtataattgtgatttttgttaaactgagatttatgtataattgggacttatgttaaattggcacctatgtcaattggagatttctgtttaattgtgacttatgctaaattgggacctatgttaaattgggacttatgtgaaattgggacttatgttaaattgggagttatgtgaaattaagttattgggacttatgtgaaaataagttaaattgtgacctgtgttaatttgagatttatgtataattgtgacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggtttcatcgaacgcaccaatagcgcctcaagaaggtaacgcttctcaaaatttcggtagcaataagcatccaagcgcttctagtgaagaaacgtggcgcacaccaagtgacccgttttcaatggaaataacacaagtccgcccccgcgatgatgatccggactacatacctatcgaacaggccgtaagtgatgaaaatccgtagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccggttacggattatggacatatatcgcaggctgactgggacacgtttgttgcggatcgtacaacagcggaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcatgaaccaccgtcacctcgacatccgccgtcaccaccaccgcttaggtcaccgcctcgccaacttacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcataagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaaaataaa

SEQ ID NO: 40808 - DNA, 3957 bp, Oryza sativa
  unsure (1)..(3957): unsure at all n locations
ccattgggcttaagctatactaaccttatatctactcgttatttacatgtcatctagctaatgatgataaaaaattaagaatatttaacaagatagattaatatgtgataaatcaattcacaaacatacaaagctaattttaacttcgacaagttgcaacaaaataacaaatttgactgtgaatatatgttaactagtcataatttaattctttttaacttgtaagagttaaattttaacttgcatatttgtggagtggcctatcatatattaatctatcttgttattttttttaaaaaaaaaatttcataagcagttagatgacatacaataacccaactattccctccgtctcagattctgcctcagtttacacaacccaatacgtatatataaaggcctgatcatcagctggccatttgcccacacaatcactcgttgttgaatgttgagtattctcccatcgccatgaacgccttcctcgagctcgagcccttctccactcctctctttgagatccccgatgatgctgattttgagtacacatccatgctcgccgctgacgacttcctcctcatggacggtgactttcttgctgaccagccgccggtgtcggtggaggtggtggcaggcggaggagatgccagtgggaagcggagtttccatgccgacgacggcgaggccatgggtgtcgtgtcccggtcatctaagaggaggaagaaggcgccaaggaattcgagctcactgtccaactgcgatggcagcggcggcgaggggagtgagccgacggcggaaaggccaggtggccggcgggtgtgggtgcgggagcggagcacggaatggtgggaccgcatgagggacccggtggcgtgcccggaggcggacttccggcgagccttccgcatgccgcgcgcggtgttcgacaagctctgcgacgacctggctgccgctgtcaccaaggaggacaccacgctccgcgccgccatccccgtgccccagcgcgtcgccgtctgcctctggcgcctcgccaccggcgacccgctccgcaaggtgtcccgccgcttcggcctcggcatctctacctgccacaacatcatcctccaggtctgcgccgccatcaccaccgtcctcctcaccagggttgtccggtggccggactcccacgccgcctccgcgtccatgttccaggccttgtccgggatccccggagtcgtcggcaccgtgtacaccaagcacttcccactggtggagaaaccgtttgtagtcccggttggtaacccccctttagtcccggttgtccaaccgagactacgaatccgggactaaagatagttatctttagtcccgggtgaaataaccgggactaaagatcgatctttagtcccggtttgtgttaccaaccgggactaaagatcgattagccacgtggccggccaaaccatctttagtcccggtttgtgttaccaactgggactaaagattggtgcaccatttttttttatttgcatggccctgtttgctgcatggttgattttatatatatatatatatatatgtgtgtgtgtgtgtataaatcatatattacacacacatatgtataatttaaagcacttaacattttatgtgcatatatatatgttaccaaaatatatattaacacaaaagtaaatgtgtacatatataaatatatatatacatgcatatatagtacaattcatttgcttggtagctataactacgacttcgacgccggcgttatgtcagaagaggaaggaccgacgttatgaattgtcgatccgtcatagtagaattcaccgtcgggattaaggacttcttcgttgatgaatcccatcagttgttcttgaacagccgtgataaaatccttgtgtgggagattatccctcatgtgaatacgctatcgttcgaaaaataatgacgtatcaatatatgaaattaataaacaacgtaacaaatcgagcaatgaaattttgaatggtttatgtatacgtacatcgagctctcgtgtggtgcatatttggtttaataggcagtgggcatactcgcatacgtagtagccgcataagttagttccctggtcctgctttgcacactacatgagaaacgatgagagatttaatatactatttatattaactgtaattagatattcaattcaatataattttggatcatgcatgtactcactggaaaatgaaacctccgtccaagtttttctttccaagtcccgcggaccaattgacggaaccgatcccaagccctacatatgcagttgcaagctatgattaattaattattacctgagatcaacataatagcaatagattccccgtgactttggaatagatggcattatattacatgtctatcagtttgaagaccttgtcaaaaatcttctcctctttattcattgagtcgtacatagctctgcatgcgtccaagtcgaagaataacaggacccaatggaatttggaatatgcgtgagatgagatatatatgatcgaaaatgtacatgctatatgtatgggaacaaaatttgttcgaacgacaataaaaactcactctgtgttgtacggcagtagtatgtacgtcttgaaatgctactgcgttaggagatggatgagattgtcctctgtgtctttctcgtacttgtcgatcatttcggtgttgattttccaagggtcgatgaacccagtatcgtagaccctccgccgtcgggccctttgaatctccattctacaacgatgaaaggaaagtattattgcttacatatatgccaggagctaattattgaacgaaacaaatcgaactcaaaaatactcacaaaatccatgccctcagaagagagatgtcgagggcgtccaactggtacagatcgaagagatccttgaaatggatccagagatcttcccattgcaagaagtcggggtttctgatcctcgctccgaacatctctctacccttggcgctcatttccatgtaccgttcatggaatttgtacatctgtgtcggtagggactgcagctgttcaggtttgacaagcggtttaccgagttcaaacttgtatgccacttccgccttcgggattggtgcgcctccaaccaactgatccacagttagaccggtgtctgaaatgaattccgttatgccaaaatcttcgccggtcaccaatggcccaacctcttggtttggttgttctccaagctgagggactggtttggacttcttgtgataggctctctgaagtgtttggtcatagtccgatatctgtaacgcctcgtttgttgtggacattcccttgaagaagttcttcacgctcgggtcaataggtatattcttttcaggactccgaggcttgagttgcctcttcacctctcctgccacataagcatcaagctcctcttgactgcaatcgtacgatggctccttgtttttggtggcgtcaactttcgccttcttcgttgcccttgtgcaggcaggcggtggagcttggcgagaccttgtcttgggaggtgcaggcggacacggtggaggcggaggagccagaggagatggcgcagtaggaggtggcggaggagccggaggagatggtgcaggaggacgtggcggaggaaccggaggagatggtgcaggagaagatggcggagccggaggagatggtgcacgagacgccgcttgtagcccaggaaggatgatgtaccgcttgcgccatagtatgatggcgtggcttgtgtctnnnnnnnnnnnnnnnnnnnnnnnnnnnnnnnnnnnnnnnnnnnnnnnnnnnnnnnnnntnngaaggtgncatgcaaatcaaacccctctgggggggaaggggagagagaanaattatgatgaatataaatgaaagtattgaagagaaaaaatcaccgttatatgtggtgagtcgaaggaaagcttgaagtaaatttggcaggc

SEQ ID NO: 40809 - DNA, 1830 bp, Oryza sativa
  unsure (1)..(1830): unsure at all n locations
aagaagagtctaccattgcgtccgttagtcgattggcagcctcgcgtatctgatcgctgaagacaagggagccatcaactgggttaagcgttccaccgtgagcatagtaccaaacttcgatcgatccggccatttagcggtggccggtttgatacccctctcaatcaaacttgcctccatctcctcccagttgggcattgcgacgctatatccgcctgaccccaagtggtgatggtacttcttcttggcggaattgtctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctgaaactgttatgctattttctacagagtccactgtttcactatgttctccgtacccgcgggtagtgtgaacgtctcgagcattgtggtccacagcatctctttctccgagtccgggacaaagctgtcattatccccgtgtgcccttgttttgtgccagtacaccatgctgacaggcacgttgtccctcacaacccaaccgctgtggcgtacaaaattcttggtccacctcagttatgatgtgctgaccctctatcttcttcgcggcacctcgttgtccgcgtgccctcttctgtccagcggagggaagacttccactagcctcctcctcatcgttcccctcctcgttcccctccgcatccctctccacgttcctctcctcgttcaagtactggtttggatcctcgttcccctctccttcgttccagtattggctgcttccctctgcgattgtgtcgtatagtatctgttcctcatcgcgatcagccatctgtgcaatcaaaaaatatttgttaggtatatagaatgtatttgcgtaccgtaatattaaaactctgctaatcttatattaaatctctaacaatcttatattaaatggatactaatctcatattaaaattgtaataatcatatatatatgctaagtataacaatattatattaaatcgctactaatcttatattaaatctctattaatctcatattaaatcgcggctaatcttatattaaaattgtaataatcatatatatatatatgctaagtctaacaatcttatattaaatggctactaatctcatattaaaattgtaataatcatatatatatgctaagtataacaatcttatattaaatctctactaatctcatattaaatcgctactaatcttatattaaaattgtaatagtcatatatatatatatgctaagtctaacaatattatattaaatctctaacactcatatatgctaagtctaacaatattatattaaatcgataacaatcttatattaaaattgtaataatcatgtatgctaagtctaaccgtcttatattaaatatctaacaatcacttctttacatcacttgcctgcgcgaattcctttgatggctagctaccactttggcttaaggtacgataacgacgtcttctatgcaacatttccaggaaaatgtattagtcttatcggtccaagttacatatatgatcatatatgtattaccagtcactcgtattagtctannnnnnnnnnnnnnnnnnnnnnnnnnnnnnnagcgtttgtcaacgattcaaggggtcctggggnggggggnnnagaataaatacaatgcgcgaataataacaaaatgtacaataggtatatcataagatcacgaagagtgaagatctagagaatagttcttaagcgtgtataatgcggtgta

SEQ ID NO: 40810 - DNA, 3608 bp, Oryza sativa
  unsure (1)..(3608): unsure at all n locations
gcgggccattgacgtcagcatctatgtcnnnnnnnnnnnnnnnnnnnnnnnnnnnnnnnnnnnnnnnnnnnnnnnnnnnnnnacaccaccgcgctcgctggcgacccgcctgataagaccagcggcgtgcctactgggtcgtatggtgatggcggtggccatggcggccgtggtgctagctgctacgtcaaggaggggcaggcgcaggaggattcgtggggcggcgatatgtacgcttgggctgaactcaagacccccaatagctacgggagcaaaggcggttctaccagcgtcgagaaggactatggtggtggtggtgggggtgtagtgtggttgttcgccaaggatattatgatgaatggaacaattcttgttaatggaggaaatggtggcaccaaaggcgggggtggctttgggggaagcatctatctcaaggctaaaaccatgtgagtatttgtaatttatattgaaaatatgatattaactttgttggctaattcgaaatcgtataagcaattcatatggttatgactgttaaagttcaaaattcaggcctcttggctctttttcacactttcacacaaaggcaacacgaatttattttttgaagtttggataaatcattgctctgcctgttgcccacaattcatatatacttatatttttgttatttttaattttaccatatttaaaaagttatatatccaatatcatattctgtaatagatcatgattcctgtataggatgcactcaacatgcactagcttgtccaatagatgtattagaaattttacactggaatggatgtaaagccaataaaatttcttctgtgttgagaatggtacaaatttcacattccagtgcattggattgaaacagtacttcccaattgaaataaatcaggaggaactatatctggtactggtattttaggacctaataaggatttgagagagattgtgtatcctttttttatttatatatgcctaaaactgacagttgcagtgatggggaccagataagttttaatttacaattatgttaagtgctaaatcatatgataggatttgtagccctcgaagattgtatgttgatatctacgtatttgggttacaaacacattcttcagaaagacatattgccaggcaactaataaacaaaggattttggactaaatgctacttaaacttactccagatcagttgctctagtctaaaattccacaattatgtcatagtgactagtatgagcatgactagcgaagatcaaacaatacattccaagtctccaacgtagaaggaaccatggaagcaaagaattaccaagaagcatcagttatgtacatgttagattataatgcaggttggcctgaccagccatatttggagttttggacttttaagtgagctggtctatgaaaaccatactcattgatattttaaaatattaaatgaatatatatatataacttttttgtttaaatttcgaatttatgttatttcgaacagttgcctcctctctgatattttgttgtaacaggcaaggaggtggcacaataagtgcttgcgaagggaatggtttggctggggaaggtggtgggcgtgtttctgttgatgttttcagtaggcatgatgactcccaattttttgttcatggtaattcacttgatttcatttgtatcatggactacttttgctctgataggcttccaattttgtatcttcacattgattttctagttgctgaggttatatgaggttgttctcgtttataacctgccatcttcatggtatccgtatttttttccctgccagctttgaatttttcttttctgactttcaacattgatttggtcaactgtcaaaagagcttgttttagcataatatactttttcttcaaacttctgatcagggaaaccactggcatatagttcagtttgttgtaaattgtaagatatgaactattctttaaaccttctacattattattttagagaccataactttagtgaccaagttagtgaccataacttttctgaccaagttattagtttagagttaaacatcaagaacttgttaaatatacagaaccaaccagtttcttccagtaacagtttaaaagggacactaatgtccctgcagggtgttagttttcattttctgatttggcttcttgaatcctgctcgaaaattaaaagatgatctacatattctccatttgtttcatgctggcggagtgtaaagtgaactttggcgttatctgatctaggttagatagatatttattggactagcccagaatttcttatttggttttcgtttgacgaggacaagttatgagtattagtattacctgtgtagttggtgcttggtttatgcaaagtacatagtttgtacaagcttatcaacaattcaacatactacttatttgtgtttgaactatgttgccttaacaggtgggaggagctcaggttgtctggacaatgcaggtgcagctgggactctttatgaagaagtgcctaagagtattactgttagcaacaataacttgagcacacaaactgatacagtttttctagaacccccatatgatccactctggacaaatgtttttatcaagaatcatgccaaagtttctcttcccttgcgttggagtcgtattcaggtgtgaggcacttagttttaaagtctattctgattgcttgtccataaacacttcatttgtttcgtttttgtggagatgaaattgcaaagacataaattattttctttaaaaaggatctgagcctctttttctttcttaaattgggaggaggaatgctattattctggtgacttccattatgggaaaaaatgttcttttttactgcatgtcaccttggtaaataacatgagttgctgttccctgctgttgagctatttttctgtccttattgggactggcaggtataggtcaacagggatacatttgctgcagcttgcagctgatattggactagtattttctttaactaaatgtttctttcattctagtcactatagatatttcaggtacccttttttcaatgttttctgattttcaagctcaaggacaaattagccttctatctcgcgctacattaacttttggcttgacacactatccatattcagagtttgaattgttggctgaggaacttcttatgagtgattctacaattaaggtatttatctgctgttacttcatgcagatgttgtattccttttgctcaattttaacccattatgtggtgtatctgcacctcacgattcttaaatcacattcaggtgtttggtgctttacgaatgtctgtaaagatgcttcttatgtggaactctagaatgttgattgatggtgaaatctgcatcgctaaaaataaccagaannnnnnnnnnnnnnnnnnnnnnnnnnnnnnnnnnnnnnnnnnnnnnnnnnnnnnnnntgaatgcgatcatcaatnnnncccagggggggngggggggggtatatttgtatatttggtgatcagaaggagccgacgagttgagtgagnacgtgagtgatgnntagagagaagcacgcgcaccagtgtattaatcacggaggtgg

SEQ ID NO: 40811 - DNA, 2201 bp, Oryza sativa
  unsure (1)..(2201): unsure at all n locations
cgcgtcctccnattttgttgcactnnnnnnnnnnnnnnnnnnnnnnnnnnnnnnnnnnnnnnnnnnnnnnnnnnnnnnnnnnnnnnnnnnnnnnnaaccagcgagcaagcactggtggagaaaccatctttcgtcggtcgggcgaattccacaatagtcccggttgtaataaaaaccgggactaaagatgatctttagtcccggttaaaaagggtaacggacatatttgatctttagtcccggttggtaacactcccggttcaaatgctgtcagggcttgtcaggccccccgggatctttagtcccggttggtaacaccaaccgggactaaagttcgtaactttagtcccggttggtcccggcgatctttagccccggttcctaacaccaaccaggactaaagtcctacccctgtatatatgtcttcttcctcctctagcccgagcaagcttcaaaatttcttcaaaaaagaggggaggtcttgccaaaattgctagtgaatttattttggtgattatatacaaatcggaggtgcctaaaaggttagcaacttcatcctccaatgttttttactgtcatattacatttggagctatgttttgcacacttttttgtctccaaaattttgttgtaagttgatgagagagaatttgtgtggggaagaaagaatatatagaaatttagtttatttgctaaataaggttttataaaatagttgagaaggaaaatatagtgaaagttaatcttaaataatagaaaacaaactaaaatgaaaactaaaagaagtaaaacacattaatattagtttaaaactttagaaatagtaaataagaattatttggtgtaatattttataatttttgtatgaataatgatatgtcattattgtacgagtgttgaaagagtttgtaattattttatcattattgtatgactgccattattgtacgaataattatttgtgtacgattttttttcatttcatgtagatggatcggcaatggatgtacgctgaccggcagtccaaagagtttattgacggcgtgcattattttttgagagtggccgaagctaacaggcataagggttttatttgttgtccatgcaataagtgtaagaatcagaaggagtattctgcatccaggactattcatttccacttgtttgagtcggggttcatcccaagctataactgttggacatcccatggagagcaaggggttgaaatggaagaagatgaagtggaagacgacaatatttcggactttgctcagtactctggatttgaaggaaatcaaacgggcgaggaggaaatggatgctgatggttacgacgttgcggatgatcttggtcagatgttgcaggacgccaaggaggactgcgaaagtgaaaagggggcccataaattggacaggatgttagaggaccacagaacgtcgttgtacccaggttgcgagcaggggcacaaaaagttggataccactctggagttcttgcaatggaaggcaaaaaatggtgttagtgataaggcatttggcgatttattgaaactcgtcaagaacattcttccggagggaaaccaattgcccgagacaacgtacgaggctaagaagatagtctgtcctctaggactggaaattcagaagattcacgcatgttcgaatgattgtatcctatatcgcggtgtggagtacgagaacctagaagcatgccccatttgcaaagcactacgatacaagattagaagagatgatccaggagaagttgatgagcagctaacgaagaagagaattcctgctaaggtgatgtggtatttccctataataccacgtctaaggcgtttgttcaggaacaaggggaatgctagaatgatgcgatggcacgctgaagagcgtcaacaggacgggatgctgagacaccccgccgatggttcgcagtggcgaaacatcgacagaaaatttaaagactttggaaaggacgcacgaaacatacggtttggtttaagtacggatggcatgaatccttttggagagatgagcagcggccatagcacttgacccattacgatgtgtatctacaacctccccccttggctatgcatgaagaggaagtacataatgatgccgattattattcaaggccccaagcaacctggtaacgacatcgatgtgtacctaagaccactggtcgaagatcttaaa

SEQ ID NO: 40812 - DNA, 1822 bp, Oryza sativa
  unsure (1)..(1822): unsure at all n locations
cattgaatttcgcgtagaatttaattaaggaccttcgccattcggggtccttgaatcacaccataaaggaagactacggggaaagggaactctcgaaagaaagccaatattgcgggtagacaccaatttatttcgtaaagcccatttcacagttctgcacaattcttcattggtggctccttacatcgaggagcacttggctctaattcgcgccagaaacatcagtaagtccgatgcatggattacaaggcatcacattgatactttctccacgtggctgcgacaacatctcatgggtaacgagacgattaaccaacaactggccttcctggcgaggtgaccatctggctcgatcgcgacattccagggatatgaaatcaatgggtacacattctacacgagagcccaagacatgaagagcacgaaccagaacagtgttgttcgtatcgatgccatgggacacgatggtacaactggcacgtattacggtgccatcgaggacatatgggaacttgactatggacctctcaaggtccctctgttccggtgcctatgggctaggttgactggtggaggcgtaccgattgatgacagtgggatgacaacggttgaccttaacaaggttggatactcggacgaaccttttgtccttgccaatgatgtaacccaagttttttacgtcaaggacatgtctagcaaaggaaaaaaaggctaaagggcttgacgagccgaagcgccacgtggttctcccaggaaaaagaaaaatcgtcggagtagagaacaagactgacgaagattacgatcagtttgatgggcaaccccctttcacagtgacgattgaccctagcatcctcctaacaaatgaagacaccccttactcacgtagcgatcacaaggaaggaacaatagtgaggagaaagtacgtgcggtcaaccgtcaccgctgatgtattgccgtaattgttgtgtacacgatgtaaactattttggatgtactgaatatccatacaaatcaattgttgtatggcatatgttaaatttgtatgattattagaatttttatcaaattgaaatcatccatatgctagttatatatgattattagattttttattaattatgtataattattagaattttaatcaaattgaaatcatccatatgctagttatatatgattattagaatttttaaaggttttaaatcatgcacgtggtatttacatatgttaattataattttcaacagtttaatatcatgatatgctagttatatatgattattagattttgtattaattttaaatcatgcatgtgctatttacatatgttaattagaatttttaaccatttaatatcatgcatatgctaattataaatgattattagaatttttaacaattttaaatcattcatgtgcttattatatattatccacgtattctagtacatacaataataatttttcaaaggttttatcattaattgttcgactttaaataattgtaatgcatcatttactattttagaaccacatatgcaatgaaattcaagacacagctgctattatcttcactcccagttcctaaccctcaccgggtttaaaaagtattttaaaataccgccaaaagttctttagtcccaattgctcagaacaagggcacctagctnttnttcgccttaataaagtgctactattcntggngcccaccgggngnnngggngnnnannnggtataaatncaacaaaantcgatcatcatccagagtacaacaaagatcatcatgattgacaacgacacatcatcaagatgataacatccag

SEQ ID NO: 40813 - DNA, 1057 bp, Oryza sativa
  unsure (1)..(1057): unsure at all n locations
tcccgattcacccttggaccaaaaggctgacgggtgggccccaattccggtggacccggtccgcgcacccttttccttcggctgacgcaataaatgagatttttaattaaaatttaaatgaagaaattcgtaaatatccttttaaagagcatataaacttcaaatggccatatcttgggcaatttgacctcggaattggaccgttcaagtctctaatttttccttaagaagtcaagaacccatttttgtgctttgtttctgctgttatttggagtttattagagtaaaagccttttcttttccgttggtcgtgtagacgctgcagcttcggaagatccgctcttcgtggaagttgaagccggcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctattcatggttccactagtataaatttaggtagatgcttcgctgattaattaggcaacattaggtggttttataactttagactttgggaattctcatatcatttggacactatggaatggttggcttatgttggaattggacacacacctccccctcttttcaaaacccccaaaatgggttaagctgggctcgaggtgcgtggttgggttttgttagtcggacctcgggtactataaggattaagcttgggcctctgttgcaaagcactaccgtacttccacatgtctagtgggtaaggcttagtttgtggctcaacctggttataaacaaaagtacacggattggagatggatgaagtcgggggtcgatggacaatttccagggcaaatgaaggctacacgagcttcggcccggtagtcgagatgtcatggcagagggttggtgccctgctgctatggggcn

SEQ ID NO: 40814 - DNA, 3824 bp, Oryza sativa
  unsure (1)..(3824): unsure at all n locations
ataagtaaaatatatgcttatcatgcaaggttcatcgcttaatatttatgttaagtactctagtactaatactttggataaaaaatgaagttcttggccaaggctagagtagtaattgataatgcaaacgtagtgtttaggttataggttacatttatttgttgtgtgtttcatgggctatagaggtaggcgacaaatggtaacagccttgatcgtcttttgtagtcctccacattccggtacgtcattgggctgtaggctggattcgcttggcagaccaggggaaagtcggtgcctgaagcaagtgatagagttttaccttaacttaattgaagaattttaacccatagaaaccctccctactctccgcctaccattttgttgttgttggatgaacttgatttcttgatgttatacacatgttccttgtgattcgatacccttggaatactctgaggtgaagtgttacagcgttatccgtgcgcttgcggatttatttgtgatcgtaacaaataccaataagcatttctggtgtcgttgcttgggaatagttgttatattatctttgaacctagttctccctggtatcttttctttttatttcttcttttcttttctttcctgccatggagtagctatctattcaaaactcattctcacatttgactggctttataaccatggttcaggggcaaaatccttctcggggtgcgacagtgaaaacccctaccatcatctacgagagttagcaattgtgttcatgcctgacaatctcaggcatgacgcaagaaactttgaagtggaagttgtttccgttctctctcatggagagggcggaacaatgatactctcataccattaggaaaacaaacggtgaatgggaggaactcaaaagtaggttctatcttgcttttgtcttgttaacctatgttgtctccctacggatggaagttctcggttttcaatagtgcaagaaggaatctattgaagtagcttaggctaggatttcattgttaactcaatttaacccagatttgtctatactcgaccatgttacaatatttcggtttgggtctaaacaaggactctgcctcatatcccgaaggttcgtttgcacacaaaaccacaacaaatggaaggaaactcttggatcttgtccatggaacatcttgttcgtccacaacgaaacatctcctgctccgggtactccctatgaacctctagaagataattttctcaaggaaattgtgagggaattaactatcatcatgagcgatgaatggttaagagatgtagaggtttcttccgaagtaattcggactagctccctatcgtccctaactatccaatgtctcgtgatggaggttacagtgaatgttctcgataatcccactgccggtgctaacatcatgtccacaacctttgtattaacttgcttaggtgacaagccccaaattcaagttcttgattaatcatttatctacaattgagttgctatctttcgtgttcttgcttgtgttcttcaatacgcacgtagggattagtcttcttggcaagatctatcgggtttcgacatggttgatactagaggagaagtggtgctgcgattgcagagttcggtgttcttcaatacgcacgcagggattagtcttgttagcaaggtctatcgggtttcgacatggttgatactagaggagatgtggtgctacgattgcagagttcagatcaacgaagtcagctcgtgttgccatcacgagccattagtacgaaccgacaaaacctttcggagttcctcaagtcctatcatagaagtttatgggattctacgtggagtgcctatgaggaacgagaatgtcgaagccaccctagacttccacgtgttcaaagtccctgacttcgatcttctgatcgactatcccatagaaaaacttctataatgtgcctaatccagattgtgcctaaggagttatgacggtcgttgaaaatgccaaaaacaaattgatcccacaacgaatcgtcatgggatggaggatgtgcctagattacagaaaacttagcaaggcaactaggaaggatcactccccgtcgccttccatcgacgagatgctagagcggcttacaaataatttcttctgtctccttgatgactattctggctatcaccaaagtcctattcatctcgatgatcaaagcaagaccacatttgcttatcgtcgaatgttgttcgggttgtgcaatacacccatatcattccaaaggtgcatgatgtttatcttctccgaaatgacgaatgaaatcatggacgacttctcagtctatggaaaaatcttcgatcattaactcgagaacttagacaaggccttgcaatggtgtaaaaaaaagaacttgatgcttaattggagaaaaaaaatgtcatttcatggtcaagaggggatagtcctaggacagcgaatttctgaaagagggatagaggtggagagagcaaaaatagaagtaatgaagcaactttcatctctcaacaatgtaaagggaatccacagcttcctaggtcacacaaggttctatcgatgcattaaagtttttttctcaaattgctaaacccctaacttatctgctagctagatatgctccctttgaatttaatgatgagtggttaaaatctttcaatttgttaaaagaatctcatcttagcgccaatcattcaacctcctgattggttgttggcttttaaaattatgtgcgagtttagtaattatgttgttggggtcattcgtggttgaactaaaaacaggaagcactatgctattcgatatgctagtcaagcatgatagaaagcaaagtcagcctgctagatgctgaaagagacattagctcaattctactccctcctttaactaagtatataaaaaaatttagcaacatctaaaatattaaattagtttcattaaatctaacattgaatatattttgataatatatttgttttgtgttaaaaatactactatatttttctataaattggtcaaacttaaagaagtttgactagaaaaaaaagtcaaatgacttgtaatatgaaatggagggagtagaaatctgataactcgctcttttccacgtcaacatgaaggcaggagactcggagaagttctgaacaagagacattctttccccaccatctcatctctatgattagctcaggtaagtttataattctatggtgtccagatcctacaaagaatggatcaataaaacctttttatgtacaaggaaaccaaatctgagactgcacaaggttaacaaatggactataagcatgcatctgtaagaagcaatgtactttgtgtacttcgcttcctctgacgggccgaaaaagaatcaactcatcccctagccttcctttttatcaactcccaaaaactcgagttgccaaaacctctgatgatcaattcagtgatacaaatgccatcactgccaaaatatggttgggtcattgctataaactgcacgatcctggatctctaagatagagacatgccaatcgacaagtcttgcttggatgcatttacataacacaagtcctgttgggaacagccaccagctagtatcatccctgccaaaagtaccaatgcttgtgtgaaaagaacagaggcagagtttttgaggtagcaacagttatggtagagcagtagcgaaatgtcatttggttttcagctaaggtaacttacccgcccaaattccaaggttgcatgcttggatgccttttggctgagggtaccgagctcgaattcgccctatagtagatcgtactcgacntcaagggggcg

SEQ ID NO: 40815 - DNA, 1598 bp, Oryza sativa
  unsure (1)..(1598): unsure at all n locations
taaaattagtcaaggttttagctcaagatcagttcccctgggtagaaaaccctggatccctttttagcccaggcttttttgacacatcaagaagtgggaaaatactgcctaactgaatacactatagcaaactgtaccaaataaaccgaaactgtgtgttactgttcttgtgattgtggatgtatgagcaatgataatagccaaccaaattatataatttccccttttttggaacctaaagcatttgaaatgaactggtaatatcaaaatataagtacagtcaaagatgagtactcacaacattaaccaatgatgtaatattccacagcgcatacacacgagcaagacctgctgaccgccgtggtccatgactaaatagagcatttatcccagcaggaaagggtgccagtatcccaagaggaagaacaaacagcactaacaacacatcgatcatagaatatgaatatagctggagaaaagtaagcaatactaagctgaaatctgcaagaagcaatatagagatcaccaaaccaacaagatcctgcaggaaagaaaaagaaccttggtaagttcaagattgtgtagatccatcataaccaaactaggggttgcaatgatgtcaggatagctgtgcaaaatggaagtcacctgatgcccaactggtttggtattgtgcaatataagagaaagagggtaaaataaatctctcttgtccttgagtgtccttaagttgtcaatgtcgagaactctgccagttattcttttaagcataacagcatcattgttccttgagtggtctagttgagaatcaacatctgtgttctgaaatctgcacagcatggtacggatcagtgggataaattttaatatgataagtgcaaaatgtgcagagctaaagcaaatgactcactgcgcatgataatcaaatttcattctagagccaccttgaaggccactactgaatggtcccacagaatgaataactagaccaaattgatagtaacctagtgctgtagcttggaaccatgcaaggtcaacacgcacgcggtatgtgttcaaagcaggatttgcatgagtttcaagccatttgagtacaggaagaaatgtggcttttagatttccacgacgagccaaacgcaactgggcgttcaatccagcaacaaggcggtgccatattgatgaaggtacaccctgtaaaaatatgttcatgttatatgctaataaaatgaattgttcacttagtgatccagtacagcnngnnaggtttcagaataaacctgactaataagacttgtgaccacactgtcactgtgaagtgaaaatggagccatgtaacttccatcgcctccaaagattaatgacattggcaacctttgatgaagacgaggggggaggtcaggccttttttcatccccaanaagaaagaaatctaaataacccagcattaaatctggtgtagcagcaccctatcaaatggaaaaccagaaagcatacctcaatccatgatgtgannagactgataattgtataaaaattcataatannnnnnnnnnnnnnnnnnnnnnnnnnnnnnnnnnnagctcaacacaagggagcca

SEQ ID NO: 40816 - DNA, 2597 bp, Oryza sativa
  unsure (1)..(2597): unsure at all n locations
ncctattattttttagaaaatttaaaaccatagacccaacgacatatgtatttgcagattagacgccataattctgtcactaaatttatttgatctgcacttgagacgcatacaaaaagaaacaatagaaatgacctcggatgcttatgtagacagcacgatgagggagctcatttgtagggcatggaaaacacaaggacttcaaagacccagtaatgttcttatatgttcttaaaggacaggcctgcatcgtgccataaaaaccgttgcagcaaagtgagaaaataagtagtatggcaggttggactaaaaaaattgaagtgcaactatgacatgcggctatgttgataagaagacatgttatctgatttaaccaaagaaccaataagctccaaatatatcaataattcgaaaatagcaaacacacttttgctacaagttaccttgcaaaatgtgccataaagaccttttgggcaatcttttcctgtcactgttccattttcacccggaaaaccttggccatcaacggttcctcctctgcacaacaaataataggcagtatttttttggtcaaaaaggaagagtcagcatactgtttaccaatcttactgtacatggctgcccacaccacacagaatcaaggctctggaaaatgggaaggtgaggaatgggggttgctcctagtttgcttaacctgctctactaactattactccttgaaatattccagaactacgattaaggaaatgtaaggacatccaccagcaaaaagcatcataaacttagaactttaaatataagaatgcagatgtagcagcactttagcatcatgaacagatctagctagtaaaacagaaggaaaaaaatagaacaaacagagaaaacatcagaattaagatgcaccttgcaagtattgatccattaactgttgcaaagggaatataatcatctccagtgggaatgtcagaccagtggaagtgaatccggccacctccacctccgccactaccattacttccaaccccaccagcgctagaaagtacagagccctcctccaaggacaatgccctcacaaatagaagaattgtgcccccggaaccaccaccaggtccttcatttgcagcatgagtcaccgcaccagcaaaactgccaccattcgcctctattgaaccagcaagggagagtagtggaagagattgctccaaagaacccattactggaaatgtgcagatgaaaggcagtaaaaaccagtactactaagagtaacagtgactgaatagaggatgataattgacaaagatccatatgctcgatctctgttacctattataccaccaccagctgttgaagatgatgtacttacattaccactaccactgccaagttcacatggtaaatcagcactaccatatgcagttccaccccctgcatgactgccactgtagaaagcatcccctcctttaccaccatgcccacccccaccactaaggccactgcttaacattcttcctcgtccaattccacctcggcagcctgcagcagggagaaatcaaatctaaattctacaatagtttacagaaggctgcattcaaaagaaagatatcaaaagaagctatatgttactattaaatgtgtacatagaaatactgaagcttaatgaaatctccattatgaaaaataggtatactgaagcagtaactattcaaacaaaaataattttcaatgctgatgattcaccaattcacgaacaaacagagaattaagacagcttatctcagatcagacagctataaaataagactggtagatgtaagactaaaaaaatgccatatttttctagtctactcagttggagctgtgcacaagatttattcactgctataaacattatagcgtgtcatgtcatttgaaatctcgagtataacagggcaaatggataatggccatcagtgacataagcataccgatttaagcctaggtaggcttaccatatgacaaatttttgaagtgattattgcaacattgcagcaaggactagagaatagttatcatagccataggaagctatcattaaactaaataaggtttcctttcgaatatttagttaatcaatagtttgtgattgcagatcgaaagcagggctgcactgtgcaatgccacaatctggatacgggtatctttaacaactcctgtaagaagttctatctcacagcttaagaaattatgcttccaataaactgttttatccagagtttaaacaataaagtgcttctcgaaaaccaccacaatgctgaacagaatcttaatagcatttatggcaaagaagaaaaagttacctaatcctgttgcactaatggtcccagatgatctcacagtgacatttcttgctctgttgaaattaataacagttccttgcacaaggccagaaacaacaatgtcttcaacacggcatatctgcgtgtcaaaagctaaccatttgttacatgttaaatgaaaaggcaaaatctaagatannnnnnnnnnnnnnnnnnnnnnnnnnnnnnnnnnnnnnnnnnnnnnnnnnnnnnntgcattcaatgcgtcaattcgccccatgc

SEQ ID NO: 40817 - DNA, 5173 bp, Oryza sativa
  unsure (1)..(5173): unsure at all n locations
ccttagaaatttaagttaatttatagaatttaaaaatatggtaacaaaaaaaaaaactcttttattaccccacaaaagaccctcaaccaagaaaaatttcacaaaaagttcaaccccttgcttattttcctataaaattgccggtagaaatgcaatcctatgaaaaattttctatcctcttcttatgaaacaaaagggctttatagaaaataaattctctaaaattcatttgctaatcctcaatttcaaaggggctaaaaaaagccgttgtggattgtaaaatttggtttgcatcttggagcatcatcactcacgccgccgcctactcccttccgtcccaaagaaaaacaaaccatgggtttccgtgtacaactttgactgtccgtcttatataaaatttttttataatttatattttcattgttgttagatgataaaacatgattaacattttatgtgtgacttttctttttatttttttaaataaaatggacggtcaaacattagaccagagtttgtcttttttttttttcggagggagtacgtaggtactacagtcccagaaagaaagtggatcctctcaagaaagaagaaaaaaaaataaataaaagaagacgaaaaaggaaatcgtcgtgcggcgtccgctcgtcgtcgactcgcgagttcggccgccgccaccgccgccgccgtcgccgccgatccccatccatcccgcgagcaagcaagggcgcaggcatcctggtgagcgcccagcccatcctctttctcatctctagaaccacgcactttacttcttattcttctcgaatttgcgtaaaccctagcttctgttctagaaatttgccgcaaacaacagtttgtttgttaaaaaatatagtaaaagtttgcggattccccccattttagatccgcccctgggcttggctagcacaacattttttagtgggggaaggaagggaaaggaatcggtgggtggatcgatgcgagcgttcgcgcgaaatctggcgggcatcattcctctcgcgcgctgcaatgcgacggcgacgaccgcggcggcgccgtcctccctcgtcctcaaggtcggcgacacgctgcgcgagcggcggcgcttcacggatggggaggtggaagcgtacgccgcggtgagcggcgaccgcaacccggtgcaccttgacgaccccttcgcccgccaggtgggagggttcggccgcggccgcgtcgtgcacggcatgcttgtcgcctcactcttccccgccctcatcgccgcccacttcgtacgccgcccctctcgtctctctctctctcgctcgctctcatgcctgccagatggtgcaccggcatttcgtcgagcactgcatcggcatgacgtgctggcctggcccttctagtatctgatgctgatgctaatgcagcctggagccgtgtatgcgaggcagtcgctcaagtttgcggcaccggtgtatgtcggcgacaaggttcttgtgcaggttcaggcgctgcacatcagggcctccacaaaacacatgtatgctcaattcatcttttcatttcctagtcatcaagactagattgtttggagtgaatcatcttctttctgacagtgtcaaattcggaaccaagtgcttcacgagtgacagtgatgacctcctagctgtcgatggtgaagctatggctgtgctcccctcgctttacctcagacaacaactgaaccaagtgcctcccatcgttgattaaagactggaagcatcgtcaggagtgggacaatatgtgatttatgttcttttgggtctgtagatgctttgacaagataggaaggctatatgttgttttgctgttctcggtagtagctggctcccttgttaagctggaattcccagccttctgtacttcatcaaacctttattccgtttccaatagaacctggggtaaatcccgttataaaaaaaaagggtacatcactgatggtagcactggctagtaactctcagtgcactccattactctaaatagaagtcccatggtttgggtcctttgttgttaaaacatttataatgtctcatgatttagtcagacagcatcttcaaaactgagcttgcagagcaatttgtttggtttgtgttgctcactttagtagaagatgatgtaaaatctgcactcgtgagcgcctgctcaacacacaataaaagttcttgacatattgttcaagtcatatgggttttaactataacatgtcaacctggttattgaacttttgcatcatgcaaagagcaacataataactagaaagagcgagtgtcccagctcctcagcattatgccactcagccgctgccactggccaccatgccttgtgcatcgttcctaggtctttggcattatgcaatgcctaccatgactctgttggtggaaatgttgatatactaggaacaccattttgaagtatcataaattgaaagtgagttagcactcagcactcaggcacatatgggcattggatcaacgccaaccaggaccagaaacaaaagtctagtgcaagtcagctagtaactgaacaggtagtttttcatctttttacaatatttttctttctctgatctctgttttttcttttcctggatgattggtatttgattgaaatgtgaaatatgaaatcaatgagttcaaagatggcctggttttatgatttagattaacttgaatcaatcaaatatgaaggggaacataggcattctgtctgtctttagcaaagtaaatatgtagttgcttgtttgtatgtcagctttgagcccaaccagctttattcttgccatgcttttctcaataagtctcaagtatgagcattatgagacttccaatttcatcttaataacttcactgataacatgtaaattgacgataggttcaagcctgtaaatattattaacttcattgagagaggcaattgcgctgcgatgagctgctctgcctctaaattctgagaacaaaccaatagcaagaacttagcaaaaagggcattgcctgccctcttgtgctaatccattggtaatgttgctactgctactgctaagtactatactgcctcactagaaatagagaaaaaaatactccatgtgacaaagctaaaactagaataatactatcacatggttttctatcattggtattcagttattgcaactgaagaatgcgaaagttggtatcatgttttagtggcatgaaattaactattacgcgtgataaggaggtggtgttaatctcgtatcaggaatatgtcaggatgatgttaagcatttaggggctgtttggtgcgttgccaaaaattatgtcccttatttggtttgtagccacaaatttggcaatgccaattattttggattggttaagtttggtagcaatccaaacaaccaactctaccaaaatttttggcttaccaaatcttgctatagcaaaaaattggcaaggctagcaatggttgagaagaaacaaacacttagatttttagcttatttccatctttcaattgctgatgttctgggtatggatgctgcatctgtggcataaactaaatgaaatcctctttctcgtaggcctcactcgtgtgccactgcccaaactggcagatcttgataggtggctttgcaatctttggccccctgaacctgtccttctccatggctggggccaccaccacctcctctcccctgcggaggatggagtctgtctgccgccacctcctcccagcatcaccgcctatcctttaccaggtacggctaccttaagaggaactactgcaacttatcctctctatagcctgcagtcccatcgagtacctttctaactagtgtttcttgggcttcagttttcttgtgttctaatttttatgttgttttctgcacagaatccgttaggtgccatcaggctggagtcatctccagtgattattggggggatggtgctggacatccatgccaagccatccatgcagccgcatcctggaacgactgtgcctgggatggtaaaccacccatccagctctttattaacttcttagcttgagcaaactgcttatttgctggtatgcaagaaggatggcatatgtgtgtgattgaatggatcagcatgaccaataatactattcaatgtaaactagtgttgaattcattatatgagaaagaaggttctgcaggatgatgtttgggttgtgatatccataagcttggtcctgtatgcatcttattcatccagaggtttaggccataaatcttgtgagctttaacttcttccatttcaatcatttatgagaagttgaagtaggatgttttttttaaacctttttaatttttaattgtaaaaataaacccttccaaaacttattttcaagatctgaaccttttggccatgccaaccaggctggcgtggcaaaacaatactgtcacgcctgctacgggtggtgtgttagtgttgttttgtcatgccaggcgggctggcgtggccaaaagcttcagatggaaaaaagttttgggagggtctacttttaaaattaaaaattcaaaaagttaaaaaaattaaaaaatcaagtaataatgcatttgaatttcctaggttaagtacgtcagtgggggagtagcaagaaatattgccgagtgcatttgtaagcttgagactcgaccattcatgattagtgttgttggaaatgatatggcaggtatttcttttatctatttgtgaagatatagtttttttctaaattggtttactcattttgaattactctgtccttttctgctctctgggtagttatttgcttcaatactttccattttttctactgcaggggatttccttttgaaatactggaggtcggctggactatgtacagatggtaagtgtgaagatattcatattgttgtatacatccttgaaattacagtctaatccttgttatgtttgttaggaaaggctgtagtttttcatgtnnnnnnnnnnnnnnnnnnnnnnnnnnnnnnnnnnnnnnnnnnnnnnnnnnnnnngcactggcaatgcagtccattnccctcgggnggggggngggggngagagagctattaaataaaagagagtaagtcgatttgaggaatcgcggaaagagagcggagagaataggcagcaggagtagagagcacgttgtaatgcgg

SEQ ID NO: 40818 - DNA, 2481 bp, Oryza sativa
  unsure (1)..(2481): unsure at all n locations
tggcctccttgtgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgctatagcaaaatcatcagtggaatctgaagctaatatacctgataagttttctgctgcaactatcgcaggtctgctatagtaatttgttttcatcttgtatagtgtacttctgaaatttcagattagatcttagtgctgtcaaatttattttattgcacaggtataactccttgcatttccatttctcatgcagatgatgcaagaagaacattgctatcagctaaaatgatgtggtgcaaataaccattggtgttatctcgtgaaagtcttggtgggcatgtaatttcctaataccgtttgttgattaggctatatatatatatataaggctgagtgtggattcaggtcgtgggctggtgacaacttagcaagtttaatgtagtagattaaggagcacggcaggtttctaaatttgtttgcatgtacctatgcctttatacttcgtcagtttctgtaggctagtgatgatgccacgtttgcatctgtatgataatgtcacatcagcgtcacgtaggatctcgaaaatggtcgtggcaatcttgaaccagaatgatatattttgtggtactaggagttctggtggatatcactatataaaaacaatctctgtgagacaaatcttaaaactaaaaagacaattctcttagggagtagggaaaagatgcattattttcttttctttgcttgtgatgattagttcatcaagttggtaaagtagcttgggaagtcatttgatacgaaaaagctaaatatgaggaaaataaaggattggtgccagaggactcacatgtatgtgtgtgctcatagcaagacacccttagcactttaagcataagcatttcccaaatttgatttaaaatggaacatcatactatatttttaatcttatccttgagctatgttgagatagatgagtttcaaggagttaggagcgggaaggcgaaaatgctaataaacggtcatccgcgtgcccgctcccctgcgtggcacgttggcacgcgcggaggggaggggcggggggacgcgcgcgtgggagtggacatgtgtcccgctggtttctgatatctttttttctttggttttttccttctttttttttggtttttcttttttttatacatataggatacaaagtttgtatacatgtatacaaagtttgtatacgtgatattatttctaggtttttccatatttttttaatacgtacgtatataaagtttgtatacgtatgtatacacactttatgtataaatttttatacataaaaaaaacgtatacacattaaaatatatatttttatatgtatgtatatatacgtataaagagaggagagagaggaaagactagagggaggagggttgtcgtgtagctcgtgcgtcatgcgcggcacatggatgaccgcgtatcagcaccgcctgcgggaaggtggccatcatccacgaagttgtgggtatccctttactctatacgacattttccttagctgaagggtttgatggctttaaattgacttcgccaaaaggcctcatctccaaagcccagctagcgaggtgtccctctcagtgtagagcagagttcatcacctcgctcttgtgagagagaataaggggaagctctagaggagtgttggagttgctgacactctttccactcttgtacctcgatggatgtttctttttataaaagtaagtgttcatgctttcttttggtatttactcttcttgtataagtaaaatatatgcttatcattgcaggttcatcgcttaatatttatgttaagtactctagtactaatactttggataaaaaatgaagttcttggccaaggctagagtagtaattgataatgcaaacgtagtgtttaggttataggttacatttatttgttgtgtgtttcatgggctatagaggtaggcgacaaatggtaacagccttgatcgtcttttgtagtcctccacattccggtacgtcattgggctgtaggctggattcgcttggcagaccaggggaaagtcggtgcctgaagcaagtgatagagttttaccttaacttaattgaagaattttaacccatagaaaccctccctactctccgcctaccattttgttgttgttggatgaacttgatttcttgatgttatacacatgttccttgtgattcgatacccttggaatactttgaggtgaagtgttacagcgttatccgtgcgcttgcggatttatttgtgatcgtaacaaataccaataagcatttnnnnnnnnnnnnnnnnnnnnnnnnnnnnnnnnnnnnnnnnnnnnnnnnnnnnnnnnnnnnnnnnnnnnnnnnnncaatntcaaaggngggcgggcag

SEQ ID NO: 40819 - DNA, 1419 bp, Oryza sativa
  unsure (1)..(1419): unsure at all n locations
cggaaaattgattgcacttcagctacnnnnnnnnnnnnnnnnnnnnnnnnnnnnnnnnnnnnnnnnnnnnnnnnnnnnnnnnnnnntctggcaatcaacagcatgataatcacggctcccgttggcattctatggacagccaaagtgctcgacatctcatcaaggaaatcgcagatgcaagaaacctccatcttggggtcaagagtgtgtcttttggggaggggagagtgagtaattttgggcatagttctcaccttggcaatggtgaagccacggttcctgaagatgccaagaagattcacaaatttgcagaggcactgaagacatctagaccaggttctaggtcatcaaggaaggaccactgataaacaaatagcataggaacaatctgctgcagagtgcagtaggcccatcttcctggatgtatatatttctccagttcttgatgggagattacttatagaagatgctactggaataaagcacacatgctttattctgtgtaaaatgtacaatacagtatatagtagtgtagtgtactaacctttaatcccagccctcaaactattcatttggggttggcttgtacttattcagtgtattgttcatgtattgctctatgcatacttcactccagctacaaacatacagctctttgacaagttatttatgtgtgcaaagttatgtattttacaatctttatagcctagattagttaagaccatttgtatatttgagtatccaccttactagtatgtcctgctcttcccctgtacagtgatagctttccagggggagggagaggagctagcgatggaggccctcgtggtttgcctaaaatttggattttaaaagttaattttgaaaaaaaaatcatctaagtttattttcaacatctattatatactaaaagtccattaaacatcctacaaacgctttcaagccgtcacaaaaaaattcctacaaacactcctaagctgccatatggcactctaataaattagatttttttttctttaaatatggtggacctattattttttaccataaaaaataaaaaaattgaaaggcccacgttcctctccttccgacctgtacgtgtagtacgcacgccatgctaccgtacgtacgtacgtagatgtattggcccctccttcctttctgttcctctctctctcttatttttgatgacccttctgttcctatctctcctattttgatgatgtggtagagtgaaaacatattatatgactatccgatctaaaatcatatattttttatgcactgcacgtacgtttgttgcataattcaagacccaaattaactatatttaacaagtcaaagaaatatgttagggtaccgagctcgaattcgcccttagtgagaggatatgcatctcatgnntcaaggccccaggcg

SEQ ID NO: 40820 - DNA, 3748 bp, Oryza sativa
  unsure (1)..(3748): unsure at all n locations
ntcgtctaatgaatatacccttaaggcattaactttggagtccatttagattttaggctatacaaaaaccatggaaagtggactaattaagcttgacaaaaatgagatcaccactacgatgaatcacgatgaatcacaaggaaaccttcataggtgcaacgaccacatctcagttgtaggacacaatgactaggagctgtgagaaaaccgtatggtaggggaaaaggaacaatgagtttagctaggtcttacattttcaccaaccccccagaactaatgaaaataaaaaccaccttgattttaatatgcacttaatttgttaaacatgttctaaacaaactaagtctactattttttatataatgataaagattatagatatttggttatactgatgaattaaatattatatagtatataacttagagaaattatcaaagtgatgttgatgaagaatatttgtcgaggaaacgtacttccgaaagatggcaaaggctatctgattaatatgatccgttctcaacccagcccccgatacatgcccacgcgaatccgcgggctacctttctagttggctttaaaatcgctacccacaaattatcattgttttgctaatacaccatacggcttattagtccttgattcaaccgtgcagggtcggcaccacttaagtctagggcagctgccatctgataactgttgttgaccaccttccttagctcaattagatgatctgaaagatagttcaaaccgaaattgaccacatcaaggtttaatagtttctccctccttaacaataataactcatatgtctgctcaagttgattccaccaaagcataagctcagatttacatggcaattgatgaagttctatctaaatcccatccatcaactcatatgtctgctcaagttgattccaccaaagcataagctcagatttacatggcaattgatgaagttctatctaaatcccatccatcaatgattgaattcctaaaaaaacctgagcatcttttgtccatgagaaaacaccattgactaaccttatcatccatcagtcctaatatcatgcatgtattgcacccattatatattgagatctcaagtattgccgtgggccaaaaatccccaatttgtaactgaaaaatatagcattaataaatcctcctcggtatcatgctcatcaattaaaattattccactaactctagcaaatagatagcaatgtgaaaaccaaatcacactgaattccttttctccactacacgatgccttgctgcacttgcgataacccatggtttcatgattttgttggaatgagcacaacaaagagcagttaagtgaatctatactgttggatgctccagcaacttagcaaaaggcagtgtagcagagcacctttttacaccaaaatgtacgctgtacgcaatctgaacaattcagcaactgaccataatacaatttcttggttgggttttataacttatgctttgagcggaactcatagtaggaattgcaactcggaaccccaagcttttggagctttgggctcatgaggtggtctaaatatgagatttttagggctcaacttttgtgtagtgcagatgtgcatctggcttatccaaaaaacttcatgttctttttccttaagttctctgagtattgatttgaggagacattttttggtggctagattgatgaaattttaactgctgtctcaaaaaagataccgcattgccaaaatgtatatggaggatcagaattattcagaaccacctctgcattgcgaaaatagctgagacatgttttccattaatatgcaatgtttgcttaaggtacatataagtagtactagaaacttgcacggcaacatcgagtatgtattgttactatttttcctttttcaagaatatatgttttgtgcattgtttgtctcatcttgtcaagttaccactatggatgttgtcctgttgattgaaaaaaatgagaatgaaccctagtatttcttaatataaaaatctagtgcattggttgcaaactctgtaatccaaatgatggtttcattaacagaatcagggtaaaaccttattcttcaaatcaaaatgcatcaaaatgaaaagcaaaatgtcttgtttcatgaggttcagttgttgtaataggttgcagccttgcagcaggttggcatcacactggaccctggtttcagtccagtggaagacaagtgatgttgcctctaggttcggagagataacagtaacagaagttgagtaaaagtgacaactgacaactgctctatttatccccctctattttttatatgctgtagaggtgtgaacttatcaaatgttaggactgtgggaaaatgtttggtttgttacttcaccaaatttttgaacagatggcgggtttgtttcgtacgttaccaaattttggtaaggtagggatactcgaacatatttggttcgttatcttaccaaaatttgtgatggcttgaaatggtagcaaacaaaacatgcttcagggtttagggttcttaaagccattgcgtagcagggtttacacttccagtttgggccaaaattgtagtatatttcgggcgagatagttgcttacccttgtgggcggggggagcagctcacaacaaacttgcagacgaaacaacaaaaaatgacagaattttaacatacaattaccaccaagctgaccagttgaactggtttgttgtccagctttaaaggaatatgttttgcagatcatcaaaacaatttcttgtgtcaaaactcaagcgcataacagagtcaacagacaaaacaacaaaaaaggggcagatttctgacccgatctgatggactggtttattagttgattcttaagaactgcttcccagatcatcacaacaaattcgaagcatgtcaaaaggtgcttgaattcagggacacagctagaaaagaaaaaaaaaagagatactgcatcttccctggtttctagcaagaacatgaaagtttggtgattgtatctgtacttatgttctgcttcagctggtaatgcataaaaaatgactctaagcagcaccattcatatatattacaaggaaagaaatcataggcatctacattatgtagaatgagaccatgtaatgtactgtaattaatttcaagaaacagtgtttggtacagactagacaaaaggtaagctcaaggtaaaccataattcaaggggggaaattcagacaacctattccaggatgtcatcgtcgatgtcgatcggggtgacctcgccgtcgtcgaactggtccttcctcggaggcgcaggcggcgcgaacagccgtgcagggccagttcccttcttcttgttgcgcggcctcgcctgagatgagcaaacagcagtcagcagatggcaagtctgaagaattgcagcaaacagcagcacaggaagcaataagcatatgatttttttattaattttatttttgtgctagagactcacatttccgtacgagtggttgaacctttttcccctcttggtcttcttgtcccctctcccgcagtaaactggtcacaccaaatggagtaatttgagttggaatcgtaattggttcaaactgcgaggtttttgtttcaatctatgttttggtgctgtatcaattgaattcgtgcaatacgattnnnnnnnnnnnnnnnnnnnnnnnnnnnnnnnnnnnnnnnnnnnnnnnnnnnnnacagcatacaatggcgtcaatggacacca

SEQ ID NO: 40821 - DNA, 1374 bp, Oryza sativa
  unsure (1)..(1374): unsure at all n locations
atggagctacagatgcaatccaaacacaacaaaaaggcaccattaagcattatgagtatctgattggcacaaaaacttttcagcgacagaattttcaagagactgatagctgctatgtatatgttctttattttccttggaactcatactgttcttcttacttccttgagctcactgcataatcacggggaccaacttgcctcagtaactgcatcagcagaaggaacaggagataaccaagttgtttagccatgtagcaatgctgaaaataaggtaaacagaaagagagagagacaaggatgtagtacaacatacctgaaaatatgattccagcttctgcttcagagtggcatgctccctcttcatcttctgaagagacctgcggcatctgaaagagaacatggcctcatcacatcatgtgaggaaattgcatgatgattggatagtatgtgaagaacaagttggacgagtcaatgaaatgcatacccttccagattcctgtcattgcagtttactttgaacacagagcactcattcttcatcctcagtgcaccaatgctgcgccaaacacaggccaactttagcgaattttgaacacataaagcaggcaaagatgacaagctttcggtgagaacattcatattaacaaataatatttgttcatttcacatcaataagcattcttaagtttgaatgtttttatattggttatttaagacctaagacatgattttacactgatgagacctgtaaaagaatattgttcactctgtgttctgggcatatgccccagttttatacctggatccgctgcctttgagttgttgcacaagagaatctaatctgtagaaatcctgagggtatttatcactgcatcaaaagaaatggaagtaaatgtaattgtcatgtctttcaaatcatgggtaatcattgtacaaaaaatcaattatctattcatatcgtggatgcagacatattacttacattgcttgttctatatttgtcaacagtcttgatgaatctttgaagaacagagccgcaacttcctcaacaaaattggggcttgattcatcctgcagttcttccagctgattaaactgttcatcaaggtaaccctgcaggaaaaccacgaggtagattataggcaaaagaaagaagcatgaaatacacaaccaaaaaaaaaacttttgtgcagtccatataatacaaataagtgtactaatttacaagggtaaatctatataattagtcaaagattaaaaaaaaagtnnnnnnnnnnnnnnnnnnnnnnnnnnnnnnnnnnnnnnnnnnnnnnnnnnnnnnnnnnnnnnnnnnnnnnnnnnnnnnnnngnngtccaacggggggtcttcaaa

SEQ ID NO: 40822 - DNA, 2952 bp, Oryza sativa
  unsure (1)..(2952): unsure at all n locations
gaatgcggccccnngtgataccctggaatccgcccaannnancncggtaccctttgaacctgagcatcgtgtttatggtttatttttcctagctgtgttcagaatactatttaatgggttagtaattcagtaattactttggtacctaaataattagtgaaacaattctgaaaattattgggagaattatgggaatatattgacacaggactaaatttagataaccagaatttactatttgcacacttgtcatgctcctacttgcagtacttattgaattttgcatgactaatgtaggaaaatgactgatattgataagagagattttgctgaactagcagtcagcggcaagaattacctgacatgggcactggatgccaaaatcatgcttggtgctaagaaactcctgaactgcattcaggacccaactattgcaacatcagctggaggagttaatattttgccagcttcagttgagaaaaatcaggcactgcatttcatgaggcaccatttgaatactactctcaagaatgagtatatgactgaggaagatccgaaggtcctttgggactcactgaaggatcgctatggccatcaagtaaaggccttgctcctaaaaacaaaacgtgagtggcttcacttacgtttccaagattacaaatctgtggagcaatataactcagttcttcaccgcaatgtcacttgtcttaagctatgtggagagaaaatcactgatgctgacatgatagacaaaactttgtccaccttccatgccaatcatgtgaatattcagaggcaataccgccaggctaaatacgagaagtattctgaactggtctccatgctcatcgaagcacaaggagaagatgagacacttgttgaaaatcatacgtctcgccccactggaagttcagcagcacctgaagcaaatgctagctcctttaagaaggggaaaaaccagaataaccagaacaaagggaagaatttctggaaaaatggtggcaaagttaacaagacgtctttcaagaagaaaggaaatcagaccagtaagtctaagaagggctctactagtggtgaatatggaaagcaagatcaggtatgcttcaagtgtggcactaggggacactggtctcgcatttgccgcacccctaagcatttcattgggctttatcaagagaagcacaggaagaagaagtcagagcatgagtcacacttcactgttgagaatcagcacttaaaagagaagatgggtggcatgcatatcgacaagcaggtcgacgagaaggcagcggttgcagatgcacatcgatgataagatggaaaagaatgcagcagacgcagagctgaagctctcagatgatctcatggactctgatcagttatatggggacatttaagtcttccaatttgtatcttagcttcctgcattataagttactttaaattttagactatgtaatagactaaagttaggtgatttttcaagtgtgcatttagtttgtgttcctagcagaactatagtttctgtaagctccttcagagcgtggttatcttaataattgagtgaactcttttagtttaatatattctccagatttttatttttctatcttaaagtgttatttttgctatatggtcatgaattgactatatttaaattctttatgatagaacagtgttacgtactatggcaatggaagaggagatgtgtctggtagactgttgtaccaccaatactatcttttgagataccacgtatttccagactttaaagaaaaagactggtcaaatcgctactattgccggaagcaatgcacccatcgtcggagtgggacgagcaacagtagttctcccacatggtaccaagatcattataaatgatgctctattatatctaaagtccagtcgtactctactaatctttaaagatatccgtgcttatggttatcacgtagaaaccaaagatgagaataaactcgaatttcttctcataacgaaattagacggaaatcataagactgttgttgaaaaactcccttccttgaaatctggactgtactacactcatataaaacccgaaaatgttgcactgaaaacaatatttaaaaatcctgagtcatacagaatacggtctagggatgatgagaagaatcatcttaacttcaaatggccataatttactaactaacgatttcccaaaccaagaagattttgtttgcactgattgtgcaacacttcaaatggccataatttacgaactaacgatttcccaaaccaagaagattttgtttgcactaattgtgcaacagggaaattaatcgttagaccctctaatttaaaggtggacgcagaatcaccagtattcttgcaacgaatacagggcgacatatgtggaccaattaatccaatgtccggatcattccggtattttatggtattaattgatgcatcaacttgctggagcactgtttgcttactttctactagaaagcacgcttttgcgcggcttatttcccaaataatctagttgagagccaatttcctggataaccggatacaatccattagaatggacaatgccggggagtttacctctaaggtatttaatgcatattgcatggctttgggaattaaagtggaacattctgtaccacacgtccacactcacaatggtctcgccgaatcattaattaagaggattaagcttatcgctaggccattgctactgcatagcaacctaccaactacatgttggggacacgctgttttgcatgcagcggcgttacttcaaatcagacccactgcatacaatgttgtatcccctatgcagcttacacgtggatatgcaccaaatatttcccatnnnnnnnnnnnnnnnnnnnnnnnnnnnnnnnnnnnnnnnnnnnnnnnnnnnnnnnnnnnnnnagagaggcgttctacctgtantaccca

SEQ ID NO: 40823 - DNA, 1241 bp, Oryza sativa
  unsure (1)..(1241): unsure at all n locations
gccccccttgaattgatgccagtcnnnnnnnnnnnnnnnnnnnnnnnnnnnnnnnnnnnnnnnnnnnnnnnnnnnnnnnnnnnnnncgcaattactactagcactgggagaccggaaattcctgacttaaacattgcaggaaacaatgaagatcaggaatgtgaaagaatagaggaaatatccaccaattatgtggatacaggtgaaacatacaataaagagactactattgtcgacatatactttgccgaaaagatcgctaagatcattgatctggacccagaaccaaagtccatggcagaatgcaaaaagcgttaagactgggtcaaatggaaagaagcaataaaggcagagttaatctcgctcaataaaagaaaagtattcggtcctgttgatcgtacccccgtagggatatcccctgtaggatataaatgggtgttcgtccgaaaacaggatgagaacaaccaggtggttcggtataaagcgagattagtagcacaagggtttacgcatagacctggcatcgatttcgatgaaacctattcacctgtaatggatggaattacattccggtttttaatatctatggcagtcaatttgaacttagaagtgcagttgatggatgtagtgactgcatatttatatgggtcattggattctgaaatctatatgaaagtttccgacgggattcaagttcctgaagaaacaaaacgcaacatatacagtgttaaattgcaacgatcattgtatgggttaaaacaatccggtaggatgtggtacaaccggctcagtgaattcctagaaaaggattcatcaagaatgatgactgtccctgtgtgtttatcaaaaaatcagaacatggattttgtattatttctgtatatgtggacgatctgaatatcatcgagaccacacaggtgattaaggaagctagttcttacctaaagacggagttcgagatgaaagaattaggtaaggctaaatattgcttaggtctgcagcttgagcacactcctgaaggggtattgttacaccagtctgcatatatccagaagatattggagaaatttaatatgaaggattcatatccgacgagaacccccatggtagtaagatctctagcagtagagagtgacccatttagaccacaggaaaataacgaggaattattgggacatgaatgtccatatttaagcgcaattggagctttaatgtatctcgcgaatggtaccaagcctgan

SEQ ID NO: 40824 - DNA, 6156 bp, Oryza sativa
  unsure (1)..(6156): unsure at all n locations
tggganngttganacctgnnnnnnnnnnnnnnnnnnnnnnnnnnnnnnnnnnnnnnnnncaataaacaaacattcacaagggataaaagaaaaaacaaattcgcacggccgaccaccacggcggccctccgcaccggccgcttccatcctcgtgcaatggccctgccggccgccgccgggcgccgccctccgcgtgccggccgccgcggccctccgccgtcctcgctcttcgctcctcgctcgatctgcaaggagaggataaggcaagaaaaggataagctccatctgtagctagaaggaaggagaggatagtgcaaagaaaatgataagagagagtaagaataggagatgaggagtttgggaggataagtcctagggattatatacgatacatcgaattttagttccggtttgtgttatcaaccgggactaaagatccgaggggggggggctggcagcccctgacagcatatgaaccaggactagactaaagagcacatagtcccgttttgcttataaaccggaactaaaacccatctttagtcccggtttttattggaaccgggattattgtggtttttgcctgaccggataaagatggtttctacaatagtgaccacttcacctgccaagtggcttaaattgtgccttagctttataatgctattattaatctgcattaatttatggctgtgtaccaatacactggaaatgtttaaattcggtatattcaagatctaccgttattggcagctgaaccatctaattagactctttttagattacatacaaatatttgcgaatctaaagcaaagctaattaccaacaactattttcttaagcaaaggcaaaagcttttaccttgtgttttatgtacacatgtacattcttctttggctaatttattcataatccgaataatcaaaatcttcatgcacgttccggcgcgtccctaatctatccaaaatttagccactggttagacttccatatatattttaaatccgattttaaatcctagacatggcacgggtgctcgcaattacggctaattattttttaattggtaagctacatacccattgataacgaggcacctgtggtgacttcgccaatttcaagataagccggcttagtcttctagaggtgctaatacggataagatatgcatgtgtgcttacagggtgtgtgtgcacgtgttacgagcatctacgtttatactatgtttcttagaaaataaatcagccagtcatattaaattagggatatattaaatttgcagctcgacatgccggaatgtattctatatgtagtatattatcataaagtaattaatttgacgataaagattatacaccaactgttactgcggtgcacggctaacatgcagagatttgcacgcggccaagtcatatgcacatgaaaatgaaataaaaaaatgaacccttttgttatatcaccccgttaattaatgcatcacccccgagtggaaaaagggcgtaatttccggtgataaaatcataacgatcagagaaagcttcaatttatggatgatttttcttaagatgttattattggatgccttaagattacatgagagcatccatatatatggaactaggtgaaaccccgcgcattactgcggaaatttagtatgataacaataaaaaaaatagcgtgtaagatagctagataacatcagattaagtaaattaatgtggtttatgataatttaaatttaaatagtatgtagaatggtgattcaaacttaaaaagtaaggtggtatgactttatggaagaaaaaaagtagggagatagtttgaaccgtacattaatcatctaatggctaaaaacaattgatgtgatatgacttaattagagaaaaaaaggagagataatttggaccatagattaatcatttaagcactaactaagtgaggatgaactatataagtatataggatatcataaaacataataaagatatacactgaaacattatgtgaattatgttggatgataatttaacatgtttgtatttgaaacattatgtgaattatgttggatgataatttaacatgtttgaatttgaaaagctcttaaattataaaaactataaagatatagtatatttgcatgatgtttaaatgtgatgattgttagtggatgatgatgtggcatcttgttaattagtggatgatgatgtggcatcttattagtggataatgatgtggcatctttgcatgttaatcttaaggagttagtgggggataactttatagtaagataggataagcgagggaacacgttgaaatgatgatttgacatgcattgccaaaccaatctcatgttaaggatttattagggtttcttcgcaaaaatatatttaaatggtcataaaaaaagccaatcgagtattaattaatcttgttagaaaattaatactaaatttaattggggcatcatggtgcccggcgggctccaaaatgatatatatcttcaatcatttcagaaattttaattagagcaatagcatgatactgttatacattccagtagtgcgtgctagcaagcaaaacttttcttaatttgttgaacgtaccggatagttctcatttgagaaaagaaaccactacactggacaaggtcacctgtgacgggcccaaaccctcacctttgacggctttgggcttggtcagtgatcagtggtcactggtgagtccaatcacctttgacgggtgaaggaccgtcactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagcagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgttgccactcacttcctcttcgccgccgcaggtggtcgagccctcctcaccgttgcgtcgagccggtgcaccgccgcgcgccgttgagccctcctcgccgctgccgctgcaagaacaaccgcgccggcgggcgggcggatccgtgtcccccaccctcgtggaggctagatccgacacctagcagtcgggggacggcgcccgtggcgcccgccggtcgggaaggggggcgaaggagacggcgacctggatctggcgtggtggaggcaggaaggagaaggctacccggatctggcgtggtgcaggcgggaaagaaggcggcgacccggaggcggtgggcgaaggagctgacgacggggcggcggagagacggcggcggcgacccatgaggctgagggcgaaggaggcggcgaccttcggaggtgggcgaagaagcccgccgcctccgcctctggtccccgccgatggacgatggacggcgccgcgccgctgctccccgagacgagccccaagagccggagagggcgaagaggcggacgtcggtcaccacgacgcggcccccgcacccgccggcgccggtgccgtctccgcctccgacacaggtcgatgaagagagagggttgagagggagagagagatggggggagtggttgagatggataaggatgagccggtagtagaggataaggatgagccgggatgagaggggagggttatgagaaagatttttttttttatcatctttgacgggctcataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacaggtgactagttacctgtgacgggtcacctcctgatggctcaccgatgacggcatcctgtaggacccgtcaaaggtgaccctcatcactgaccagcacttatgcccgtcacagatatgccgtcacaggtgcaaggatctggcgtagtgaacgtagccctttttgaaatttgagttcaaggatatatatgtctagtataagatcgaaccgtatacaaacataatataagatttagatgaaatttgtgttctgataattattcaaatttcaattacaatcataaacacatgagacatacattatactgagatccatcgaatcaatcttgcatttgtcctataaaacctttgtacaccataaaaattgatcaaattcttatagtataagcaaagtatctaccagagttccgaaacactggtttatctagaataattactagactcggaggatatcccgatccaataacaagttgattaattaccaccggttactgaatttattccgataaaaatgcaaatccaataattaaatttgtaaccggtaacatgcagaaataattctaaattttaccttaaactataaataaatatataatttcatatgttcttatggaatcaggatagctagaaattaacctccctccaattaggctttaaccggttatcggctgtgaacctactagcggcggttatctattattgagttgcatacacggatcagttcaacccaaaagattaaacagataagaaaagatggacaattcactttatattccaacacctataaccgcccgtaatggtaatcttggtagctactcgaagcagtgttgccggcatggaggagaccgtgagcgatcctgtctctaacctgttcggcggcggcggagcgcactgtattgccgccgccggcgaccactccgtcgtcgacgagctcgtcgtgtaggaggtcggcgtcgagctccccgccgctgcgctcgcagaggttgtgcagcacgcagcaggcgcccagcatgttggggagctccggcagcttcacctcggcgcgccgccgcaggcaccgccaccgcgccctgagccggcggaacgcgcccaccgccgccgcgcgcgcgtcggccacccgcgcgttgagcctctcctgcgcccacgtcaggttcggctgcgtgtacggcaccagcatccagctcgtcagcgggtagctcgcgccgccgacgagccactgcggctgttgccacccgagcttgtcgtggccgagcagaagcccagcctcgcaccgggcgtacagcgccgacttcgcgaggacggcggcgtcggagagcgagccggggtggccgatgcagacgtcggtgaaggcgccctcgtcgtccacgacggcctgcatggcgacggagtaggtggccttgttgttccggtcggtaaggcggtggtcgtagtactcgccggcgtgctccctcggcacgacgatgcggacactggtggagaaaccatctttcgtcggtcggactaattccacaatagtctcggttgcaacaaacaccgggactaaagatccccggttaaaaagggtaacgggcatcaccaaccgggactaaagatctttagtcctggtttaaatgctgtcagggcctgtcaggccctcccgggatatttagtcccggttggtatcgtaacattagtcggactaaagatcccagcgatctttagccccggttcataacaccaaccgggactaaaatcccacccctatatatatatatatgtcttcgtcctcctccagcccgagtaagcttcaaaatttcttcaaaaaagaggggaggtcatgccaaaatttctattgaatttattttggtgattatatataaatcggaggtgcctaaaaggttagcaacttcatcctccaatgttttatttttttcataggggatttggtcatnnnnnnnnnnnnnnnnnnnnnnnnnnnnnnnnnnnnnnnnnnnnnnnnnnnnnnnnnnnnnnnnnnnnnnnnnnnnnnnnggatacaaagaanggggtccat

SEQ ID NO: 40825 - DNA, 974 bp, Oryza sativa
  unsure (1)..(974): unsure at all n locations
natgttaccattgtattccatttttcttctccttatgttgaccctcttttgttttgattgtgaaggaggataccaaggccaaaatcatcaatggaaactctgtccacactaccactaccactacaacgatgaccaccaccgcgttagtaccactgcccccaaaatgtagaactcttgatgatgatgaagaattcctcctcccagaattcaacgaaatagttctcaaagaattcggccgagacatgggcaacattgcaacctcacctgcaccaagggtaagcgaagaagatgcaacgaagaccccggaaatttttgagcttagagaaatggtcagatcacttcaagaaagggagaagaccctggagctacagcttctagagagctatggtttgcaggagcaagatgtcgcggtgcgggagctcgagaatcagctgaagatcaacaccgtcgaatcgaagctatacacgctgaagatcgaatccttgcagtctgaaaatgagaggctgcaggctcagttaactgaaagctcaaagctggcttcagagcttgaggcagctagaatgaaatgcaagctgttgaagaagaagctgagacaggatgcagaacaagcaaaggagagaattgcctcacttcaggaaatggccgattcttggcagtgtaaggagattattactgaggggaaattcagtgctgaggttgaggaaaaattgagtaagctagaggagttggaaaatgaggcaagagagcttagggttgtcaattcaaggctgcagcaggagaatgcacatcttgccaggcgattggagctcacacgcctgccccctgtacccaagcccatcaataacatggaggtgaatatttactgttcttgaactgtattgtagnnnnnnnnnnnnnnnnnnnnnnnnnnnnnnnnnnnnnnnnnnnnnnnnnnnnnnnnngtggaaggtgntagttactgtcactggtggcca

SEQ ID NO: 40826 - DNA, 863 bp, Oryza sativa
aacatatggaacaacgcagcaaccttcacccggacccaaagaagaaaggaagccattacttgagtccagccagctacactcttagcaaggcagagaaggacagtatgtttgaatgcttggagagcatcaaggtatcgtcaggatactccacgaatataaagcgaataataagcacgaaggagaagaagttcacaaacataaagtctcatgactatcacgtgttgatgacacagctgctaccagttgtaataaggggtatcctcccagacaatgtccgggcaacaataacaaagctatgtgctttcatgaacgcaatttcgcagaaggtcatcgatccggatagattagaagcccttcagaataatgtggtgcaatgtcttgtcagctttgagttgatatttccaccttcatttttcaatataatgacgcatctgctttgtcaccttgtcaaagagatcggtattctcgaccctgtgtacctacacaacatgtttcctttcgagtggtacatgggcgttctgaagaaatatattcgtaaccgtgctcgtccagaggtaagcatcgccaaggggtatggaacagaggaggtcattgaatttcgcgtagaatttattgaagaccttcgccaatcggggtacttgaatcacgccatgaagggagactacggggaaaggggactcaagggagactaggggaaaggggactctcggaaggaaagcaataatgacggtagacaacaatttatttcgtaaagcccatttcacagttctgcaacaatcttcattggtggctccttacatcgaggagcacttggctctagttcgtgccagaaacatcggtaagtccgatgcatggattacaag

SEQ ID NO: 40827 - DNA, 1132 bp, Oryza sativa
  unsure (1)..(1132): unsure at all n locations
tggcccccgtgatnngtgatnnnnnnnnnnnnnnnnnnnnnnnnnnnnnnnnnnnnnnnnnnttaatctcctccccggtctggtcgattcgaagccatggagatatagcctgcaagcttcatggggctggagcgagctcgtatttcttgatgcaagtttcagcccctccaagaacaggttcaggttcttggccataatcttcttgcagtcaaaaagaaagtctcaatttcttgctcaaatgtttggattttttttattatcttttttttttggtgatcaaggtaggagagattatttgtgttccttccattgctggttggttgctgcagtctgcatgtggtggattcttgggaagaaggtggtggtgaggtgaggtgaagagggagatgcccaaggtggccggagatggcggcggcggtggccggaggagcgaggacttgcgcgttgttttcctcagggtcggcgccgccgtcgcgctctccgtcgccgggctgctcctctcgcggcggcggccacggcagcaactccggttacctcctcctcctcctcgctcaggtatcaacagcagaggcgtcttgttcaacgtttttttttcatttcgggaagaaattccagattttcagatggaaaacaaaatgaaatttcaacgaaaaattggaatatgaacaatattttgggtcaatttcaaataaatttgattcgcttctggccggatgaacattcgtacccaccggacaatttgaatttttgggaatttcgtaccggaattgtgaaccccgtgcttgttgctgattgctactcctagttagaaaattttggtgatgaatcgtttcttgatgtttttctgcagattcggatggaatgaatggtggtgtaggcctcaaggatgagcatgggatcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 40828 - DNA, 7110 bp, Oryza sativa
gctaaccctttcctcaagaggttgcactaagcacttctccttccactaaggggtatctctttctttgtggagacaagatccggccttcacaaacttctcccggccaaccacacgtagatcggtggctcgggagtgacacctagccgtctaggagtcctcaacctccaagagtaacaaacaccacacaactcttggtcaaccctagtgctcaagatcaagtgaaacacacactaggcccacaaaccccaaatccacaaccaccaagatccaccacacaaagaacaaggagagatttgagagagggagaaagagctcaaagatccaaagcaccttagcaccaagcacaacccaaagtgaatgagaatgaaatgagttgggtaaccctagaaaagggttaggtggggggtatttatagaagcccccaaaatgtggtcgatgggagagaatcttttcatcccacctcggaaagtccgaggcgacatccgatagtccgatgtttttgacccccaagccggccatagacagagaacgaaattctggagaatttccgacaatccgatcgatcggatagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagatagtgagcaaagttctgtgaaatttcagatagtctgagcatcggatagtctgatcaacatcggatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcactctatgcgaggtgtggttcaactcgtatttgaagagttgctgcacctctatgtgaagagtctgtagagagctctgagtaccccgtggggatcccgaggaatcggcggctggatacatctcatggatgaatggggcctgcgcctagctcgaaggcatcagccagcgtatcgacgaagccctgaagcagtagtgtcgtcgatcgagccgatatgctggggggcatatattggcttgcatacgagatcatcgtccgcagctgcacctcgagttcctccacgaagggttttctcgttctcggagaactcctacggagatagatggcctggcgaagtcgatggtgccgctggcggagaaggtcttccagtccatggactggcgttggccttcctggtagtctccgtgtcctgtgacaaatgtcttagggaaaaagtgtaatataattttggatttttatggaattgtaagaagtacttgtgaaatagaaaagagatctatctaactaagctttcttactctggttgtagcgtgtatgagtgtcttctcacttcgcgacttcgatcaatcgtttgagttatacactctccctagcccccagccttgtcatcggagaattcttcttggaagataaggctcttggacctttgacctgcctcggttgaacaagcactgatcctagcccccagccgtgaagttggaaagttaatttccgatttacacagcttggttaatacgcacggcgagaactcttacacgaccagatcttacatggtctttcgtctctacaggatccgacaaggccttatctgctctgggcgtccccagccgaagttcccttaggttcctcagaggccttgtcaagacggcgtaaagggacatgaggataggtttcaacgctaggtgtcatctgggtaagggatcatcgggaatgaacactttgattgtagtatgtacctgaaaataggctttactgaagctgtaagatgtcttacaagtatggatactattgacttatacatagaatttacgtaattgatcaatgttccaggaattagccaactcacgaccatcgccgtttgcaattttgaatgcgcctggccgcagaacttgtgtgatcgtgtacggtccttcctatttgggtgagagcttgttccgccctgcttgactttgaacccgtcggaggacgtagtcgccgatcgaaagtgtgcgtgctcagatgcgtttctcgtggtagcggcgaagggcctgttggtagctggctgctcgaacggcgactcgttcgcgatgttcctcgagtagattcacatcgtcgtttcgctgctcctcctgattctcattggagtacttctgtgctcgtgcgctttgatatcgtagctcggtggggagcatggcctctgagccgtacacgttgttggtgtggtacgcacggcccatagtactgatggaagttcttcgacccacttcttgtcatgtgacatgagcctgtcgtagacgcgggtcttgattccctgtagtactatgttgtttgccctcttgacttgtccgttgctctgagggtgagaaaccgaggcgaagcagatcttgactcccagcctgatgcagtaatcctggaaatcggcattgatgaactgggagccgttgtccgttataatatggtggggcaatccgaatctgcagaatatccctttgatgaatttgattgcgttgtcggccttgatttgcccctgtaggtgtcgcttcaatccacttagtgaatttgtcaatcgccacgaataggaacctgtagccgctctgtcgaatcatgtcgacttcacaccgctgaaccatgtcgcaggcgtctttgagggcggttggctagaagaacccctgtcgaaaagcttttccaactaatgtccgaccggcggtatgtgacctacagatcccttcgtgtatgtcgaggaggagatgtctgccgttgtccgacgagacacattttaggagtaccccgtttggtgcgttcttgtacagatcgttacctattatacagtagacttttgctttacgggatattttctcggcttctgcatcgtcctcgggcaactcttcgctgtgtatgaatttgatgagtggggtgcgccagtcgtctgtggtctcgatatcggcaacggcgcgctctatctatgtagcccccgagctgttgttgagggagatcgggctatcttcgtcgcttgcgtctttcactaatggccttgtcaggacgtccagaaaggtgccaggttcgagtggctctcgtctggatgcacgccgtgctagatcatctggttcgatgttgtccttgcggtatacatgtcggacctcgatcccatcgaaccttttttccagcttcttgacttctgcgagatacttggataactcggggctagagcacttgtaatctttatgcaccttgttcacgactagttcagaatcccctttcatgatcagttgcctgactccgagtgcagctgcagctcttatcccggcgagtagtccttcgtactcggctgtgttattagtcgccctgaagttgaggtgaattgcatgcttgaattgatctcccaaaggtgatgtcaagatgaatgctgcccctactccttggctgttgtgtgcaccgtcgaacgccattgtccacgtttcgttgtcgatttggttgtctgacttattatcaggcatagtccaatcggctacgaagtcggcaagtacctgggacttgatggctgttcgtggcacaaagggaccatcaaattggcttagctcgactacccatttcgcaatgcggccgacaacgtctttgtttctcactacttcaccgagagggaaggaggatagaactatgaccctatgggcttaaaagtagtggcgtagctttcttgatgtcattattaccgcgtagagcagtttttggatctgtgaatatcttgtctttgcgtcgtggagagcttcgctgacatagtagactggtcgttgcaccttctctctcttgacaacaatgacagtgctaacggaatatggcgtggtggcaatatatagaaataattcttcattaggttagggggcaacaagtacaggtggatttgataggtagcgcttgagtgcaatgaatgcctcttcggcttcctgtgtccatacaaatttgtcttgcttcttcagcagggcaaagaaaggtggtcctcgctctctcatcctagcgacgaacctgcttagtgccaccatgcatccggttagcttctgtacttccttgagtcttgtaggcgacttcatgttctcgattgccttgatcttctcgagatttgcttctatttctctgccagagacgaggaaactgagcagcttgcccgatggtactccgaacgtgcacttctctggattgagcatgaggcggtatcgtcggaggttgtcgaacatttcccgcagattgtcaatcaatgagtcggttgtcttggtcttgacaacaatgtcgtcgacgtaggcctcgacattgtttccgagttggtcactgagtacgccctggaccgtgcgctggaaagtgtttcctgcggttattagtccgaacggcatcttaacgtagcagaataccccgaacggcgtgatgaatgctgtcttctcctcgtcctctttcgccatgctgatttggtggtagccggagtacgcgtcaagaaagctcaacaactcacaaccggctgttgagtccatcggttggtctattcgaggaagagggaagtgatccttgggacacgccttgttgaggtcggtgaaatcgacacacattctccatttcccgttggccttccgcaccatgactgggttggctagccactctagatggagtacctctctgatgaaaccagctttgagaagcttgtcgagctcttcttgtatggcttgttttcgatctggtgcaaatctccgcagtttttgctttactggcttggcatcaagtcgcaccatgagtttgtgctcaatcacctccctgggtacccccggcatgtcggatggctgccaagcgaacacgtcagcattgtcgcggaggaaggtgatgagcgcgagttcctatttctcacctagtgatgccccgatcttgacggtcttgtcggggttggcactggagagtggaacaatcttgattgcgccgtccgatttcggcgtcttgtttgttttgctcactttcttgggtggctcagctgtggcgggtgggctgggcgtgtgctcgaccatgtcgaggctccgcttgtcgcattgcactgccagcttagcattcccttgaatagtgattgttcccttcagtcccggcatcttaagcacttgatatgcgtagtgagatgcggccatgaacttcgggagtgcagttctcccaatgatagcattgtatgttgtatcgaattcagcgacatcaatggtgatctgctctgttcggaagttatttgcttggccgaaagtcacaggcaacataattttgcccaatggtttggacgatgactgaggagtgattccatgaaagggttgatcggtgggtgtcaactcgcttcttgggatccccaccgcgtccaaggtgctggcgaagagaacgttgattgagctgccgccgtcgatcagaacttgcgcaaccttgatattccgaatagtgggttcgaccacgatcggatatcgccctgcgatgacagcagtcttggggtggtcctcttctgagaattctatcttctgctcagaccacttcattttgggcacagctccttgccacgtcgaacaaacttcccgttccactttcttgtattctcgctttgaggagtatgccgtggaacctccaaagatgtacgagacatggagatcagagtctgggtatgctgagtccgattcctgagcagttgcctcagcgtccttctcgaccacgcgtactcgcttgcctttttccaatgccatgtgttttgcgagcgactttttgaagacgaggcaatcttctagagagtgtatgtccgacttgtgtatagggcaccatgttttctttgtgtcgctgccttatgggtctgggcgcttgggagggtccgcgtattctgttgcgagaacttccgcttgagctttccttttcccactcttgcgatttttcttcttgcttgactcaggtgcgtccttggctggtttcttatctcctccggtcttcggtttgtcgttcttgtgcctcagtgcgtcgtccgcatgagcacattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgggtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaagggtaccgagctcgaatt

SEQ ID NO: 40829 - DNA, 1463 bp, Oryza sativa
ggcgaattcgagctcggtacccgtcaatgggcgccatccgacgtaacggaagagaacttgaaggagatggtggcgcacggcgttctcccagccaaggagatcatcgggtggcggccagcgagcggtgagacttttccgacccctgatacacatgagatcgtagtcttctcgcatttcttctatggcggcttcgctcttccgacctcgaaatttttccgcgggatcctgaatttctacggaatcagcttacatcacctaaacccgaattccatagtgcatatcgccaacttcgtccatgtttgtgaagcctttttggggatcaaacctcactttgccctattccgccggatcttcttcctcaaaccccaaccaaacaagaacaaaccgtgtgtagtcgggggggcaggattccaactaaggggaactctgagtcaaaaatatttctcgatgcccttcaagacttcgaacaaaggatggcatgcaaactggttctatgttcagaatcccgagcctgctcttcccgggtactcttgtcttcctccagtgtaccaagatacttggaattctcttccgatcggagatgaagcagtacaagccttggagttgttggatcgtatgttaaatcttaaagaacaaggcttacagggagagcagatcactcggcacttcattaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcaactgccagtcgtgccatataatgcattcaatccgcctccacaggtatgcatcggaaatcctcaaaccgtgatcagaacatagttttatcttcacgctgagttgactaactatggaagcatcttgtccaggaatatgcattgatgaagtcagatccaccagtctctcagcgccggtctcctcgccaacacaccgctcagggaggcggagggccaacgatcagaccagatccgcaacctcagacctccaaattggctgatcaaacaggtcctcgtaaaagaaagctggtacttgatgatgatgaaggcgacgatgataaatctggggataagggctcgcctaataaacccccaaagcgtaccatgcccaggaaaaaactggctggccgtgcgataccaaagatcagaacatcctccaggtattagacctctcgatatgattccgcttcggcatgtttttctcatgaaaatgatactgaatactgaaagaacactctgcaggaaaccatctgatatagatccatctggaaaagaccctgatccggctatgacagagcaaaatatatccaaggaccccgagccgactaatgaaaaccagccgactgctgaaagccagccgactggcgccca

SEQ ID NO: 40830 - DNA, 2738 bp, Oryza sativa
  unsure (1)..(2738): unsure at all n locations
nnnnnnnnnnnnnnnnnnnnnnnnnnnnnnnnnnnnnnnnnnnnnnnnnnnnnnnaacagatggcgaggcaaattgaagccctgggagagacaagacagaactggctgcgcaaagggactcagccttgaaggaagtcgaaggtagcgccagctaacagtctgagcttctctccttataatgcaacagatgctcatcatgaatgtgttttgtagatcgcaagatcaaatctcaagctcagtttgacgtcctggttggtaagatcaagaggcttgaaggagcaagggatgacgtcgccaacgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggccgacaaaattgcgagcgatgttgtagagcaatttcgcaacaacgacctccagccgagtaatgaagactctgatgatgaaagaactgattctgactgatcatgaatgtaatgtatggaggctcaatttgtacaatactggtgtatttatgctgtgcttgatgattcttgcaaagtttttgatttcttaaaagtttttgctaagctttgttgagcctaaaacccaaagaagctattaaaaaccttcagtcctcgcaaactaagtagaaaaaccaaacaaggcaatgataaaccaagtaagcaaactgaattgataaaaaatcacactccattattatgatgatagcccccgactgacaacttcaaggagaaaacttgacgtttgacagtcaaaatagggaaatacaatgataaggttaagcgtagatggatccggggatgaatccgccgagtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacacacatcgatcgacaatttcgaataatctccgagtagtcgtgatacgcctcgttgccaactcctgggtagtatagcaatctctcacaccggacttgaaggcgcggattacagaagcgtcggtgatttcggggattgtatttctgcactcattaaagcgccgaacataatccctcaaggattcattcgggttctgtgtcaacgcatgtaagttgtcttcgatcgcgtggcgcttgtaagttccttggaagttggcgacgaacttctaccacaggtctgcccacgaagaaatcgagtagggagagatgcatcagccatgaacgcgtggagcctttcaatgcggttggcaagtaattcgccaacacgttgtcgtcctctccggcagcgtagagtaccgtggagtaaacctgaaagaattcttgtgggtcagtactcccatcgtacttctctattgctcctggtcagaatctctcaggccatcggacatcacgtagcgaacggctgaaagctctacacccagcgctgggggtggtgggttgtcggtgatcgtacgtccttcgtggatgtctatctgatgatgaggatgaggaagatgacgacgatgatgatgggtcacttgattccggtgtacgattacgaggacatcgcccgggttatcgagaatcctgttgtcgtctcccgttgttgtctcagcgccgatctccatcgtcgtcgtcattatggcgacgtcctcgaccagtatcgcccagcacccgcggttcgcgatcgtcgtgatcgtggcggttgtggcggttatcacgatctcggtcttcgctcgaacggcctcctcgttcttcgttatcgtgacgccgtgaagagacgcgatgtcgggaacggttcttgttgtctcatgcgcgtcgcgcctctcggcggccatttaggtgatcgcggagatcgccggtgccacgaggtggaggggtggctcgatgaggcgattcccgctgttcagggttttcaccattagcaccgccagttggtggctgttctaggtgcgctgcagcagcagcctcttcgaacgcgttgctgaggttggtcactgattcccgtaaccgttctgtccatcgtgcgagatcgtcgttcagaacgggatcgtaaggggtttccctcagtattgcgttgacggccctgatgtgctgggctggtgtagtcacttgattctccgcttccgcattagtgcgcgctgatgtgccggtctcatcgatagccaatacctcgcgcggcgtacttgttgatgatgagccatagtcttcgagcaggtgcaagactgatggttcgtggggatcgatgtcgattaccccaaggaatcgatctgaaatcaacgtcgctccttgttccttgtcctcatccttgagggggatctgtgactgctggacttaggaggtgacgtcttcatgg

SEQ ID NO: 40831 - DNA, 1294 bp, Oryza sativa
catggagtcatcctgggttgtagctattgtgttctcgcttccgatcattgatggaccagccgagatcggcaccgtggtgtaaaccgggaagacgatttcgttgacttgaatccacaccagcattgttgaagtaggaactccttggttgaggttggtgttgacgctgttgtcgacgaagctggttgtcatagtagtagaatcttgaacaccaagtccccctacctggcacgccactgtcgacgggggatacccgtagactggatatagagggtattggggtacgctagtacgaagatctacgtaatacgacatcaagcagacagaaaacaaagattatactggtttaggccccttaataggtaatagccctaatccagttgatatgggattatatgatgtaaaccacatattacgaagggaaaagcggaactcgatgataccgacgagatcgtagtcgagttgattcgactagatcacccggcgacttggctcctgtaggctccggcttcgtaggctgtggtggttgtcttggctatgagattcaatgccttaggtcctcccggggggtcccttttatatcgcaagtcgactggtctccaagtaggactcggagacatcggacccggcacggtacaatgatgacccagttctgtctaagtatgactccttccatccgtgaactccatgatgaattcctttaacgtatgccaaaaacgtccgtatacgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaagataacaaaggatggcataatagggtttcatttgcaaaagcagcatttagcaaacatttgagaatttaataaaacagttaagtaattaaacaatattaatccaacgctatacaacataccctgttgtataggcccaaccattctgaacaaccaccccgtctgcacagttctatctccaaaccaggaatattccattccaaaccaggag

SEQ ID NO: 40832 - DNA, 1455 bp, Oryza sativa
atggccgcggcgggccaccgtcatcccggcattccagcctctggtagtggaagaagctggccgtccgaccaccgatgctggattcctgcaagcccatcattgtaagctcaaggtgagtttagctgacagacaaagatatatataacactgcaagatgaatgcagatcatatggagggatgaacagtatggtgcacatggaatgaccccaatgtggtacaaacattagcaacaatgaaacatgaagaaaaggacaaggattgctctaatgtttgattccttatgccacatgggactacccctgacctttcacatccatgtcccttcctcatgcattcacagctgctcccttatcatttgtcggagaacatccccatcttgtaattactggagaaatttcctggctgcattgcatgacagcatggcatgaatgatttcatctggaaataaggaaggtgatgttttcgggggtacagttttgtttcttgttccttaatctgctgacttgtcactgtgtcagttgtcagtgaatcagttctgtctgccattggaattacacagaatctttgcaaagagtaattaaaaaagtgttagctttgtcagagcaaatatgagagtacaagagaagacgatgtaaacctcataatgacagagagaaggggataagtggaagagatgcaatccagtggtaactatcaagatctcagtaaaacttacttagatgagtttttcaaagagtaaaaggatgttcctgtattcaatataagacctctgaaaagaggtagcaattatctcagaactgacccagtacattaatagaacaagaaacacctaaactaaggcttccactcgaccaatatggagccagtacatgtttgtggtttcttcaacgatcacaagcagaatactagtctatttgaacgataatttccaaacctcccgaacattcgatgatccatcagcaacttcagcaagtaggtcggactgcatggcccctaaatgacaacaaaataacagtgaaaatctgcataaataccaaatgacatgcaactgtaatacacacataaagtatccaaaaaaattttgaattttagcacaatgcgttaataactagtctatagctttggcatgtgatatgttaagcatatgcatatgcatagttcaatgcacatatcctcaaaaagagtgctaaattcattcatttaaaacatctgcaactgatgtctgcctttaaagaaacaaaaacataactcatacaatggacgctatcttggtatataagcttaaaagaaataacatttagtgtttcacagaggaaaatgtttaacattcatgcaacataaaaagtaggtattgctccaatcttgctaattcaaagtttgcaaacaagcatgtcatcaggagtaatattatggaggtacatggataaataactcaatgactaaaaaactagaaat

SEQ ID NO: 40833 - DNA, 5646 bp, Oryza sativa
gggtagcgcaggcactgcaaagtatttttggtaagtaaactataataaacatgaaaaattcaagtgaaaagaaaaatatcagcaaaatgaatgttgtggatgctgaccttcttgatgagcctgtagagattagggagggaagatactgcatagacagtctcagccataaggatgatatcatagccattatacgctgtatcgttttcatgactgttggttgatttatccaggtcagcatctccacgaagaagcagactgtcaatttcgctccagtcaccagcaaagaaaccaacactaccagatgtaaacttttcttcagatgattccttcaatagattagcctttacatttggtatggtaaggcatctaaggacctcagcattgaaatcttggaagtggactagaacagcaccctgatagttttagcttttgagaaatcaatagagttaaggagtcatttacaaaatttcacaggggaatatagataaataccttaagaatagcatagataccagggaggccatgtccacatcctagctacagaatcacagagatggataactgtaagcagcaagttgggtacatcttctgagattacagctacttgtatcaaactgaaggacttaattatttagatattccactacaggctgttactaactatcgagagagattgaacctcgaaaacctggtattagtgacttcaacataaacagttgaaaaagcaagtggaaaatagaatgtgataaagctttttcttaaagagtcaatgtggttgtggacatacctcgctttccaaaaagaaaaaactcattctggatataccttattctgttatgactcttgtaaagtcttatttcttttgttattactttaactatcaaaacacaacacagttctactcaaaatatttttaggcgtgaagtatctcacctccaatacacgtttgccttctaaaagcaatcggtcttctttgatgtctgagtttaaagtcttcaccaagtctagtgaaccttcccagagcttcaacccacctagtgcacacatatatttccaagcttacaaagacaaacagtaagaaatacgttacaaggatcaaaatgtattcagtcctgaccttcatatttccctgggactaaatcagagtttttgactccaaaaacatcagaagtacttgctctcccctaaaacagtaaggcaaaaaagatagattaagttgaatttgtgggaggatgtaacaatgacctgtagcatgcagcagaacaactagagaaatttattgtaagttccctagaagttattggaacagcgatgaccgagtgaacattatgtttgcaccaaacgtgggtgtgtggaatgtcaccatgcgctctgagcatatgacttaccaagggaggattcaacaaatagctgagagaaccatttcagtgctaacaaatgttcttcatttttgtttggttttaggcagaggggagggaggataagaatattcctcaatgtttacatgattacatccggtttcctctgttattgtttccattggtgaagcatatactgaacatgatggacagctataataatctcataattttctcactcagcagcagtcccaacgcgcgatgttcaatgataaacagaacattctcgacagcatgagttgtatggttagtaaagtaataattgcatttatcattctaagatactagataactattagcagcctaatagaatcagtagcactgcagagtcttgccgcggccacagaggcatttccacaaacacaatgtaagcatttctgcagacgcaccttgtaaatcgacagggagtcatcaatcaccacaggctccaattcgccggccgcgacgggcgattcctgcaattcaaccaagaaacgaccgaatctcgcatcaaagtaacccggtaaatacgtagtaggataagcccacaaaagaagaagaagaagaagaagaaaaaaaaaggaaagcgggcgagatatacctcggagaggagcacctcgacggctgccggcggcggcggcgaagaaggtccggatgacgcgctgaagccgaagccgaagccgaaggaagcgttggagttggagaaggagaagagaggggaggaggaggcagcggcagcgacggtgttcttggtctctttgccctccattgtttgtgcgtagctgtgggcaccaccctccctgaccctgggctttcagctcgagcagcgacgagtaggctacacggagtacggccgccggcggcggcggacgggcggcgcaaaccacggcggaacggacagaggcggcggcggcgcggaggcgaaggggaaagctctatatttgcttttttgaaaacctgggccttttgaatagggtagaaattaattgacaaatgaaatatttagggttcaaatttcctttttaagatattcatgtattgttgatgatttatttatttattagagtgcgatacaatttatttttgtgttcactgttattattatattataaaatttgcgaggaacaacattattaaaaaaatgcataggagtctaaatccatattttacaaattgtaaacttgaaattttatgttctcaatgcaagaatttttatttacctttacttgataacattggcattaaatcgacaatctcataaaacgaagctttaaggacatcaatttagtagaaaaccaatccaaatataaattgaaatatttcaataaaaatacttaaatggaatctaattacagctcatgatttcaaacaaattcccacggtaaatttcaccttaattaaaccttataacaatagaataagattaaaatagctcacccgtcgtaacgcacaggcatttttctagtccaaatataaattgaaatatttcaataaaaatacttaaatggaaactatttcttgttttcaaacaaaatatttaaatgaaaaaacttttgcaataaaaacataaattgaaatatttccggtaaaaaaaacttcaaattgaaacttaattaaataaccctgaaataatcccccaacctaaagtcatgaacatcaggctatttttgttgtgtcctagtagtagtgaatttaaatggaaaattttgcaataaaaatataaattaaaatatttccggtaaaaaaacctcaacttaaaacttaattaaataaccctaaaataatcccccaaacctaaagtcatgaacatcaaggtaattgttgtgtcctagtaggagtggattgagggacttgatatttatgccacggatgctataaaacctctctccctccctcgtctccctctccaaaaccctagctttctccttcccctgctttgcggcgcgccagccaatcaccccaaacccctcccagtcccagcgatggatcagcgcaagggcagcggcagcgacgccaacggcggcctggcggaggcgacggcgtcgaggctgaggttcgaggaccccgacgaggtcatggaggagaaccccgccgccgccgccgccaccgtcggggcggaggaggaagggggagagggaggaggaggggaggaggtgatcggcagcgacaagaccagcgccgactactacttcgactcctactcccacttcggtaagcggcgctcgcgctcgatccggtttcttggagatgctgtactgttccgcagattttcttttttgggtgatgataatgctaattaatagagcaatgaagtttttagatttttgtgctgttttagttgttagggggaaggttcgatatctggtgcgaatttgtgcggcctaaaatataacgtatattcatatgtagtgttgttacttggattgagatattatattttggttgttcttgacagtaatgctgtgaaagattgaaggttttttgcgtgttagccgttaagtgcacccgcatcattcatttagtagcaggttgggtggtaacaattcatttttgttttttggcaatggtggttgtatgacagattggtatttagttggttttgtacttctgttgttgatttatcaggactgcaattgaacataggttttttgagattcagtcgaccttttggcattctagctttgcactgctgaataattttagcttttgatctgtacaggtcttgagattttcattgatactgtgtgctccggttttgcctaaagttattgtgtaatttattaccttgcgcagtttataatgctcctgctctgttttgcgcagtaactttatgaggtgtacttgtcttgcaggtattcatgaagtaagtgaatctggaagaaatcagcctcctttgttgcaccacagttcacaagaaaccagttttcatccgatttttttgtgcacattaactttaggcagatgatttatgcatctaaatgtgcaaaccaagtgttgtcgagatgccaattactttatcgtgctgattgcaggaaatgctaaaagatgtggttcggacaaaatcatatcaaaatgttatcacccagaacagctttcttttcaaggacaaaatagtccttgatgttggtgctgggactgggatcctctcacttttctgtgcaaaagcaggggctaagcatgtctatgcggttagttttctaacatacttttatgttttcattttaatgctgtgatagttttgttgtactaaataagctattttgatgatcccattcttgttctttaatctaagactgttagccatttgctgcttcactatttgatgaggccacaactttagaatctagttcggcatgttgtagtttcctcccatctatctattacatggaatataatagaatttgggaagagcaggaaggctactattttattcacatgtatcagactttaacgactctttgcaagctgatacaagcttatctgttggactgttattgtgctcttcgctaacaacttaaaatgagtgttctttttggatgctgattatccaaactgttggtgtcctgtatagttcccatggtgtttaggatttcaagttacatatatagtagtttgttaggattatttcgcattacctgttcttatcaaatattgttttttcctcaaacttgatatacctgttcttccatttacagattgagtgttctcaaatggcagatatggcaaaggaaattgtgaaaacaaatggatattctaatggtgatttcctttctatcttactatcatctatgatgaccattcagtatcatgcttgtttgactttgagaagttgttaatatcatttctatcttcacagttataacggtaataaaagggaaagtggaagaaattgagcttcctgtcccaaaagtagatgtaataatctccgaatggatgggctatttcctcctgttcgagaatatgctgaacactgttctatatgcacgtgataaatggcttgtaagtgcttatttaccattaatgttcatggtgtttgccagttttgtaggctatgaaaactaaacttggtttgtttgttctatggacaatatttaaaattttggggatatataacttgtatattatgttaatgtcatgcaggctgatggtggtgttgtcctacctgacaaagcttctttgcatcttactgcaatcgaagatgcagaatacaaagaagacaaaattgaatgtatgtagtgcatgaggaaaa

SEQ ID NO: 40834 - DNA, 750 bp, Oryza sativa
  unsure (1)..(750): unsure at all n locations
tgggcttctcaacaggttcatctttttctcaactaaccatccaaattacgcccatctattttcttttcttcatgctgtgttgtaattcttgtataatttaattgatgcaggcccaagatcaaaagccactcactggaagcaaactgttctgtacctggaggatgtactgaccatctgtgagggggaaaccatcacagccagtatgactgttacaccgaataaaaagaatccccgagatattgacattaagctctgctacgccctaagtgggcatagatgccaagtgtcaagaacacaacactacaagatgcggtgatcaatgcgagctcagctgccctgcaatccattaaattttggttgaccaagtatcttgtttcgcaaactgtgcttgttcccgtgatcctgtattaacatacgttatttatgttctttgggatctaagcataagtagaaaatagattgaactggcctgccgatatgagatttgctattttgcaaaactatgttgtcttgctggctggtggtattggtaatgaatgcgttgacaatgatgatggcaattgctgtgtacgttttatgaaaatggatcaatgacgtattgccagtttgccacacaattcatgcttgagattttctttcattctactgttgtatggtgactcttctttcctgcatttacatttcaatttatttgagagcacatctgcnnnnnnnnnnnnnnnnnnnnnnnnnnnnnnnnnnnnnnnnnnn

SEQ ID NO: 40835 - DNA, 2313 bp, Oryza sativa
agattttcctttcatgctcattgtttttttttgtgaatacacctgactgcaaaaccctaatgaactagataaaactccttatttgccatttaatgctaactcaatggaaacgcggcattcccttactgccactagttcactattgcctttcattatttgccacgtccgtcaactctgttaggatgaaacaccattaaccgtggatccaccttttttttttttggaaatattccatttgtaccctcacaaaatgggtgccatctttttcttctggccatacccacagcacctaagtccatccgttgccatctagaattctagatggacctgaactggtgccactgtttgttggcagaagctttggctagtcagcctctgtggctccaccaaatgctcagcaccatgatctggcttgagaatccggtgagcttgcatttgtacgctgctgttcttttggggaatggatgcagggatagatatggcttggaaatccggtgagcttggatcggtgtcgtatgattgaccatgtttttcaggttatatgggaatagcaattttatgctacaagacatggtttgattgggcattaggtgagtataatacttctagtgccactccccagcaagcttgaatcctctagacctagtgccatgctagacacaagtattaagtgtctggtcttattgttttggaatgggactataggattgtgcagattgttattttttttgttgcatagcatgacttcattttcttataagtttgtaaaatttgcgaaagtacttcctggatttggtggataccaccaatgtggcggcacatctcttacatgccaccaaggatgaccatgctagatgcccatgaatctgcctcattggaatggatgcaggcattaggcacacaacccatattcactagccattgctggtaaggatgcctacctttggtagagggtgagtgctctgtcatgtgttcaggaagaacgaagccgctgggttggatgagtttactgttctgttgctggcattttttttaaatttaccatggataaggaagagaaggagaaacgaggaattaggaagaatgaggaagggcaaattatcttttcttgtttagtttaacagcaagatgacagaaggggcaaatgggaagacaaaatgaactagttgcaaataagggaacatcatttttttatcctgtaagggataaggtttatatttgatggcaaataaggaaatgaataagatgaatcctatgctttgattgttttctttgccaattcatgcctccaggctccagctacaacttttcaaaatatagtttgtacttatgccgtatcttctccttaagcaccatcctagacctagcacaactacatgtgcctaataatcatctgtgtttgtagcacgagatccagtatggaggtgacaatgcatcagcctctccaagatcacagcatgcaagccaaagcactcaagctacagtgcctattcccaacacaatgagccagcagccatcaccaaacttatttgcgctaggaaatacaggattggtgcagtccaagaactcagcggtcttttcaaatgcactatctagccccgttcgccggagcctgcaaccattccacctggagcagggtggcgatgcggggtacttcgcaaacggcgttaaccgcgatcaaaactcgacggcttcgaacgattcatccatggacatgcattcagacagcccagctcatgactcttactgagttgtttgccccctctgtggagctggaagagcaacacttccagtggaacagaatgtgtgcctttgctaccacagctcatgtaggactattcaatttaacccccctcccctagcctccaatgatgctaagcttgtattctgttgctgccaatcaccagttactagtaccgattacattgctaagatattgtaacttgcatgtatttatgtccagagtaaaactgtactcggtttacctgtgcatactactacagttggtatgtggtgaaaatgtaggtggcaaagcaaaattgagaagaataaacagtattgtactgttgttccctctcctagactcctacgctaaccatttctgaagttgttatcaagctgtcgttttgttctgtcattcttatagatatactaacgttgactatttgttttatttgaaaaaatagtgtaaatataaaaaagataaatcacacttaaagtacttttgaagtgtacttttgttgataaagaaagtcacgaacaaaataaataataattttaatttttttaataagacgaatgatcaaatattat

SEQ ID NO: 40836 - DNA, 1634 bp, Oryza sativa
agccgcagctgagaaaatgacagcgaacacacctattagatgtatttggtcaagacacgtagggataactcatatatagggataactcatatatatgtataattagtgatagataattaaagggctatgcattgggtccaggcgtctaggtataactattcaataattggatcatactttgcgttttactatgcaatatatgaatatatatgaataaagtattaaaaatgatggatagacatgtagaaatattataaaaatcatgtgttggattaatagtcagtaataatgggtgcacgagccccctctgtactggagctggaaacattacatttggaatccaagaattatatcttatatacccactaaatagcaattctgttttttttttcgagccaaggaaataatatttctctccttttttgggaactatgtaaatgtcactttactgaatttttatttgtggttcgaatagaattcagagatggagttttacaatgacacatttaattttagaaaaattacaatgaagtcatttaattttaccacttaagtattaatccaacaagcaaaatagttcttaattagtggggaagtcatgtgcggtagagttatgggtgtataatttcactccaccaggtttaaatcccagtgtctagaagtattacacacataagtgggtttttaacataaatttagtgagataagatatgtatagttgttttatttttataaaaaagatcgttgttatacttcaagctttcaagctctgccactcaatccaagtatagagtagacatatctgctgggtcaaatatggcaaattaagcgaaacaaaacgagtaacatttgagaatgaccagaacgaatatataactttacataataaatagatacatacatgtagataaagaacaataacactagtggattaatccgttcgatcacaaatatatatcatttaactttttttaaaaaaattgaggaagtacgaagaaaatagaaaaaaaatacatgttacttgatggaatataaaaactcaacccaactttttagaatactaaagtttattttcattttttattttcaaaatggtaacttaaggcaacttatcatttttcaagtgtgtaaaatccattgcgggcgcaccgccactcgacctacgcgttgaaggcggtggcagcgcagcagggtagcggtgggcgcatgcattccaggggttgtcggcatcgggtgcagagtcacggagcgcacgccagacgttactgcaagccttgaagccggtgccgaaggcaagcatccagaggcggtcaccggcacggacgcgacgcttggcctcaaagtaggcgagctcgtagaagacgaggctgctcgacgtgttgccgaacctatgcagtgtggcgcgcgccggctctacgacctgtggcccaaacgccatcagcttcaccaccgcgtcaatcaccgccttcccgccggagtggatgcacatgtgctcgaacgcgcgttggaaatctggcacaatcgccgccacggcctttgggttcccggcgacatatgcgcgcgccacccgccacacgtacctgcgccatgcaccccaattcatcactgaattagtagcaaaataactataagtt

SEQ ID NO: 40837 - DNA, 766 bp, Oryza sativa
agcaatacaggtacaggttgtgatcatactctttgtagaaattcaatgacttcactccaatatctagtgcaaacttcccttgactactcttaccaacttgagtgtacacacggactttgttgcctgaacacaattaaacacactaatgaaatggaatgtaaaagggaaaaaatggctcctaaagcaccttcaatgtgagaaactatgaaccatcaacaatgttgaattactgggacgagaataaagatggttaccttccgatgttacaccttctacataatcaaacaaaccaacaactatggccaccaaataagttgacataagcggcgattcttcgtagtggatggtcttgataggaccagcaattgtctcacaagctactggcatgttggacaatgctactagctcagatggaacttcaagtgttaacttgaactttgcctgaaaatattaaatatgaagaggggaaacaacagaaaaaatagatatgatatgtcaacacatattgcatcaaacatctggacaagaaaattatgattattgaacaagtcgtgctatcataagaattaaccttgaatgcaggctcatcccagcaggggaagcaccgtcgagcatccacagcctcaaactgtgtcaccgccatgttttttgtctcccctttatactcatatttactgcaacgaatggcattttctcatatgaaaatgtaaatgatacacacaacttgtcgaaatagacccaaagcacagattcataactactttcc

SEQ ID NO: 40838 - DNA, 1481 bp, Oryza sativa
tggacatggttgctattcctgatttcgctgctggggccatggagaactatggattggtcacttaccgggaagtttctttgctttttgatgagcagtcttcatcagcatctttcaaacagaatgtatatatcataactcagattctttttagttacatatttcatcatttatggttcactttgtaaatagtgatgcattattatttattagacattttctttgggacgtccaaattccttcagtgtaagcaactgttctttttaggttgcaattaccgtggcacatgaactggctcatcaatggtttggtaatcttgtaaccatggaatggtggactcacttgtggctaaacgagggttttgctacatgggtaatcaattatacaacactgaattttagaaatttaatatcaggatactactgtatactgaatggttggaccttttatttcgacagatgagccatttgtcagtagatttttttttccctcaatggaatatctggacacagtttcttgatagtacaacctctgctctcaaattggattcacaagctgagtcccatcctattgaggtaatagctgtttgatacatgccatggtctggtactctggttcaatggttcaaaacattgatgcatttcttatggtgtacaccaaatttgtctaaaaccgtaaatgctatgcattatatcgctgtaaaagagaaaattattgcgtgcaaatttgaccatgataagtgacgctgatgcataatatgctggttacattcttaaatatccactagctaattcactgttgaatcttgacttttctatgtggtaataagatggaaatgttaattttgaggtcaaattaataagtgcaccaatacaattacacttcagctggtggcactttaacattttgtttcaatgctgactagtgatttgtttcaatatttgttgctgtttactcaggttgaaatacaccatgccagtgaggtagatgagattttcgatgccattagctatgacaagggtgcttctgttattcgtatgctacaaagttacctaggtgcagagcgttttcaggtttcatactggctctccttgaaattcttcagaatcgtgttattcttatctgtagtgagcaccttttgctcaactgtattgcttaaaagcgtatgaaaattaccccaaaccattttcttttttgcttctcggaggaagcattgaccttttagtctgtccactattcatttagttgaaaaacgtcaagtggacctttggatattccaagtttccaatattttaaatgcgtgaatgatccttaggcgatacaattggtgttaatgttcttttgttagtgattttgtaagtgaaattctttttttaaaagcttcctatattttttagggcaaatattaccatttcccccctaatcatcttgcttttgtttaacgagtacctgttatcgatgacgagtcaaccattaatacttca

SEQ ID NO: 40839 - DNA, 2380 bp, Oryza sativa
acgattgtactgtaatacatctgtcaaatttttggggaaaaatttatcgacaaatatatagcaaaatcgctataattttatatgcatgtcttgagagttgaccgatttgatttataaatattttggatttttggttctaaagacgggagccagtgataatttaatggggaggggactgtttctagagatgacaagtacaattaaagcatcaaaactcgttacatactccctcgtcaaaaaaaaaaaatactcatgagtttgaatccgttcggattttttgttacggagggtgtatataattgtagagtacaaacaactttaaatgtgctcatcagagaacaagttgtcgtcctataatagtaacatctaatcaaataaaactaactttaactgaaatatctcttcgagattatataaaataagatattgtaaaaaataagtagttcaaatgcatgggaaaggtcactgaaaaattttgttgccaaaatatttggataatattgcattgttaaaaaaacaacgtcaaatatatggtactaaaatttatcaatttattgaccaaagtgataatgttaacttttagtttcacctcctgtactgttcaataactgacagtgatgactgttctatccaaactttaatcaataatagtttttgttttattttgtttatatgttaaaacttgtatatacgttggagagccccaagtatttataaatgcattgttggaagaatagtgatcgaattgtatattttagtcgatgcttaatcatgtactgaagtgattttgtacacatttataagttggtttgtctaagttgtagaataattatttatatttgcaaatataacttgattagctatgagaacatatcctatgcacacaagattcccgtgcacactccatacaaaccaactagcaaatgtcacagaaaattctagaaaaaattagacacatacttccaagagtattacaccaacatgttaaatcttatcttcaaatttattatattttaactgtaaaaagaagataaaattctgacatatttttaccctaacaattggtagattttttatttttatgggtaaaatataatgaattacgagactttgcagatatgtataatactattaaaaaattgccatttttttctagaatattttgtgacatttgctagttgatgtacatggagtgcgcacgaaaaaattatgtgcataggatatattcccttagctatagcacatcttcacgggcaatatcataaacatagaatattgttctccttgattatttcgtaaactcgttcgcatcttagatctacacacctcagggaattgaaaaataatatactgcctccatcataaatggagttactttaattagtatatacgtaaagcttggtttattatatatatttttatctcaaaattatacatgtacttttcttacaaaattaaagcttcttcaaatcaaaattttcgtatgtcgtcgttatagcaatgttacaagcatgagaaaatttcatgtgcatcactgagagttcacctaattgctcttctatgttttcgagttttgctcattctcttacaaactcttaaattttagtttggattctgccatgatcttttcgttagttgaacgttttgtcctttgctatgaagaaacaaataaataaatatagaaatttgttggatggaactattatatttatgaatttattatgcgttatatcatttgaatactactctcttcgtcaaaaaaaactcaacctgtgatctctcctagaacagcattctaggagaatttggacatcacatcttctctaggttgagtttcttctctaggttaagtttttttcttgagagagggattactcattttaagagtgtagtaccacataagctctgtttttcagctcagatatttgatatgttgcagcaaaaagagcaaattttcatgtccatttaaggcgtctgaaatctgtgaaagcctgaacgcaatcaaaggctgcatgcttcgttcagctagccattatggcggcgaagagcaaaggagagagagagagagagagagagagagagagagagacctgacctgaggagctcggagacggggaggacgtgcggcgcgagcgtggcgatgtgctggcggaggcccgcgccggcgacgcggacgaggtccttggtgagcgcgacgccgacgttcccctcctcgtcctccatctgcacggcggcgttgtacgccgcgtcgtcgccgccgtggtgcgtccgcagcgtgcgcaccagctcgtacttggcgtcgccgcgccgcgccgccacgtcggtcaccagcgccgccgcgctgcccacccggaagatgcagtttgtcaccagcatgtgc

SEQ ID NO: 40840 - DNA, 1551 bp, Oryza sativa
gagagccatactgttttcttgcagcaagccaagtcttggttgcagacctgcagcagaggcaacgtgattctctgcgttttgcctagaaacggatagtgatacacaccccgcggttttacctgcatttcgcttaaagaaggcaatgccatcattcctacactgtttcctggaaggtgcaaaacctgaatttcctgcatggtcataaattttcttggctcatgaacacgctgtgaatgtgaggttgtgttcttttctgcgtattcaccagattattgccgtgcattacttgctccacgcttctaaagatatatctttgaaaattctctttagtatattgcttgtaatttcaaatcctcgtgtccacgaataatctatttattagaatgttaccatatgttttctcagaaatcagcactcacaaatttagtcatgtttgtgatggaagaattttggtggcgaaaattcgattttattcccttgttccaaacagagggtttggtttgtgtatcactgcctctcgatcgaacgtctaacctaaaggctgattcaattaggccttgtaatgatgcaggatgccacttgcaatttcaagtattactcgaagatagtagcttgcgaggaacgatccaattatgtgtgccagtgctattatattataccaataatgtgtccttcctaattcacgcaggtcatcatttagggatataatcttcctatatatgtgcattgcatatggaccattggaaaccattcctgttttcatatatattgtacatctttccaaacataaaaaggaaatgtgacagagagatgcttgcacatttagaaatatctcataactcatttttagaaaatcgacgatatttttagtctatgttgtttctcttctcgtattgaaagtttacacggtacttcccggtgggttcgtggaaaatatactccaaaaatttaaaacctgtcaatgttaccaccataattctcgaccaaaattttatggatttgctgaaaaagtgtcgctacattacgtggctgagtacagttggattttaatggcttggatgcgctgcgctggacatcgtgtgcacaatgaacatccgtttctccacctcctgtctttgtagcagtcaaatttgttattctaattatatatttatacaaatttgcacagtaattacatcccactggggtcttctcggtcaattcacattatatagctcttgttcatacggacgtcccaaatattaatagacgtatttggaagattaaagtaccgctaaaagtaaaagtttttctttggtacttacgtcggggagtaattctaaccaaggataacctagctaaacaaaattggaaaggcagtaaaaaatgttgctttcgtcataaggatgaaaccattcaacatttgttcttccaatgtcatctatctcgtttggtatggtccgttattcatatggcctctaactttcaacctccttgaaatgttactcatatgtttgggcgttggctttcatgtgttcctaaagaaatgagaaatctgcttttgatgggtgc

SEQ ID NO: 40841 - DNA, 885 bp, Oryza sativa
gatcccagtgttttttagtgcgccatgccaacactcgtttgtcttgcggtgcttactgatctgatcagttggttttagtgattcgagtttttctaacggataccgctgaatgtttttttgtgacttatttttcgaggtgttgtggtgtttcatatgtatatatatattttaagtttccatgatgtattattattttgattgcatatgatccctttttttactgtctcaagcatgcgcttatttgaaataattagatgggatgagttctttgggggatgaatttgatattgtgccacgagttgatatgattgagctgttttgtggtgtctcagatttactaattttcaaagcattgagctgcattacgaactactttatatttgtcatcatgtaatgtcattctgattgggcatgattcacacttttctaactgttacttgggagttgggactgttaacttcaatctgtacaaattattgtgaagcatatcctaaaatttgtagcctcgcttttcagtgataccttcactgattttgcattgcaagcttcacttgtgagatgataaataaataaaattatactttctgcagtatctgaaccatctttcaagtttaagtcgttttcctttgcaggtaagacatgggtcagtgtttgggtttagtacagattgatcagtcaactgtagccatcaaagaaaatttcggcaagtttagtgaggttctagagcctgggtgccacttcttaccttggtgcataggacagcaaattgctggttacctctcactgcgtgtgaagcagctggatgtccgctgcgaaacaaagacaaaggtttactccaatctcgttctattttttctttttttcatgctttgctggaaagtgaac

SEQ ID NO: 40842 - DNA, 1101 bp, Oryza sativa
ctctgcaggttatgacttcttgaacacgacaggatatgacctcaatataaatgtttggtacaactctacttataatgataacactgcatattcatttatcgcagcattacgagttccacgattggtgaatgcagtatgttttccttttcataacttcgtcctgagtaatttcggtgtattacagaaccatctgacaattcagcaatttatgctttgtttcctgcagatatccaatgcatacctaaaatttatcagaggaagtggggtggatatgctgcttgaatatgtaaaagagatgcccaaagttggaacaaggtttaggcttgatctctcttctcttctcagtgtgctattcttcacatggatagttgaactacttttcccagtgagtatgatgtgatttaacaagttcagatgcaaaagaaaaagggagtgttgagtgtgttatggtcaggatttgtacagcttgcaaattgactctcttttccaggttatgttgacatatctggtgtatgagaaggaacaaaagctaaaaattatgatgaagatgcatggtctgaaggatgggccttactggctaatttcttatgcttatttctttgctctatcggttatctatatgacattttttgtgatttttggctccttaattggtaattttcttccaatctattttcacgaaggtgctgttctgacaaataaatctagatatttcaatagattttttttgtaggtctaaatttcttcagactcaatgactacagcatacagtttgctttcttcttcatttatataaatttgcagattgcacttgcattttttgtggcatctttcttttcatctgtcaagacagccactggttagtgattcaaccttgtaagttataagtccaaaatgtttcttactggaagtcacaaattacatatttcctcctgcagtgattggatacatttatgtatttggctctggcttgctaggggcatttctttttcgtttctttgttgaggacaggacctttcccagtaagttattatatctggtgtatttttcaacttaatttacataatatgggtaacaagcatttttgttttctactcagat

SEQ ID NO: 40843 - DNA, 1307 bp, Oryza sativa
gtttgaaatcatgagtcatcactcatcaaggctgcttggctgctttaagcattcattgatggacatgaatgaatggaacatgagaaagtcgtattttcttgggatccatacccaaaaagaccaaaactaaactttacacttcactgtgtccttcagctgtatcccagaagttactgtacagtttgccaatttcattacttgtgtttatctgaattagtgttgtggggtttatttattgttgaggagatggtctttcgtttctcattagtatgccatattaaaactgttatccatttcatggaacagcagaaaagtcaaccgaaaatggtagcaggaaccatccagttgtatcagtagtctcaggctcaacaactactagtaatgctgagagcagttcatcagcatctaaagctggagaggaaataaaagttgcctcacagttgcgcaagtttgcattcaatgatctaaaatgtgccacccggaacttcaggcctgagagtatccttggagaggggggttttggatgtgtttttaaagggtggattgaagagaatggaactgcacctatgaaacctggtacaggggttacagttgctgtcaaaacactcaatcatgatgggcttcaagggcacaaagaatgggtggtatgtgctttgttattcttattgttcaaattgcttttgttccgttcatgtttggtaccattcccattagaacccccaatgactgacatttgtttctgcttcgtttcaggcagaggttgatttcctaggtaaccttcaccatcccaatttggtgaggctgattggatattgtgttgaagatgaccaaagattgctggtttatgaattcatgcctcgtggaagtttagataaccatctattcagaagtacgtgtctgaccagtttctcaagacattgaaacttcaatttgtatacaatgcctgtgctttaatgaatgaacttatcattcatatttgagtagctcttctgaagtgtttggtcattgcatcttgctgctggaaaaaatattaaatagatagaaatattgaatcttatatgatttatgattcacctatagggtctcttcctctcccttggtccatcagaatgaaggttgctcttggagcagcaaagggtcttgctttccttcatgaagaagcagaaagaccagttatttaccgtgattttaaaacatctaatatactgctagatgctgtaagttttaagtccttgaattggattacgtattgcacaccacacgattcacatcttgtaattttgtatattatgctgggtaccgagctc

SEQ ID NO: 40844 - DNA, 879 bp, Oryza sativa
  unsure (1)..(879): unsure at all n locations
nnnnnnnnnnnnnnnnnnnnnnnnnnnnnnnnnnnnnnnnnnnnttacgctcttcagagcatcctcaacagcctaacagtggaaaaatcccagacatggttcaaatacaagatgtacatatgctgagatagctgagcagtatagtttatgaaatacgtgacaaaacaacttcatatggtcaacaatgaaatgtggatattaaatttaaaaataagtgaggcagagtagaggtaccttcaccaacacagcacctttaagattcttcagcctgccataaaagaacagatgttcttttccagtcaatggttcccaaagtaagctgcatttcagattaaaacgtattactataaaaaaaataatctggtctgggaaagattctttttggtcagataagtgctagttgtagcaaatactcatgctgtgggcacacccccatgtttgtatatatgtgatccatatccatattgatatccattccatgaacataggaagtaccagatgtaggtttaacaagcccaatcatctggtaaaataacaaaacaaggttaataaaggtgagctgccacaactaagcaattttcacaaaaaatggtaccacgtgccattttagtactataccatactaatgaaggatgttttcccagctccatttgggccaagcattccaaagcactgcccttttggtacggcaagagataatcctcgaaccgccagcttatcagggtttccatcccttccaggatagatcttcttgaggttgtgacatataatagcttgatttgcattgcggcctaccaaaagttgctcaactacttctctctggatagaattnnnnnnnnnnnnnnnnnnnnnnnnnnnnnnnnnnnnnnnnnnnnnnnn

SEQ ID NO: 40845 - DNA, 1631 bp, Oryza sativa
tttattttattctagggacagtattgttgaagttaccaaggctgtgtttagttggatccaaagtttggattttggttaaaattgaaaatgatgtgactgaaaagttgtgtgtgtatgacaagttgatgtgatggaaaaggactgaagtttggatccaaactttggatctaaacacagcccaagtcttttgaatgggacgagcttgcgccaaatcatctcaggcatctgatttaacttatgatgatttgctgcgatgtactgtattttggtttaaaatcctaacgcatcccatttccaactattattagttcgatcgcaaagtttttacagtatgaagaactacatatttgcttgcaagaggcttaaaacatggggacggtgatttgaattgagatttcagagattatttttaaaaatcattggtttgtttaattgaattttcatattttttaggatctggtgggaatatttttaaaataataatcaatgtagcatctgaatggttcgttcaaaaaaaaaaaacttcattgtcatatactaagaaaatctacaacacaaaatttctgatattttttactgccggtgtgatgatggtcagaagcatatccccgactttcatgctattgtcttttacactgtttccagggagtttttgtttgatgtgaagaagattgcttttttttttccctgacgtgaacttcaaaggattttcttgttcaagtgcttgtatttgtatacaaaactagacatttctgatcaatcacacgcctccaatatatgcaaccgctaaagtacaaactcgagcagacaatcctgatcaaagttgcaaatggtacaagtattcaaataaaagcattgatctagatcagtatatgtacaataactctaacagctcagtgcagttgtgcaagtgtacactgaactccatagtgtgtggctctttcgaattacttatattatacatgtgattctttggtaacatcaataattaaacatacagatacacatttgatcagcatgtacagggttgtacataacatccatagttcaataccaagatcaaaccatgcaagaaaaccaaaccagcaaaaaggaaaaaaaaacaaggcaggttcatgcttgaggactgattgctgaagcctcaccttagtctctcttctgttggacaggcacggccaggccatagaacagcagcaccagcatcaggaggtagccgacgacgacgagggcgaccagcctcgcgtcatctctagccagatatgcagagaaagccgagtggagggtgagcacggcgaaggccgtcagccgcagccatggcgatccatcgccatcggctgcggcagaggaagaagaagaagaagcagaggctcttctggtagagttgttcttgcctttcttggccatgaagaacagcagcttgaaggggatcccttttctctgggctctggacaaggtgaaggctgatgctttgctttgctacgaagcttccctgagtgagtggtagactggtagctttcactgcttgtttgccaccacatcagagaggatcaggcctatgtgacaaacaataagctttgttgaatgaatccatcataatagacaacaaagtcaaggcatctgattcggacaac

SEQ ID NO: 40846 - DNA, 709 bp, Oryza sativa
tcaccacccagcaaatcatcaaccgaagaagtaaacatgctattccccattatcctctcgctaccttcctgagctgaattttgagctcctgggtcatcttgatcccctgtatcaatcaaatcaggcatctgtgcagcaggtactgttgtctttgtttctgaaaaattattgcttccagtaggttgttccccaaccagcagatttaagacctaagaaaatggcacggtttattatatagtaataattggaggtggaaatagctatagcctagagagagatagaatcaaagagatgcaaagcatgtattctacatagcaatttgcagaaaataaatggtgcattatacaaatttatttattaatggcttgcaactttactgaccttcgaagccttttctctgagagaaacgtgcggaagctcacagcatctaacaacagatgcactgttctcacagaaatatgaagtaatgattgaataaggatcagtatcctgtttccttacaattgcttccaatacacaaattgccttcatgcgaacctgaagtagaacaaatgcattgaatatttatgaatatataaagtgaaaacaatggtggaagtgcttggtcaagataaaatggtattataaatatgatctaatcatgtatataaataatgtgagataatattgtatcaaaaatataagaaaaggtcagagaacatcatagata

SEQ ID NO: 40847 - DNA, 6012 bp, Oryza sativa
  unsure (1)..(6012): unsure at all n locations
nnnnnnnnnnnnnnnnnnnnnnnnnnnnnnnnnnnnnnnnnnnnnnnnnnnnnnnatgccttctacaaactaagcaacaccagggaacaaatccagtcgtatgtctttgatggtaaatgttctgcacttccatctgtctgaaaattctatttcacatgtcgaagtccccatctcttttcatatatagttttgtcttcgtgtgttctttgctaggctagttgaagttaacagtttcagttttgagcatcatatatacctgctaagtttttaattagtgaacgaaaggaattctacgtttctcattgggcgacatcgtttatcttttagtcattagagctactgttccaaagctgaacttggatgatgcatttgagcagaagaatgatattgcaaaggctgttgaagatgagcttgaaaaggtttgtctactatttgctatcctagagacaagaaaacatttgtttttggactgactggatttatgattgctgtaggcaatgtctgcatatgggtatgagattgtgcaaactctgatcattgatattgagcctgatgtccatgtcaagagagcaatgaatgagatcaacgcaggcaagtaaccattgccctttccctgcataattgttgcttgctttcgatcttctcgccaaagattgagttggcaatagctttttgggaatactgagttggcaatagttccttccatcaatcacataatcatttacacattgattgttttgattgattctgtaacatgtactcagaattatttccatctaacatcttgatttatggtattgttgagcagctgcaagattgagggtggcagccaatgagaaagccgaagccgagaagatactacagatcaagaaagctgaaggagaggcagagtccaagtacctggctggtgtcggtatcgcgaggcagcgtcaggccatagtggatgggctgagagacagcgtgctcgccttctcggagaatgtccctggaaccactgcaaaggatatcatggacatggttcttgttacccagtactttgacaccatgaaggagattggggcctcctccaagtccacctcagtgttcatcccccatggccccggagcagtcaaggatgtcgcggcgcagataagagatggcctcctccaggccaatgccgaacgcaatgactgaatgatggcttcggttttgcaagcagcatggagttcttcatcactatcctagaaacatatcgtgtgagattaaatgttacagcaatggttaagtggagtatattttaggtctacacgcatgcaaatctctctttaagttgtggatcttatacttgttacctactagatgagtagatggttgttaagactttcatgagttgcgctaaaccatttgtcagacatatattatagtactggttggtatatcacttataacagattgcaagttccaggaatttggtgatattatgctgtgttgtatggttgtagaaaatccatcagattgagcttgatgtgtgcctatcaggctttgtgttgtgcaaagctggaggggtttatgtgaacagggcctagaggcaatgttcataataatggtgtgtgcatgtacttggtttttggtggctcaataatggcagattcacatgaatttgctgtttggttttgttcacatgaattttcttgcatatatcaagaggcacattgcattactgcattacacaccaatcaacaatacaattatacagaagagcaatccaccatgtaactaacatcagttttattcaccatgtacacacatactgatgaatctgttgcagaggcagcactgacactacccaaaacacacaagtctgccaccaccaatgctcatgtgcaatacagaagttggtgccatctacaaatgttttgcctttgtgaaaatggcaggacagggaatggagggagcagcagttctcaggaacacaggcctcgcagggttctgatcgagcttgagcaggtcgggcatggctgctgcggctgctgcttgacgtaaagaccaaactggttccaggcctccatgtactcctttctccactcctctcgcagctccgcggagtcgcggtaccattgcctgatgattcacaaaatgatgagcaaagtttcaggtcagaagggtactagtactgagcaaattgcttgaggtaacagaagaaaagatgaatattcttgtgttcagtattcacttcttttacaaaaaaaaaaaagagtattcacttcttttagcaactgatcaagcaccaattaaactaactgtagtttcactttggtcagaaaattcagcaagaaatatgatggccgtttgcttgaccgaaatgttcttaaaacacgaaaattaatcggatttagggatctccctaattcaccagcgatgatccatcatcaattcaactctccactgttaagagcagagctatgatccagcctgtaagcaaaaggcagataccaatagacagcaagctacatcatagccattgactcggagagatcgagcaaaacggattcgattcactgcatcgagcgagctcgaggcgtcggggtgggcattacgtcgaacacgccgcgtgcaagaaccgggaatcgcgtcgtgctctgctcactgacctgcacacgagcgagcagctgaggaggtcgacgcagtccagctgcgagaacacccgcgcgatcacgtccgccggcgcccgcagcgccgccgcctcgcctccgccggcaaccatctcctcctcctgctgctgcttccgcggcggcgccatcgccttcctctcctaggaaatccccacctggccggttgaatttaagcgatcttggcataaaaatttaaggggaaaacaacaaatttgcagcgatttgtttaaagcccgagtggatcgggatgatcgattgcttggcccaggtcaagagagatgacgcgagatttggggataacacgaaatgaattcgggtgattgcgaaatcgcggacgcagaataattaaaaggtgatttggatggggagggggaagggattattggatcgtttggaacccattgatgctgggcagctgatggtgtggtgatgcacattgtcatgacttttctttgagatccacagcgttgtggcttatgcctattgttgggcggctgatgatgccatatgatttatcttgatatgacaggatgtttataggtgatttgttgcataactttgtggttacttcctccgtaaaaaaacttagggcctgtttggtacaactccaacttttaaatttagcttcagggtctggagtggagttgtgaagctgcataaacccagctccacaactctatagtttattttgtgatagagctccacaaaactgttgggagtacctatacatctttcgaaagatttttataatcgtatcacacagatttttaatctttatattaaaatccgatagatataataaaaagcaaaaagcaattaagaaacaccataatgaatattaaattaccatatcctcaagaaaaagaccaaatccaatacaaaatttaaaatttacatgtgaagattcaaaaattacagtgtaacttacaaaagttacagtgtaagttttataaattacactgtaacttacaagaaaatgcactgtaaatttgagtgagaaaatcgagtgagagataagaaaaaatctttcgagtgagatatagcaaaatcgaaactgtttggctaatatgataggatgggactccagattcgttatatgggagatggagctgtgccaatctgataggacgggactccagattcgttatatggggtatattcactcctagattgattttttttttacggataaggccatattatctttgtagataataaaatactcgtattttatattccatcgtcccgaaaaaatataacttacgaggatgagcctgaaagtgttttgtttttttagggaggcgtacattacagtaatatttgattagaaaatgtattaacaacacatatttttttcctttgtcacgtacgatgttgactttcatgcttcacaattgactatatatcttatttaaaattttagtgtgcataagaaaatataagccatttttaaagtatttaatgataaaacaagtcataacataataaattatatttacatatatatatttaataaaataagtggtgatatttaaaaacattatgcatttaaaaatggaggtagtataatgttacatgtagggtgctatatttcaaaatggataagtaataaagagcaacattcccttgtcaaaatacctaatacattaggccaagaaagtcaaacacttgcctgtttatttatacatagaactttttatttgacaggtttatttctgtagaatgtttttccttgatggcctcatcttttcacttattattatgcttattagtcaaaatttaaatttgtaaccttaaatttgaagctgattttgaggttttttcatcgaagtttatttttcagtcgttgcttttagatcgataagaacacgtatataaaagttttattcatgaattatttttcgtttgtaaatatgccgtttgatggggccttaagtttgttttggacaaagcaaagacagcgttgctttcctttgcagaagaaacagtttctctatttttaccccaaaaaaaaagagcaaaacatctgggttaaaaactcctgcaaatttcatgtaaatttccatatgttttggattggttaattctttaatttacattctaacatatttctgctattctcattcccttttcaaaaggaaatttctagttggaataacaaagcctaacaagcctaccaaaaagcaagatgttctggctgttccaacattaggcctagctaagggcttgtttgttcagtttaagatttttttaatcaagattattaaatttgattactctaagctggattataataagctggtttagaataagctacgagttatttgtctctagattattggaagcatctaagggtagtgggtctttagccactcaataatccggaaaaagctcctccctagaagattattagattatactaatctagcttatagattataataatatatcataataatctacttgtttattttcagcttacttctaataatacagattataataattctaagctgaatgaaacagggcctaaaccaacatctccttaacctcttgtttaattgattttgggctacgtagacacggccctcaaagcctgggccatgttggcttgggtaggattatgggcttgaagtgacattttgatgtgtaggttttgccctcttcatcaattttaagctagtaaattttgctacaggtcattcaaattttgtgtgatttgttggtagtcatcgtaaaaaacgtgtcacggttaaaagataccctaaaacctgataatttgctagaggacactttcgcctcaattgaagagataagttcttatgaaagacgagaatgtccctagtaccacatgcttcaaacatggagtgaaattttgaaaattatgcaactttaaatttgccatcaccccaagtatatcgctagcatacatcatattccattttcgctctagccacaggttgtgtttagttcacactgaaattggaaatttggttgacggaaaagttggaagtttatgtgtgttggaaagttttgatgtgatggaaaagttggaagtttggaaaaaaaaaaactttggaactaaacacgacctcagcttggaagtttttggccttaggggcatcctcatccttttaaagaatttttctctccaattgagtcgaaagtgtcctgagcaaattactagttttttctctccaattgagccgaaagtgtccttagcaaattagcaaattactagtttttatggtatctttcagtggtaacacgttttgcgatatctataagctaattacataaaatatgagtgtcatatagcaaaatttgcctttgaagcatgattcatttgaaaaatgttgga

SEQ ID NO: 40848 - DNA, 1762 bp, Oryza sativa
attttaattgcctaatgtaccatggcttgtaaatcaacatccaactctttctttatcctaagtcatccctaacttgccctttttattttgcttttccatttttttttctaatggaacctcaaatgacattcgtgctatactttcacggtacattcactcattggctgatgaagagttaggcctagtttggatatatttggtttagcttttttacgacagctaaaacgaagtaagccattagagtataattaattgaatattaatgattataaaatttaaatataagtttatttgatttttaaaataaacttctatataaaagattttgcaaaaaaaacacacgcacaccatttaacagattgaaaaaaaacgtgttaatggaaaataaagaagttacagtttggagttagggcaaaagtaagtatttgttattgaaaatctcacaatatatatgtataagcaggcaatacggtgggttccatgaaaatataagaatctagcagaagaactattttatttctctatttcctggttttaaagaaaagaatacagccttagttacatttaagctgcaatggaaataaaaacccacacacggtattatgtatttattatccattggccatttggaccattggatcaagatatgtatatatcatggacctttgtcgcattttcaatattttccattataccgatatgcactctgtatacaattgcaatgcattcgtgatttggaacataagaacatatgaatctagctagacaagattttgatcaaaagtttagacacaatatcaaaaggactatttgattatacatcgctcaatcatgtacatcttgttgaatagagaatatatgccttagaatccttacattcaatcacatggtttggaaaagaataaacccgtttgatgctctagctctcaagtctcagcaggctagacagccacatctccagcctgtgtattcagctactctgaaaaaatgaaaatgctatggggcacaacaaaagcaacacataattatagctgcacaaccaggttattagttgacataggctttgaccttttgagttataactgacaagtcgtgacaaaataaacgaaacaattataataaattttgaaaaaagttttatatctatattatgttgggtgtaaaagacagtgctgaaaattagattgtgatgaaaacacatcaaaattaagttttaaaatattgtagctgataagttaacaagtagatgataagaggcatacaatatactttcaattgtgaattatgaaaatgtgaaatttagattcaatgaaatagtatttacatttatttgcaataaatggttaaaatattattgaactaacccattctgcacctgatatcatcacaaatttataaaccatttgaattttgaacaacaaaaaaaaatccgataccaagatgataccaaaggacgggttagatacttgagacatctagagataacaacgtcatttgaactcaagatataacagaagcaaaggataaaataaagaaaaaaaccgaagaaaaaaaaagataaaaccagaaacgaaataaaaatctagggtttatcagggcccacacgcagcctcgccgcgccgtgttttttttttcctccgcctttattttctcctctcctgtcctctcccgcaacctccacctcctatccgccgccgcctttttcttcctcctcccacccgcgcaagctatccgccgccgcatcgcgtcgtcgacgaggaga

SEQ ID NO: 40849 - DNA, 2115 bp, Oryza sativa
atgtacctgttgcttagtgagacgcgggatttgtaagctaaaagattgttcgagagattatctcttggatagtggtaaaatgatttaggagtaatctatatcctaggtaggtcttttttgttattgataatgataggtagggagttgggttaaaacaacagcatgcttggcaactgattggtggtttgattgttttgaaagagggttgaacatgaacttgttggttgcagaacattagtttaattagtcttctttatttaagaaagcaagtctattactgaagcagggaggactcttgtttggtacattatgcaattattatactttgcccttggtatgcttacggtttttaaagaaaactaaaagttatgggagaaatcccttcatgcaagtgcttgtaagtggaatagttgaagtgtgctcctgctaagagaagcattgatgaaagtgaattttgtgcataataaacacaaaactgtcttgtattgttggaataacctaaactactaaaggctgtactaatcaattacatgttcgtaatgatagcttgtaaaggtggtgactggttggggtgtatatttgagggttatcttagtgttgcttttcctgtatgattgtaaattttgatacaatcatgcctgttgtggcagctatgatgttatttgtttagctctttgacttgttattccttgatgcaggcaatcactgctaccagtacaaagaaggctgatctgatttttggtgagatccaatcacagataaagaacaagaacatcactgtagatgtgaaagcaaactcagactcaaatgtatgactctttctctcacgcacacacatcgtgtgcacacgcttgcgcacacatacacacagataaacgtgcacacaactaatttacattttgtgattgccttctacattgcaatggtctgaaatccttgttctatatgaaatacacagacacacccaaataaacttgcacacaacttatttagattttgtggttgcctgctacattgcaatggtttgaatccttgttctatatgaaatgattttacgttgccatctgacgaattcgtaccgaatatgctactagttttgattgcattgagcaatatgttctgtgattagctgttatgccatgctctcccttttttgtattgactgcttctatctttggccaggttgttactactgtaaccgttgatgagctaacaccaggattgaagtccatcttgagctttgctgttccggatcaaagatctgaaaggtaatttgctcatgcaccacattactgcttattttcaatgaaaccttcttgggtggttgtcctcactctccctctttttggtttcagtttgagcttcaatactcgcatgattatgctggtgttagtgcaagtattggtttgactgccagtcctgtagtcaatctctccagtgtttttggaaccaaggctcttgctgttggtgctgatgtctcacttgataccgccacggggaacttgaccaaatataatgctggattgagcttcagtaatgatgatcttatcgcgtcattgaacctgtaagtgtcttgggcttacagtgaattattaccttcatcatcttctaacttcataactctttaagttattataaaatccacatttgtacatcctattgaccattccatctgtcccgctagaagcaatgtgtctgttcttgccatctgaacaacttatagcccaaatagagtttatatatatatatttttatcaggtttcatgatctacctctttcaataatggtaggaaacatgagataaaatagagtaaacttatcaatgttaatatcttattggagttgacatgtttccttgttctcgttaactacagagaggaagataatgtttacaagccatgtttgggatctccattcaaaagccgctactattttaagtgaccatatacgatcaagatactttgcacaatacacaccttatcaacattgaaaactgacgtttggtgttacattcttttattaaaatcaaacaaatatgttgaatctagaaataagtttcttggcttgcatctcatatcaactaatcatcaatctctattatcctcatctttagat

SEQ ID NO: 40850 - DNA, 6924 bp, Oryza sativa
atctcagcagaagttgccaccaaggccattgacaagagctcaaaggtcggcattgcggtggccctcaagccttgatttttctcagggtgtacttacatttcaaagatgaaattgagatgagttgaaaaacatcttggcgcatgcgcatcttttggttgttgcagtctattagattccaagaactgccatgtttaatttgaggattttttttttctgttatcggtgttagcacttgttcaatgagcaacccttgcaccccaataattcaagctcggcaaaattatgaacttgcttctaggtgacaattttttgttactattttcacactgtcattgtccacactgtgcttgtggttatggtgctccaattaaactaactgtttatatgcttgtcaaggtgtctagtaaagtggttttaaatgctgagcaaatgagtactattaacatattcagtccctgtctaaatacctgtacaattacacgtactcttagacgtaaaaaatcattctgtggctacaccacgtaggcacgtgaattgtttataatatccttttgaaaataaaagcgacgcaggcatgtgaatttgtttaaaatctgtcggaaaagtaaaagaatagtcgcgtgaattgtttataatatcctttggaacataaaagtgacgtaggcatgcaaatttgtttaaaatctgtcggaaaagaaaaaaaatggtttcagataagtttgattgattgatttcgtgtaccatgcggacttcagatatactcctatataatagagacgagacaaaagataacaaaattattcaacactactttcttaaattattcaacactactttcttcttccaaaggaggaaacatattactgataataaagggttggggatgacctgggttgggtgccttcaaattaaattcccatccaatcacctctcttttctctttttatccacctatttattcttatatagatagtatcttttcattcttaattcttgtgtagagataatttcttgcatgagaaataatttctttatctttttacctctctcaccattaactcttgctacattagacttttgcttatgttacaatgtatttaatgatatggaaactagatgacatgtttaggggagtttaagattctgagatgcagctggttggtagccgctttctaagaaccagaatctacaaaaattaggtttcctaggtttttattctgggaaaagctgcagcagctagaagctcctccaaacaggcctttaaggtgaaaggtaaatgaccacagtgctgacctgtaggaatccccctgccacgtggcaggctggcagctaggggcgtggaaaattacggttgtgccacttatccccctgagaaatagagagaatctcctcttatctcttcgcgctttccctcgcgacgcgaactcccctccgcgcgcgcgtggggcacccctcacctcactctcactcaccctcttcttcctcctcacgcctcacaccgctcagtgacctcgcaaaccagccaatggcgccgccaccgcggacgctgtcgccgtcgtcttcgtcgccgtccctgcgctcctccggccgccgcccgctcccgtcggcgagactcgtacgtactctctctctctctcccacggtttcttttcgcttctgcttcctccgggagctgatcggtgacgcatttcttggcttttgcttggtataggtgggaagatgggtgcagcggccgtcgtgctcgctgtcgatgaatgggtgcggcgcggcggtggcgggggcgggggcggtggcggtgcgggagacgcgggcgttgccggcggcgggcgcggcgggggacgccgtggggcagctcagggaggcggtggcggcgctggaggccgccgacccgccggcgtcgccctccggcatcatccgcatcgaggtgcccgtccggcagcgaggggacgccgtggagtggctgcacgcgcagggcgacctgcgcgcgcgctgcttcttctccgcgcgtgccgccgctcccttgcccgagtgcccggccctcgccatcgcctccgccggcaacggcaacggcaacggagcaggcggcgtcggaggggagcagcggcagcggccggtgagcgtcgccggcgtcgggtccgccgtgttcttccgcgggaccgagccgttctccctccgcgactggcgcgccatcaagaggtaatcgatggtgccatctactactacattttttaatacatgatgataaatgttgattttgaactttgactatactaaaaacatatcctacgcacataagcttctcgtgctcactaactagcaaatttcacgaaaagttctacaaaaaattagacatttactcctattagtattacacatatatgcaaagtttcgtattcaaattcattaaattttagcagtaacaaaagatgaaaaatctgacagttttaagggtaaaaatctgtcagaattttatattttttattacggctaaaatataataaatttgaagataaaattttacatatagatgtaatactgtttgaagtatgtgtacaattttttatagaatttttcgtgacatttgctagttattgtgcacggagtgtgcacaaaaagtttgtatgcataggatatgttcctactaaaaagacatgaatattaggaaatgacctaatatcaaattattagaaggggtgaagcttcaaacttaggttgtctaactcaccactctatagagttagctgtagaccctggacgtttctcaccatactccgtttattgattttgaacatatttctttttattcttttgctattaagagtcaaagttaaaaatgtttgatttacactattcaaaaaataaaaatacttatattttaggatggggtagtatatgatgttattaactttttttaaaaaaatagagagattacaatagtagaaactaaccatgcgtagcaaatttaagaagtaaatgaacagctagttgctagtaatttttttgataaatttcagttggattaataagaaatttacggcgatttcttcctgaaaaataaatagaagggataaatgctcacttggaagtgctttgtgtattggtttaagacacttttctctggtgctcctttatcatgaagcacaaaacttttgcgtgtgttcaagagaaaaaaaaaccacatgatcttgcactgtgttagtgaattctttatatgatcttgaattatctttgaattccttgattgtttttataaatttatttatttatttatttcaatgagcttcatgctggtcttggcccatactgtgtcagtgaacacttcacatggtctcctactgtgttgttggtgatggtgaactattcacatgatcctttattatctttgaatttcttgattgttgcttcatgattgcttttatttttttttattccaatgaggttcatgctggtgctgacccaatgacttgatttatgtccataaagatttcttccaagggattgcccactgattcgtgcttatggtgctatccgcttcgatgccacgagcgatcattcagttgaatgggaggaatttggatcattttacttcattgttcctcaagtaagtccttacttaattaccaggatcaccccagttatggattggaatagatggaatgtgatactgactcctttgaagtgtttctggtacttggtgtaggttgagtacaatgagcttgaaagagctcggttctcgcaacgacgattgcatgggatgattcactttcttggacatggcaaaatgctgtgaaggagctccaatcaactttgcagaaggtatgcatttctctttcttccaattctgtcagtcatgtggaactgtggaagatagtaaccttgttgtgctttctgcagatatcatccagtccaattaaagtgaacaattccaccctgcaaacaaccatactaaatcttaatcatgtccccacaaaggcatcctgggatcttgccgttactaaagctctccagatgattaaagggaagcaaagagaattagtaaaggtaaattattcatttcatttactgtttgctaaagaaaaaatctagacaagtttattccccaaaagaaaaaaaaatctagacaagtcatgttgtgatcattattttgaaataagcttgcatcgatattttctgcaggtcgtactggcaaggtgtagcagatatattactgatacttgcattgaccctgttgaactgttggcatgtttaaaggtatattgcatctcttgtattgctgttaaaacaattagatctttctgacactgaatatacaggttgagggccaaaatgcttatcagttctgtatacagccacctgatgctcctgcatttgttggaaatagtgtatgtcaattctattctgaaaaacaaattccttcatcacatcttctgtgtgatctcttgtatcgattttactccaaatgatttattagaatatctcttactatatttacatgaacttggatgttttttcttattttggccttctcatgttaaataacaatgacctaagttctaactaatgttcattttatgcaaatattctgaatagccagagcaattatttcatcggaaatacttaaacatttccagcgaggctttagctggtacacgagcaagggggaaaacaagggctgatgactttcaaattggtcaagatttgctactaaggtacctttcccttcttcgattcataaacatataatgaacctatctccagatgatttaaggcgatatcaacaccgtccgtgaagaaaataaaaggaggtcctaatataaaactttcttgcagtagcaaagaggataatgaatttactatagtacgggacagcataaagaagaagctggaggcaagttgagttttacactgactgattttttttagtatgatactgacatagtttgttttgttcctagttgcaagaatattattgggggaaaacatggccagtgcagttttattcaaccaaggaatttattatattttacagatgatctgcgatgatgtggttgtccatcccagcaaggcccttcggaaacttccaagagtacaacacctgtcagctcagttagctgcaagaatgaggaatgaagacgatgaggtagtctatgattcagggctttcttcagtcttttatattggaattttcagaatttttgggggtttacttgcaagaagaattttggattttaatttaccatattgtcaaaaaaatgaccacacccgatctgattctttgtgttggcctggccattgcagtttgacatcctaaatactcttcatccgagcccagccgtttgtggtctgcccactgaagaggcacgccaattcatacaagattatggtatgtgcctctataatctattgcaactatattgttattttcataattacaaataaaattgacgataaaagattttttgatgaaagtaaggtttatttatggtgatcagtgaatgttctattgttatgtccatcagaaatttttgaccgtggaatgtatgctggacctgttggttggtttggaggagctgaaagtgagttcgctgttgggattagatcagcactactaggaaaagtaagaaaaaaatgtagtcagtacgattgatcatataattgggatgtgatgtttttttgtcaaatatgtccatgttgttaccatatcctaagggccaattagttaccaagctgttgtttgttctagggtcatagcactttagtttatgctggtgccggaattgttgaaggtacaaatccatcctttgaatgggatgagcttgacctcaaagcatctcaggtattattggtctaactcatgatggattactgctatatttctttttttttaaatgctaatgcatcccatttccaattattttcagtttgcaaagttactgcagtatcaagaacaacatatttgcttgcaagaggctgaaaatatgggaacagtgatttgaattgtaactagtaagtcatcacatattcatagattacttttctagttctttcttatccatttgacagtaatctacttctcaaacaaacacttgtttatatcccatggtttattcagttgaaaattttcatattttttgaaacacggacgcagaagttttaaggttattaatcaatgcagcatctgaacggttagttcaggaaaaaaatcatctcaaagaacataaaatttctgatatttttggtattcagaacaagcattttttttatacttactagttactacaagtatgacgattttcaaaagtatatcctttccactgaaggtcctgacgtcttgtgcacaattttttgcagggagtttttgttttgttgtgaagaagatttgcttttttttttcctgccatgaacttcaaaggattgtcttgttcaagtgcttgcataccaattatgtttccgatcaatcaaacacctcctacatacgcagccgctgaagcataaatccaagaaggcgacgaagataaaagttgcgaagagtacaaaggctatatgtacaataaatggggaattatacagtcgagtgcaggcatgcaagtatatattgaacctcatagtttgttagcttctttcgaatcgcttatacatttgattcttaaaataaataaatatatataaacacaccattttatgagcatacagactgattgttactacacatatacttcctccgtttcacgatgtaagtcattctaacatttcctatatttatattgatgttaataaatctagatggatagatcttttaacatcaatatgaatgtggaaaatgctagaatgacttacactgtgaaacggagggagtaccaaagatcaaatcgtgcgggaaaaccatacaaaaatataatgcaggattgcaggtaagataatact

SEQ ID NO: 40851 - DNA, 2497 bp, Oryza sativa
tgcagatgagtaataccagtgtaacaatagatcttatgaaatccgatatgagggaacttcctgaaaatgcctccgagatacgatcccagttttcctgcatccgaacgaaacaacatttgtaagctcaacattttctattacttcattgcatgtttaatactccctccgtccccaaatataagggagtctaggttgtttcggagaaattaaggatagaggaaaaatactatgagcccatcattaaataatgaggggtgtgtaaggagtgggagggtggttgcggcaatatggggagaaatttcaatcaccggtggttggagggattaacaagactctatgaccccttgtttgcgaggacacactttgaatgtgtgaatctcttatatttagagacgaaaggggtcttttgtcaggaaatggttagaaactagattaacttgaatggaagttactcattttaaacaagggtaacccatttcatttatccattcaaagtgttcttcgaaaaggctactttcataggttcataccaataaaaactgattttcaaaaattatggaaattttcgagaataattagtaatatagcatatgcggtaatctaccatcctacaaaatttctttgtaaaacatgacttgtacaaggaggcaaaaaaagacaatatcatcagggagtgaagtgactttaaaagaaggattcaatgggtaaggtaacatgaaaataatatagtgtaaaatagtccagcaaagtagctaaggaaactataattgtccttttctcttacaaatataacccccatttgacgtatctacacaattcgattacttgaaggaaatgctacttgaagaaagcacgaaatttagctatttacttataattttgaatgtagaaaatttgcataattttgatgctttctagggcagaaaaaacatccaataagtggatatttcattatatttaaagatcctaggagaatcacatgcttcaaaggtccagatatcacaaattttatgttgcggtaacgcatagaggtaactggactttttgtaccttcaaccaggaccatgcagtttcacgtgcctctattatgacacctccaagcacacgatatgcatcttgattgcgaacctataagcaagagaaacaaatgagacctgtatataacttacaggtagctaatgtaaaagtataagttcaatcaggtccttccaatggagtcatggaagaaaaaaaccatttagcaatttacctcatctgtgaaaattaaattcaatgattcaagaacaatatccttatcctggcaagaagaaagtgtgcctacagataaggagacagagccctcaggaagtctggataacccaaaatatcagcaagcattgttaacacaagatggctgagaagatatcaacctaagacacgtaacttttcctccccttcagctgatttcctgtagacctttagaagagcatcataaccagatctgtttgtgctactaacattatgcatcacagagaggtatgcagcctgaaaaaaaaatgcaaaatatacagagatgaattcgtcttcaaatagaagatatacagatatcaattcatttttgtaaaaaagatacagatgagtcaaaaaagaaagaggaccatgtaaagtaggggtaaaagaaggacctttctagtatctggagtaagaaggaaagtgttgcgatcatcaaagaagatttggaaacgcctgaatccctcatttatagtcttatcatgcccaagctgaacaagggcaaccaaaagcattggtctgagcattgcattcaggtggctttcaccatctttagggtcccaacctaattttctgcaaataaaatttatgtcatcgtgtatgcatggccacaaagaaaggcatgtttaacaaacatacacatagtatgaacattcaatgggaaataatatattgagaactaaaaagcagcaaacatggtaaacatacttagcaggcggaagaagaagcttgataaaaagttgcttgatgtcaccagccaggtcaggagtagcatcaattgatattttcgcaacacttgaagttacctgacaagccaaagtaaaagatatatacaaatcattgccaacgaataactgaatatcctggaatttaattcaacataaaatacacatacagaatttatgtgtgaaagaacactgtaatcagcctcgtcacggaacgcatacagcaagtggagcaacgatgacaatgtttgcttgcaggcaatagaaagggcatgtgcatcgtccacaatgcctgtaatatagtgttataacacctttaatcgctgcaatagcgcccaggaaaaaaaacattgcaatagaaatttaatagtgccacaggttgtgtttaccaatttcgtccattagagagagcttcttggcctgcaatgcatttcgaagtgcagctgtaagctcatcatcatatttaaccctataaaatcctgtttcatcaatgttcaacttaa

SEQ ID NO: 40852 - DNA, 1022 bp, Oryza sativa
  unsure (1)..(1022): unsure at all n locations
cgtaaattctagtcagccaattacatcttcataaatagcaggcacaaaaattaaactaagatgaagttctgtcataatttttttatgtaatatttgtcataaacatttcatacaggattttaatttaggaattgtacctcactaatcatacctcggcaaaatagaaaggaaaagcaaaccatatgcataatgaatttacatataggtggttcagaagtagatgaatgtgcagtacattggaatgacgctactcttttcgataatttattacctgttcaagttccaagtcgtgccctttaagcttcacgctgataacaggataaccttgttgcttcgtccacgtagtcatcaaatccttgacaggttcaccagatacctcttcaagaacagcccacaagtcctcggttttagcatttgagtaggcatacttttttatatatgaagttaatgctttctgaaagagtaacagttccacaagtttagtacaagaggatgcattaggagaatttgtggagtcacacagcaataatgaagaaacaagataaagaagtaagcaagaattgaccttcgataaatatgtaattaacaaaaatggagctttatcatattagtgggtttacaatttgttcatatttatgatatgatcaacaaaaaaagggcaaagatagctccaactcctgtaacttgtacatggtgttacaggttgtaaattgttacccaccctagagaagtacacaagatggccatcaaacccttattgaagttgtgcctctctctacaggattaatattttcatctgttgaatcttgcttctttatatcatttgagtatatgtccaaaagtaccatgcaagtacgtgcaatgaagtattaatggttgactcgtcatcgataacagggtactcgttaaacaaaagcaagatgattaggggggaaatggtaatatttgccctaaaaaatataggaagnnnnnnnnnnnnnnnnnnnnnnnnnnnnnnnnnnnnnnnnnnnnnnnnnnnnnnn

SEQ ID NO: 40853 - DNA, 719 bp, Oryza sativa
tgggttttatacaaacattcataaatcacatagttttctgactctgttgcttgtggtaaagaactggacgattccctccggtcatggaaacatgttgttttggacatggacatgatctacaagatacagttttggtcactaatttttattgtgaaatatttggaaaccccaaaaaagattactatgcttgttttttgagacaagacaatccacagatatgattttcatgcggccaatctaaaaatttaaaaatataccttgtgcaaagtttataaagtttgagttgaaagttgaagcacttcacatgttatcgtgactggagggagtattggctgccatcgagagtaatgacggttgggtcacgcatacctaaaacctagacatattttgtacagaaaaacacatttctcttctttttcaacatttttttctttgactactcgacatctgtttcattgttttgtatttccccctttcactagtgtttctcaatctttttctaactgatgcaggaaaagctctatgaatggatcttgaggcagcatgaaaatggcttgaggctgacagttgctgatatagcctcgcacatccaggtttgcagttattcatcctccaagaactatttaattatcctctaaatttataacatggcattgaagaacctgtttagattttcctttcatgctcattgtttttttttgtgaatacacctgactgca

SEQ ID NO: 40854 - DNA, 826 bp, Oryza sativa
catgtctgggatttttccactgttaggctgttgaggatgctctgaagagcgtaaatctgttccatggtggtgttggtgataagcaagtgggaaagtacagcggaggcatgaaaagaaggctcagtgtggcaatatcattgattggagaccccaaagtacttttctgtatatttttttaacccttccataggatgtccttttgttcttttggtaatgtgttatgcaacctgacaacacattctgtaggtcgttttcatggatgaaccaagcactgggctagaccccgcatcaagaaataacttgtggaatgttgtgaaggaggccaagcgaaaccgtgcgatcgttcttactagtacttatccttttccctttctactttcgcgtccaattcttagattcctaacgcgtcacttattgattttaaaatttacaagagtatcaaatagtgttgatcaaatgtgattctcgcagcgcactcgatggaggaggctgaagtactttgtgatcgacttggcatctttgtcgatggcgatttccaatgtcttggaaatcctaaggaggtacattttattgccttcttgaatcacactgtgtgctttatgaccagatctaaaacctcatttgcacaatgcagctaaaggcgagatatgggggagcatacatattcacaatgacaacatctccagaccaagaacaagaggttgaacggctagttcatgacttgtctccgagcgcaaataagatctaccacctatctggaactcaaaagttcgagctgccaaagcaagaggtgaaaatagccgaggtatttcgcgcagttgaggat

SEQ ID NO: 40855 - DNA, 4737 bp, Oryza sativa
atagaggagaagtagttatgcttgcaatgcatatataggttagaacaataatattccactagtattgggtatactaaccttttgcagagaataaccataaagtggaggagaatcgacatcacacagacgataaatcaatcggacgatgtcgagaatcagagttatgtatgaatgggccaagaactcagaaatgacacgaccaattgggccaaaattcacaagtctgcaaagagaagaagtccaggaggtcgccagccgaagatgggctggtttgggccagcccatggttcacccccatctccactgttgaagccagggttcggcgtgaacgtctaggattgcatcctaatgacggttggagggcacttcggacaattccccttccacaaccatcataacactggtggagaaaccctttgtagtcctggttcgtaacccccctttagtcccggtttccaaaccgggagtaccaatccgggactaaagatcgagctgacctttttttttttttgcatggccctgttgctgcattgtttatatatatatatatatataaaccatgcatatatatgtttcaatacatatatatgcatacatatatatatgtatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgtgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtgaaattaaactaactctgtgttgtatggcaacagtatgaacgtcttgtaatgctgcgccttcaggagatggacgagattgtcctctgtttcttgtggatattggtcgagcattgcgacgtttactttacgagggtcgatgaatccagtatcgaaaaccctccgccgtcgggccctttgaatctccattctacaacgataaaagggagtatattattttctatggtctacttacatacaaggacctaattaattaaaggagacgtatagtaagaaatctaactgaacgatatacttacaaaatccagcaactcataatagagacgtcgagggagtccagctggtatagttcgtagattcccctgaaattgatccagagaatgtcatctccttgcaagaagttagattggtgcgactcctagcaattgatccgtagttagaccggtgtcagtaataaattgttctatcgtcatttctttaccggtcaccaacggcttgatctcctggtttggttgctctccaagctgagggactggtttggactttccagaagatgctttcttcagcgttcgctcatagtccgatagcttgatggcctccttgacagatgcagacatacccctgaagaagttcctgacactagggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggtaggcggtggagctggggggcccttgacttaaggtgctggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgtcatagaataatggcatggcatgtgtctcgtagatgcgtctcaccgtctcctccagggtaatccagctcgaggtcctcgtacgcgccttcgaccaactcaactttgaccttcgagtatcctgctggaatcggcctgcagtggtaagtacctgaagggtccgttgggatggctatgcccgacgccaccttcatgttgtgagagattatttattagtaatcaacatatataagcagcaactagcggaatggctaaatcttacctttattgataagatcttgaaagtaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctaagaggaggcttccactgcatctgttagtcgtcgcgcagcctctcgtatctgatcgccgaagaccagtgagccatcagctgggttgagagttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcacctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacacagtactgacaggcacgttatcccgcacaacccaaccgctgtgacgtacatagttcttggtggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctctttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttagcaatctaagtcatgtatgctaagtgtaaatgtcgtacattagaaccctacacaaccttacgtgctaaatctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaactgatcgtaatcctcgtcagtcttgtcctcaactccgacgatttttcttttgcctgggagaacc

SEQ ID NO: 40856 - DNA, 2617 bp, Oryza sativa
ctaggctggtttgcagtcactgaggagactatagcgtgaaagatctttctttggtcatcatttagctgcgctatcagagagtcagcatgcatggacatcataagtggatcagctgcaagctcttcatcgattaatctattactgtcgggcatgtgtgcggtagatgtaggtactggcaagtcaaaatcttttatattaccgccactgtttgcaaaaacagttgtaagttcacgcaggaggagattgagcaagtgctcatgtggaatgatgcattgtggattatctagtgctttctttagcctgttatggatgtcatcagtcatgtaaagccaatacttatcaaacaatgatcgtacgttaccaacagagcaataaagaatgacagtcacacattgccattatacgtgcgtacatcagcataattttgcgcgcctttaacgatcattaataacattctcagataatatagctctccacaggttgggtgcacataatatatcctacctatcttcgcagctggtgttcgtgcacgccatgttttagatgatgagtcccatgaccattcctttggaaagtcacagtatgttaatgaacgtgcacttagatattttgcattagcctcaaaccatgcagttagcattgattgtttcgcaccagggctattcagcaccgctcgcaaatcagaacctggctcatatctaacatagtttttcccaggcaaatgcacagctagacgctcaactggtggcactctagagtgtatgtcaaactcaaatactcgatgaaacgcctcacatgtcgaaagaaatctaccatccatgtattctagtatttcattaggaggagcgaggtcatgatttggtgacatatttcatgtcttcgcagttgtctcaaagtatattttgcacggtcttgtccctttgtaatatacttgaataaatatttaattaagtttgacttgttacaccattcaacatttatgtgtgcctcgtatgttttaagcaacttcaggttgtatggaacaactgatctattgtccaaaggaattccatttttaattataaaccgtccattgtttcgtcgtctgtatattgtgaagccagattcatcaataatggtctcatcttgaaagtcttttggataatgttttgagcatttgtcgtttttcatgcaagcacattttttgtttgcatcgccacaaggaccatgcatcataaactcgcttaccaattcatatcctagtcgatcggtttcaatgtcaggaatctcagcagagatgaagccatctatcacagatgctgagatgtcagcagttgatgctgcaagccaaaccaagcagtgtatatgtggcagctcgcgcttctggaactcgacagtgtacagaactaaaaaggtttaaagaacaggaactataaggaaaatattggtgaaacactaaacagaaaatgaattttggctgctacctgcaagaaatttcccaaaagtccttccctctctaatatcagtgatgaaatcattgactttcatgttaaacacgcgaacaattacatctgctctatcagatgactgctggccgggttcaaatcggattgcttcagcgatttcttgccacttagaattacatgtgaatgtcacaaataggtaaggcgaaccatagacgcgacagattgccattgcgtcctgataattcatgaccatatacctcctgcctccagtaaagctagcaggaagtatttggcgtttcccaactgaatctccatcggtaacacctctatctatcacatctacaatttcttctacagattcagcacgtaattccttttgatgatcgattataaactgtagtctattagcttcgatagtagaaaaaacatcaacaacagcttggtcactcagtcggccatagcatgtgaaaggattaggttcatttagcctataatgcattagatatctatgaaactccagcatcgtgagatattttctaccagtcccatcataattactatattcgatgcctagatggaaaccagattcaccatagggaaatagcaaaggatattgcaaagataggtatgatggatgcaaggaagaaacttgacgcattccgtggtctctatcgtgcacgagcagatcaaatttgtattctttcgcatcaaagtcaccaactattatggtagttatttcagtacttgttggaaggttatactggacatcatctctagcattacagcctaataagcgaagagttattttctcatcaccatgctgagaaagaaggtctctaacgtatctgaaattttgaacaagtctattgttgctatcaagcatgcgtgataaggcagcaatgatttcagggtctggcctatcgttgtcatcacggtcacggtcaaaaatattgagtcgattttgggtttcattctcaggatcatagatataaagctgtgcaaacttagggcgtgcaccatgcgatggtagaagagtaccaattctgtggtgcacaacaccgttaattttgaaaacataaggcgcatttccagtattgatcgatttatcaatagtcgctcccattgaagtgaaagcaaacattgaattgtatgatcgaatctgcctcagaaat

SEQ ID NO: 40857 - DNA, 6834 bp, Oryza sativa
ctgggtatgatgctgcacaatacatatctgagaatgtatttcttttaaccggccaatataaattgttttattttttttatcagaaaacacggacctttcaatgattggatgtattccttatctgtccttgatgaactaccggaggctctgctgtttaaagctgcaattaacgaacattgcaatcatattttagtgccgtagcttctcatatatagggtaatgaacgctgttaggtgtgctttcagtacagtattaccattctgtggtgcaaggagaggaggcatctttgaacgcagcaaagaccggtgctgtctatgtagcttggatagctctggagtaaagtccatcaacgaacgtggctttttggctcgatgaatctggggaggttgggctggcaacggtatggcgctttctatgcgcatcgcagatgagcgcaacaaaatgttcgcggctcgtttctctcgactcgcgcgaactctctgaaccctgtccatacggtggtctggtatttgccgagactgatggagcaatatacgcagactaataggaataaataaagagtttcatggcatccctaaaacactgcaaagagataatctggaagtaaagtgtgcaacagaggcagaaggaatagcacagggaagacagaaaagatgagatggagaagaagagagcagaaaactaccttagccctataaagcctagagagaacagggaaaagaaattcgttacaggcagcaatgtttgaaatatgaggaaagagagcagaaagatagccatgtgcaagctaacgtgtgcgattgctaccaaaagatgatgcgctgactgtcatttttgttacatgccccaacagagacaacacatatgcataaagtctaagcacattctatcacagatcattagcacagattgccaggcatacaaaacaagcacttacacacacaatccatgcacgagctaaaaaggaagcacataaattcatatattcatatacaggaacaaaaatccaattatagcaaggagatagttaccttgcacggaacagtggaaaagaagactgcgatccagtgtaggcccagagacaacaacagaatatgacaattagccctgcaggatgtaaagaaacacaatcaggagtcatatacagaccaaacaattgataaagcagatacatggtattaatctacacaataagctgcaaaatagtatcagatctaagccacatatgatcggccatcatccacaatatcataaacagacaagccaaatcacaaggacggaggaaaaacctaataacctaaacagacaatggccatgccatgtaagcataaaggtcatttaatagtttaagaaagtacgcgcgaactctttgtttacaaaacagggcagatgcgctggcaaaaacataggatgagaaatatcagtatgaatgaatagcaaaacaaaggcaccgaccataatcgacatataacacgaaggagtgatgaaagcaggaaagcaacgtatctggtacccgcaataacaaattaaatactcgttaattcgccggaaaactaccctgcgctatacagaagagaacatagaggcaccaaatatgctgctcccagatcgcactgcagagattaatcaggcatacttcttttttcgccagacaaaatcaaaacctaacaatgcatatcatgtctttaaaatcttgcatggttaatccagcttgaaaacaattagtaatctcaaaccaaaaataaaaaaccaataattaacagcagatatcaagtttttaaaatcttgcatggctacctcaccctgaaaacaattatctatctcaaaccaaaaaataaacaaagggcacacatatcatgtgcgaaccatgcaacggtaagcctagtttgagtctcaataaaagatcaggccacaagaacgcaccatagtgcagcaatatctacaaggggatgaagcgagctaacagcatcaaatatataaagacagaaagagggaaccctggaacagcaactgcaaattaactaaagatgagaacgaatgcagcagaatcaaaagtgaggcagagggaaacgacatgactacaggctgtaaaggacagaatataaagaaagaaagcatggaagagaagcctgcggagttagttatgcagaagtaacaaaagccatcgaggtgtcccttatcggtacaataactgatgatagcgacagcagacatgcaacgtcctagacatctgacaaccaaagaaccgacacagcaagatacaaacaagcacgaaggaacgatatcaaaaagaaccaaaagacaatgtagaagagtaacaatgaataagatgaaaaaagaaatagtgagagggagcacacgacagatgaaaataccttgtatgaacgaacacccaatcagcaaagaacgcaacagaaacaagctgaccaagagtatccacagaggacaaagctgtcggctaagaaatagaagaaagaacggaaagagagagcctggctgaccctgcgcaagagaagacgaccattagcatacatgcatgctaaagaaaatgcacgatgaatacagtgaatagggcagtctatatgatggaaagcatacacaggatgaagaagctaacctcctcgatcgaaggagcagcaccaacgttccttggcaaaaccaatcaagaacccttgaaggatcgatccagctcatgcagatcccataggctaaaaaccaagagaaaaaccaaagaatgatcaggaggcataaaaacaggagaaacatcgaataaagatgagaacaaaatgagagcctcctcacaccctaccctgccatactgaacgatcaaagatcacagcaaacagatgcggactacacgtgtagatcgaaccaacgaaagaagcaatgaaaacgatagagcagtggaaacgacgatgaaagcttgagaaggaagaggagaaaagaagatggctgctagcacctgcaaacaaatatagcagagaagaaaggacaaactaaaaccacagcacatctaagagcagcaagcgcacctaccaatacgaaaggagtatacatggaccccatggcacccaaccccacctgaaagtcagacatcctaacacatcttccacgatgaaggaagtaggctggatcatacaccatgagagaaccatctaacaccacatccaattagaccccacaattcagtcaccaggagcatatagaccacacgcaccaatacagatcgatggagccgagaaaaccccacccaatcacagcacaccgccccaactatttgaacctgacaaccgcacttgcaagctaacctgacagccccactcccgccgatcggtgcacaagagtaggcatgcatagttgtgtttccctacatagacacagctcatattgtggatgagacgaacgccgacggtaagggccacatgtcagcgatagcaaatcgatatctgactgtttgcatccccatgttcccaacccatctccctcgttttccacgcgcacgcttttcaaactactaaacgatgcgttttttgcaaaaaagtttctatacgaaagctgcttaaaaaatcaaattaatcaatttttttaaaaaaagttagctaatacttaattgatcacgcgctaatgaaccgctctgttttccgtgcgagaggaattagttcccatcactggaatccaaacacagccagaagaggcgcaccgagcagtgccatgaaccatcagcaagcgcggccacacgatcaacatcaaacgggcagggcagcaagaagcacaaacagtcaaagtcatcaggatcgtagtcgcggttgacctaggtattgagcagcatgaaagccggcggtgaacagtgcgagacaagcatgcgaaaggcaaattcagcctgtagaacacattgaacatatctggggaagaagagcaaacatgaacgggcggccgcgttgcatatatacctttccatcggcatccatccgccgcggccgccaccaccgagcccaacctgcacgcagcacatcagagttggccatcagctctaaagcagagatcagagacagaggaaaaaggtgaagaaagagagacaggcaacctgtggagctaaccaccatggaagaacaacaagggacgacaccatccgccatcctccctgatagcaccagccgtcggctctaagcgagcagatccgccggcaagcaaacggcgcccgacccatccagcacgtacaggctaccttccagcgggcgtcggcagcgccccaacaacgacagcgccaaaccgcgaccgcgccatccagcacccaccgcatccccttcgaggggggcgccgacggcggcgcaacaagaagagcgccggccgcgaatcctgtccgacaacacggcgcacgcagaatagcccccacaaacggcaaacagtagcgccacaggcagcagagcaggcagcggccggagaagccccaaatccaggagacaagcagcatccgacgagaaagatggaaggagcgtagcggccgcgttttttcccctctcacgcggcggcgctctcgcgaaggggagagggagcgctgtgcaaagacaagtttggggaatacacccccagcctgcacgatttagggcgcgcccctttttcctcgtctcctcctcgcccgcatcagatttcacataaaatgaaggggctaaacgaaacattgctgagccaaaaacagcacaccaaggatgaacaaggaaaaacgcacaaagaggagggttttattgcaaaaattccagcgccgacgcggcctcacgagcagtcgccaaaaccctcctcattgcagccacgctgacgtgccgcaacgcggccgtggccacgccaggccaaatcgctgagcgaggagcagaccggggtgacttttaatactttagatgaaggcaaacactgctccagggccagatggcttccctgtgggtttctataagagatgtggcctgaatttagggggatagttaaggaaatgttggatgaattgcataaagggaatctggatactgacagattaaattatggggttatcactcttttaccaaaattagcagatgcaaacaacattaaacaatacatgccaatctgtcttcagaatgttatccttaagatcttgataaaggctataaatgagagggtggctaaggtggccgagaagataataagctggactcagactgcttttattcctggtaaaaatattttggaaggttatgtgatcttacatgaaactttgcatgagctgaagaaaagaaaaaaagaaaaagggataatcttcaaaattgacgttgaaaaggcttatggcagggttaattggaactttctatatgaggttacgaggaagaagaacttcagcagtgagttcattggttgggtgaagaaaatctcgggggggggggggtaatgtcagcattaatatgaatggggatcaaggcccttttttcaagactttcaggggcttgaggcaaggggacctcctttcccctttgctgtttaatttggtgggggatgctttggcagctatcctgaaaaaggcaaaaacaagtagggttttagaaggtttgattcctgagctaattcctagaggtctgactcacttacagtatgcagatgataccatcttatttactactccctccatctacttttgatagtcatatttccaaatatgaaaattttatttttgataagcatatttcaatccaacaacctatcatcataatgactttctcggatttaatgcatgactctccattcttccacactagattggctacatggccattgaaaatgtaaatattaatgaatcgcatgtttacgagaaatgactagtaacatgtttaaatggatgataagtagaattacttatccttggtctgtgtactaagatgaaatatgactatcaaaagtagatggagggagtattaaggaaggagtttcaaatgtcagggtgttgaagttcttgttgttctgctttgagggtgttgaagttcttgttgttctgctttgaagagatgttaggaatgaagataaattatcagaaaagtgagatctatgtgatgggtgtagagaaagatgaggagttaagaattaccaacatgtttaactgcaaagtgggaaacatgcctttcacttatttgggtttgcctatgcatacagagaaaatagggatgagggagttcagacaaataactcaaaatgtggaaaagagattgcagtcttggaagagtggttaactcatctatggtgggagagaaattaaaatcaattcatgtctgtcaagtgccccaatgtatgttatagggttatatcaattacctagggagtttcataagaaaatagattctttgagggggagattctattgacaaggccttgggggaaaaaagaagtatcatatgatgaaatgggaaggtttgatcagaccaaaggattatggtggcttggggtttatggatactaaaacaatgaacttgttgtggggacacccgataaagtcatggtgccccacgaatacgtaactgcacaggatgttcagttacgcatgaaatgatataaaagcataaacttcgattatacaatacttagttcacaacacaacataaatacaaaccattacatatatggcctataaagccttatttctacaaacagataaattgctagactccaccccaggaactgcctgagcgtaggatgacctagaaaccatagctatcccactctaacagatcagcaggttctccacaagcatcttcctcatgatctgaacccatttatgagtacaaaaggtactcagcaagacatgcttatgataataaatac

SEQ ID NO: 40858 - DNA, 737 bp, Oryza sativa
  unsure (1)..(737): unsure at all n locations
gttttttaatagaaaacgccgttgactttttttcatatggttaaccatttgttttattcaaaaattttatgtaaatgtataagatataaattgcacttaggtacatgcatgatcaacatggtataacatgtttgaccatgtttgacatatttaatctttagtcctggttcaaatgcnantagggcctgtggccccccccccccccccccccgtgatctttagtcctggttggtaacaccaaccgggactaaagtcccacccctatatatatatgtcttctttctcctccagctgcccaagcaagcttcaaaatttcttcaaaaaagaggggaggtcatgccaaaatttctagtgaatttattttggtgattacatacaaatcggaggtgcctaaaaggtttgcaactttatcctccaatgttttttttgtcatattacatttggagctatgttttgcacacttttttgtctccaaaatttagttgtgatgagagagaaaatttgtgtggagaagaaagaatatatataaatttagttgatttgctaaagaaggttttataaaatatttgagaaggaaaatatagtgaaagttaatcttcaataacagaaaacaaactaaaatgaaaattaaaagaagtaaaacacattaatattagtttaaaactttagaaatagtaaataagaattatttggtgtaatattttatgatttttgtatgaataaagatatgttattat

SEQ ID NO: 40859 - DNA, 2226 bp, Oryza sativa
tcctgcagcccagatcatgccggagaagtccagcgactggcaccgctcctccatcagtatctccttcctacacacaccgtcctccacgcggaagctcagctcttgccgcctccgccgcctaggaaagtcacgatggcgcacgacgagaaggacactgcgatccccacccgtggccgcaggtgcagccgtcgcgccgcccgggccgcggcccaggaacccggcagctgcacccctcctatcctccgcctgccctcctgcgtgcggcgcgccggctctaggctccaagcagtcaccgtctgccaatggggtgatggattgggaggggaatcaatggaggattggatagaagaagataagggcaaaaatgtcattttttatggtttctctcttattaattgggcgaatattatattttaatgcatccagtgttcagcagcaaattaccgcaattttgaaatgttctcgaacatattcatatctttgtgatgttcttcagctaattacgcattttctgagtgccctggaacaaattttaccataatcttaacttaattaaaggattcatatttttttcaatcgtcacctcgctttccgatgattttcgtcggtcgtcgtccgcgtccgatttgtgaacctggaaaatgaatcgataagattaattgaaatcgatctggtgcggtaattgtcatcctgtagcaaagtaatcggtaccattggctgggcctaacaagaatgggcttgcagcctgctgatgggatttctgcatgagagtctacatactcaactgatggcaatgcaaacgtgacagctcatgtcaaaatatatttatcaaaggttgataagcagttgtcaaaggtagaacacgggagtttttttcaaacgcgcaagagccttgcacgtagaagataaaattttgtataactgttaaacgtggataccaagtatttttttttcactagacgagtcattaacacatgaactatttgattttttaaaaagaaatttctatatagaaaacttttgtccgaaacgtaccgtttagcactttgtaaaacgtgctctagaactcagccttagcctagaagcattgagcactactcagtcgtaacaagaaccgctagcatgttgtctccaatttacaatccacaatcacttccctctaatactacctttgttctaaaaaataaaaagaagttctgcccaaagtaaatctaggggttataataagaaacatccataccaatcctggaaaaatctgaaacacatatataaaaaagatcccgttgcaacgcatgggcattttttttgctagtaaaataaaaagcagagtgaatggtagacacatgatatatatatagtaccactggtggagaaaccgtttgtaatcccgattggtaaccccctttagtcccggttgtccaaccgggactatgaatctgggactaaagatagctatatttagtcccgggtaaaataaccgggactaaagatcggtcagccacgtggccggccgagccatctttagtcccggtttgtgttacaaaccgggactaaagattggtgcactatttttttttatttgcatggccctgtttgctgcatggttgattatatatatatatatatatatatatatatatatatatatatatatatatatatatataggacactcatatggggcaccatggtgcccgggcaccatggtatcaaatacacaaaatatatatatatatatatatatatacacacatatatatatgcatatatatatatatacatatatacacatacatatatatatatatacacacacacacacacacatatatatatatatatgtatatatatatatgtatatatatatatatatgtgtgtgtgcacacacacacacatatgtcacaatatatatatgcataatatataagcatatataacacatacatatatatatatatacacacacacacacacatatatatatatatgtatatatatatatgtatatatatatatatatatatatatgtatatatatatatatgtgtgtgtgcacacacacacacatatgtcacaatatatatatgcataatatataagcatatatatatatatatatatgtatatatgcatatgtgtatatgtataaatcatatattgcacacatatgtataatttaaagcacttaacattttatgtgcatatatgttaccaaaatatatat

SEQ ID NO: 40860 - DNA, 1663 bp, Oryza sativa
aattcctgcagcccatacgtacatcgagctctcgtgttgtgcatatttggtttgataggcagtgggcatactcacatacgtagtagctgcataagttagttccctggttctgctttgcacactacataagaaacgatgagatatttaatatactatttatattaactgtaattagagattcaattcaatataattttggatcatgcatgtactcactggaaaatgaaacctccatccaagtttttctttccaagtcccgcggaccaattgacggaaccgatcccaagccatacatatgcagttgcaagctatgattaattaattattacccgagatcaacataatagcaatagattccccgcgactttggaatagatggcattatattacctgtctatcagttggaagaccttttcaaaaatcttctcctctttattcattgagtcgtacacagtgactctgcatgcgtccaagtcgaagaataacaggacccagtggaatctgaaatatgcgtgagatgatatatatatatatgaaaatgtacatgctatatgtatgggaacaaaatttgttcgaactacaataaaaactcactctgtgttgtacggcagtagtatgtacgtcttgaaatgctgctacgttaggagatggacgagattgtcctctgtgtctttctcgtacttgtcgatcatttcggtgttgattttccgagggtcgatgaacctagtatcgtagaccctccgccgtcgggccctttgaatctctattctacaatgatgaatggaaattattattgcttacatatatgccaggagctaattattgaacgaaacaaattgaactcaaagatactcacaaaatccatgcgctcagaagagagacgtcgagggcatccagatggtacagatcgaagagatccttgaaatggatccagagaacatcttctccttgcaagaagtcggggtttctgatcctcgctctgaacatctctctacccttggcgctcatttccatgtaccgttcatggaatttgtacatctgtgtcagtagggactgcagctgctcaggcgtgacaagcagtttccgaggtttaacttcgtatgccctttccgccttcgggattgatgcgcctcgaatcagctgatccacagttagaccggtgtctgaaatgaattccgttataccaaaatcttggctggtcaccaacggctcgacctcgtggtttggttgttctccaagctgaaggactggtttggacttcttgtgataggctctctgaagtgttcggtcatagtccgatatctgtaaggcctccttgtttgttgcggacattcccttgaagaagttcttcatgctcgggtcaataggtatcttctttttatgactccgaggcttgagttgcctcttcacttctcctgtcacataagcatcaagctcctcttgactgcaatcgtacggtggctccttgtttttggtggcgtcaactttcgccttcttcgttgtccttgtgcgggcaggcggtggagcttggcgagaccttgtcttgggaggtgcaggcggacatggtggaggtggaggagccagaggagccggaggagatggtgcaggaggaggtggcagaggagccagaggagatggtgcaggaggacgtggcggaggaacc

SEQ ID NO: 40861 - DNA, 2449 bp, Oryza sativa
gcgtctcaccgtctcctcctgggtagtccaactcgaggtcctcgtacgcggcttccaccagctcaacttcgaccctcgagtatcctgctggaatcggtctgcagtggtaagtcccgaaagggtccattgggatggccaatcccgacgccaccttcacgtgatgagaggttatttattagtaatcaacctaagcagcaacttgcggaatgtacaagtcaaaaaatcatcaaactacgagcataccttgattgataagttcttcaagggaatatgcagctcacatggtgtccgctgcatgatctcatcaacagggcaggtggtttcgtcctgggtttgcatggcgtccatgctctgtgattctacctgccccgttaaggcgcagctgctacgattgcctgatgggctgaccattgcaggaggaatgtacggctggggatcctgggaccgatgtgcggccatacgttcatccaccttccttgccacctcctcttgcatgctgagctcgtagctcgataccctgtactcaagatctgcaatcttcgccctggatgctcgggagtctgtagggcgagtgacagcttgtccttctctctgtcgggtcggaatgtgccctgagaagaggcttccactgcgtctgttagtcgactggcagcctcgtatatctgatcgttgaagacaagggagccatcaactgggttaagcgttccaccgtgagcatagtaccagaacttcaatcgatccggccatttagcggtggccggttcgatacccctctcaatcaaacttgcctctatctcctcccacttcggcattgcgacgctatatccgcctgaccccaagtggtgatggtacttcttcttggcggcattttctttgtttctgtccatcatcacttgcccttgttgcccagtcttgtaagcaatgaactcgtcccaatgatcccttagctttgggaatacatcaaaatttggtgttagtcccttcaggatgtatttcttatagagatctcccttgaagctctggaattgttctgccattttcctcagagtccactatttcactatgttctccgtacccacgggtagcgtgaacgtctcgagcattgtggtccacagcgtctctttctctgagtccgggacaaagctgtcattatccccgcgtgcccttgttctgcgccagtacaccgtgctgacaggcacgttgtccctcacaacccaaccgctgtggcgtacaaaattcttggctgcttttgctggggcactaggtcggccgtcttcgtccacctcagttatgatgtgacgaccctctatcttcttcgtggcacctcgttgtccgcgtgccctcttctgttcagtggagggatgacttccactagcctcctcctcatcgttcccctcctcgttcccctccgcatccctctccacgttcccctcctcgttcaagtactggtttggatcctcgttcccctcttcttcgttccagtactggcagcttccctctgcgattgtatcgtacagtatctgtttctcatcgcgatcagccatctgtgcatacaaaaaatatttgttaggtctataggtcatatttgctaaccgtaatattaaaactctactaatcttatattaaatctctactaatctcatattaaaattgtaataatcatatatatatatatatatatatatatatatatatatatatatatatatatatatatatatatatgctaagtataacagtcttatattaaatcgctactaatcttatattaaatctctactaatctcatattaaatcactactattcttatattaaaattgtaataatcatatatatatatgctaagtctaacaatcttatattgaatatctaacaatcttatattaaatcgctactaatcttatattaaaattgtaataatcatatatgctaagtctaacaatcttatattaaatctctaacaatcacttctttacgtcacttgtgtgctcgaattccttcgatggctaagtaccacttccgcttgagggacgacaacgacgtcttctctgcaacattaccaagaaaatgtattattctaaacgggccaagttacatatatataatcatatatgtattaccaggaaaatgtattagtctaaacgcgtccgttctcacacttttagtacaagtgcattcacgttcgtaagcgcttcgttcacattcgttcacgctcgttcgcgtttgttaacatttcgttcaagttcgttcgtgttcgttaagcgttcgttcacggtcatccatgtatcgttcacgttcgttcgcgttcattcatgtttgttcgcgttcgttcacgttcggtcacgtttcaatcatgttcgttcatgttcggcaatgttgggcgcgcgcggaaatggcgcggcagcggcgtgacggcacggtggcagcggcgtcggggtgccgtgggcc

SEQ ID NO: 40862 - DNA, 9494 bp, Oryza sativa
ccggcagcgtggcgagctagaggcgggggcgcggcagtggcagtggtgacggcgtcgtcggcggtggcggccacgtcgaagtcagtcgtcggcggtgacggttcaccctggtgtggtagtggcgtcggcaacgaactaggcggcggtggtttggagagagagagagatcgagatcgagagagagagaggcagcagcggcgtttgcggcggaggcggcgaggaccgccaagcaacggcgagagacgacggcggcgtcggctcggggttgccctaggcagtggtggcgaaggagaagccgatatcgatctcaatggaaaaacgtctaagtgttggtggagaagacgagggcgcaccgggaatatatatacccccagatctttactcccggttctaagaacaaccgggactaaagatctctttagtcccggttgttcttacgaaccgggagtaaagatatctttactcccagatgttctcaccaaccgggactaaagatcttttcccgctatttccaaattctttttaaacccggttagggttaagaaccaggactaaagataatagcactgaattttgaatttcattacatatgtgtttctaaaatagtaaataatgcattacaattatttaaagtcgaaaaattaatgacaaaaccttcgaaaaattattgttgtatgcacatgaatgatttaaaattgttaaaaattctcataatcatatataattagcatatgcatgatattaaattgttaaaaattctaattaacatatgtaaataccacatgcatgatttaacattaataaaaattctaataatcatatataattagcatatgcatgatattaaattgttaaaaattctaattaacatatgtaaataccacgtgcatgatttaaaacttttaaaaattctaataatcatatataactagcatatggatgatttcaatttgataaaaattctaataatcaaacataattaacatatgccatacaacaattgatttgtatggatattcaatacatccaaaatagtttacatcgtgtacacaacaattacggcaatacatcggcggtgacggttgaccgcacgtactttctcctcactattgttccctccttgtgatcgctacgtgagtaaggggtgtcttcatttgataggaggatgctagggtcaatcgtcaccgtgaaagggggttgcccatcaaactgatcgtaatcctcatcagtcttgtcctctactccgacgatttttctttttcctgggagaaccacgtggcgcttcggctcgttaggccctttgcccttttttgctttgctagacatgtccttgacataaaaaacttgcgttacatcattggcaaggacaaaaggttcgtccgaatatccaaccttattaaggtcaaccgttgtcatcccactgtcatcaatcgttacgcctccaccagtcaacctaactcattggcactggaacagagggaccttgagaggtacatagtcatgttcccatatgtcctctatggcaccgtaatacgtgccagttgtaccatcgtgtcccatggcatcgatacgaacagcactattctggttcgtgctcttcatgtcttgggccctcatgtagaatgtgtatccaatgatttcatatccctggaatgtcgtgatcgagccagatggtcccctcaccaggaaggccagttgttggttaatcgtctcgttacccatgagatgttgtcgcagccacgcggagaaagtatcaatgtgatgccgtgtaatccatgcatcggacttaccgatgtttctggcgcgaactagagccaagtgctcctcgatgtaaggagccaccaatagagatttttgcagaaccgtgaaatgggctttacggaataataaattgttgtataccgtcattattgctttccttccgagagtcccctttccccgtagtctcccttcatggcgtgattctggtaccccgattgggcgaaggtcttcgataaattcaacgcagaattcaatgacctcctctattccataccccttggtgatgcttgcctctggatgagcacggttactaacatacttcttcagaacgcccatgtacctctcgaaaggaaacatgttgtgtaggtacacaggaccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccctttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccggttgaaggtcgccgcgttgttccatatgcttcagatcattacgtgcttccagtgtatctttcgactttccatatacacctaggaagccaagaaggtttacgcaaaggttcttagtgaggtgcatcacgtcgattgcatggcggacgtccaagaattcccaatagagtaactcccaaaatatagagttctttttccacatcgccgtgtgaccaccttcgctctctatgggctggctgccaggcccctttccaaacactactttaagatctttaaccatagcaaacactgttttcccgctgcgatgtttaggctacgtacggtggtccgccttatgttcaaagtgcttgcctttcttccgtaccgggtggtttgctgcaaggaatcgacgatgaccccatgtacacaaccttcctacaatgcttaagatacgtactttctgtttcatccatacagtgagtgcaagccttgtaccccttgttggactgcccggataggttgctaagtgcaggccaatcgttgatggttatgaactacagcgctcgtaggttaaactcctcctgtttgtcctcgtcccacacggggacaccttccttcttccacaacagtttaagatcttcgaccagtggtcttaggtacacatcgatgtcgttaccagtttgcttgggggcatgaataataatcagcattattatgtatttcctcttcatgcatagccaaggggggaggttgtagatacacatagtaacgggccaagtgctatggccgctgctcatctctccaaaaggattcatgccatccgtacttaaaccaaaccatatgtttcgtgcgtccttttcaaagtctttaaattttctgtcgatgtttcgccactgcgaaccatcggcggagtgtctcagcatcccgtcctgttgacgctcttcaacgtgccatcgcatcattctagcattccccttgttcctgaacaaacgccttagccgtggtattatagggaaataccacatcaccttagcaggaattctcttctttgttagctgcccgtcaacttctcctggatcatctcgtctaatcttgtatcatagcgctttgcaaatagggcatgcttctaggttctcgtactcctcaccacgatataggatacaatcattcggacatgcgtgaatcttctgaacttctagtcctagagggcagactatcttcttagcctcgtacgttgtctcgagcaatttgattccctccagaagaatgttcttgacgagtttcaagaaatcgccaaatgccttgtcactaaccccattttttgccttccattgcaataactccagagtggtatccaactttttgtgcccctgctcacaacctaggtacaacgaagttctgtggtcctctaacatcttgtccaatttatgggcccccttttcactttcgcagtcctccttggcgtcctacaacatctgaccaagatcatccgcaacgtcgttaccatcagcatccctttcctcctcgcccattcgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaataatgcacgccgtcaataaactctttggaccgccggtcagcgtacatccattgccgatccatctaaataaaatgaaaaaaaatcatacacaaataattattcgtataataatgacagtcatacaataattataaaataattacaaactctttcaacagtcatacaataatgacaaatcattattcatacaaaaattatgaaatattacaccaaataattcttatttactatttctaaagttttaaactaatattaatgtgttgtactgcttttaattttcattttagtttgttttctattgtttaagattaaccttcactatattttccttctcaactattttataaaaccttctttagcaaataaactaaatttctatatattctttcttccccacacaaattttctctctcatcaacttacaacaaaattttggagacaaaaaggtgtgcaaaacatagctccaaatgtaatatgacaaaaaaaacattggaggatgaagttgctaactttttaggcacctccgatttgtatataatcaccaaaataaattcactagaaattttggcatgacctcccctcttttctgaagaaattttgaagcttgctcgggctggaggaggaagaagacatatatatataggggtgggactttagtcccggttggtgttatgaaccggggctaaagatcgccgggatctttagtcccggttggtactaaagttatgatatttagtcacagatcccggggggcctgacaagccctgacagcatttgaaccaggactaaagatgatctgttaccaaccgggactaaaagatcaaatatgcccgttacctttttttaaccgggactaaagatcatctttagtcccggtttttgttgcaaccgggactattgtggagttcggccgaccgatgaaagatggtttctccaccagtatgttacgggcaacatatcacagtagtaataataataataataataataataataataataataataataataataataataatatatgagagacattattattttcatatgtataatagttagttgtatatgagatatacgtacgtacgtacataaaaaaacgtaatggctgggtggggtcaggtttcggtattaattttttctttaagataaatataatgagtactctaaatctaatggttgtaataaataaagggttcaccaaatttaatgaaaatcaacagttatttcttagagtgctacatcgcgacttacaatcgattgtagaaagtttcattgagttttagtatataaaaaaactaggaaggtagcctagcttgcgcattcgctcgggcatgcatcgttgtttatctttgagatacttataagagttataagagtgaagtattaactgcataatacttgacacgcttaaaaatacaatttctccataatttttcatcagcattgcttacataattttttaatcctattagttagctttacaccgcacaatattttattcaatttaattcatccatataagaaattataattttgaccatctaaaagaaggtagacttggttgtttacacaacatatatataaaaaattaagtgtaaattatatgtaaggtgttttttaaaaaaaaacaaatgctctctgcattcgtgtcacatcctgatttttgtttcaggatttataaattatttaataaattaataatagaatttatattaaatgatctttaattttcaagtgaagctaaatgtgggaaataaaatttcctaaatataaagcatggatggatttaatttttattaaattctccatgattaagtatactctctgaaatattctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgatcttaaaagcctaaaagagaagatctaattttaatttgttaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccctctctctctccccggcccagtcggcccagttcgccacgccccttcctcctctctctcggccgctgacaggtgggtcccgcctgtcagacttgtcttcctcctcgcgccgccgctgccggccaaaaccctagccgagccgtgcaccgccgctttccaattcgctcgcccctttcccgatccggtgaaatcaatagaggggaaatgatcttctcgatctcctcttccttttctcttttggaatcatcgcctaattcggtttggaaatccgtggattcgagtttgattcggattcgtttttctctctcgaaccctagctttccttctcgccgtcggtcgccgtgggcctccgtcgccgctcgctagcccctttaaaaggatccccggtgcctcctctacccgccgccaccctcgccttcgtctctcgccgtcggaagcgccctagcgccgtgtgaccacgtgccgcagtcgtcgccgctgctccagtcgtgcgccgccgtcgttctggtcgtcgtcgtcgctcggggaggtcgccatcgtggtcgccaagtcgccgccgtcctcgtccgcctcttcgtcgccgccggagaccaccggagcaccgccgtcaccgtcgacccgaaaaccgccgccgtttcttcctcgtcgccggcgccgtccgttgctcttccgccgccgttttggtcaccggtgagttcgccgcgtcgccctctacccgttggtgtcctccgtttgcgtcgtcgcgccgtcgttcgccggcgagcatgcgttgccgagccgccgccggtgctgacgtcatcgctgacgtcatcgggaccgtctgctgtggcccggtcgtggactgtttgatctcggccgttcgttttggataagatcgatctcggccgtccgttcccgtgaaccactgccgtgcacccggtccaccgcaaaccctagccgctgacgcaataaaccccttttccttttcaaaaataattcattattgcgtcataattcaattaaaatctatataagtgttttaatccgatttaatctttaaaaattcataactaattcattgtaactcagtttaatgtggttcaagttgcaaaaattatataaaataaagatctacatattaaaattaaccataaattgaattaagtttatttaattctttttaaatgggctttaaatagatttaatcttgtaaaattcataataaattcatatgaagtcagaatgaggccgttcaagtctcataattcatttaaaattatgatctacatgtttgtttactttttatgtattgtttatttggtttttattagtctttttctttgttttgcgtgttagcttgtcgtttccgtcgttgcgaaggttcgtgagtacgccggaagtattcaagaagattaattgaagaccgattattgcaaggcaagtcacacagatcctaaacacaatactttgagcatgttgatcctatatttaaattctctatttatttcaactgtgcatttagtttcgaatgtcactgggtggtgtgaatctattcctttgttatggcctgcttgcattgattactttattctttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgtcaaccacaagccagcgtgggcaacggctttaccttttgtatagcatggttcattgcggagcaccagactgagaagtggtggagataagcccacgggggtcgctggggagtccatgccttgtttataagggggtgactatgatccgggaacggtgcactgtggtgggttgtgttatgcaaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactagtaataatttgtttagctcctggtttggagttagatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtacccttgtgcacttgcatatttgctgtgtggcttgttgagtatgtcatatgctcattcttgcaataatcaatcaacctcagttgaagaaaaaggatctaaaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaattagttcggaaattattagtgaatttccgggcgtgacaattcgcgagtgcatgaaaggaaaaaaatattggttagttttttgcgggcgcatttctaaactgataaatggtgttttttttttcaaaaatgttatatagaaaagttgctttaataaatcatattaatccattttctagt

SEQ ID NO: 40863 - DNA, 3175 bp, Oryza sativa
cagtgcaaaaaggaacaaaggtaaaataaaaggaaagtaaaaatcccaagtcctgcgtacaaatctatagttcaagacatacacatcgccttccaaccgaggtcgagttgccccggtgccatgtcttattcgtggaattctatgtccaagtgcatactttgcgggggtaaaattttctacacgtatgttgccaaaatttctgctaagtttttcgtggccaactcgagaaaattcttacacagccagtctataaatactcacacatttcacaaaaaaatacttgcaacatcaaagctacacaggtagaatcatcgaccgtaagtaagtactactcctacgtacattaagtgtgagcttgattaactatggaggtatccaagctggccattgctttggccatggtagccgccatggcactcccctcccaagctcaaaactccccgcaggactacgtgaggctccacaacgccgcccgcgccgccgtcggcgtgggtccggtgacctgggacacgagcgtgcaggcgttcgcggagaactacgccagccagagaagcggcgactgcagcctgatccactccagcaaccggaacaaccttggcgagaacctcttctggggttcggccggcggggactggacggcggcgagcgcggtgcagtcgtgggtgggcgagaagagcgactacgactacgcctccaacagctgcgcgcaggggaaggtgtgcgggcactacacgcaggtggtgtggcgcgcgtcgaccagcatcggctgcgcccgcgtcgtctgcagcaacggccgcggcgtcttcatcacatgcaactataagccggccggcaacttcgtcggacagaggccttactaagttatttatacacacgggcgtacgtactggctagtactacgtatagtagtgaataaataaagacgtgaaaatgtaaacaggtcagtgtctgatccacgccttcacggtccataccgaggattctataaagcgtcatgtcgtacaagtaaaaataaatagtactccctctgtttctttctgtttcaggttataacacctattaactttggttaaagttaaattgctttaaatttaactaagtttgtagaaaaaaaataatagcatttttaacctaagaaaaatttattatggtaatatattcaattattaatttaatgaaactaatttgatactataaatattactatatttgtctacaaacttaatcaaacttaaagtagtttgattttgacgaaagtaaacacgctttataaccttaaacggagggagttgtaaaaccgtctaaaagcatgtgccagctgctagctgatggtccattccatcgtcgcacttctctaatttgccttgtcagttgtcactgggtaagttttcttttgaattctttagggtacgctcaaagacaacccaaatatataattgttaaaaattctaaaaaaaaataccgacactcatacagtataaataaactatttaacaaaaatcaagtcaaaacttaactcacacatcgagaaataaaaatctctagtacaggatagctcatcttaatcggacggcaagcctcatctgtgtcagggagaagtcctgtcacgaaccaaaggtatcgtatttgttttgatcgcaagcgcatgcatactgttgtgagtattccaaatgtatcgtatttgtttttccgaaaggaaaacggcggtgtaaagagaaagttcatatatttgtaatcatgcatactataattgatataccatagtctaaacaggattaattgataacaatgataattgggtagtgtgatacaggagattcatctctaataaatatagactaggtagggtagtgcagaaggactaaagagagctaaggttcatatgcacttttatatgaacatatttagtatacacttgatatatacatgcttacaaggctagtaattaattctacgcatccaggtgctactgaaagatcactacctgctgatctgttagcgtggttattgcattttacgaactcttatgtcatacctagacaaaaaggaataaaaaaaaggacagggttgtcaccaccagctatctacctcacttttcgtagggcatacccgcatccaataccatttatttaacctaagcaccatattttatgttaataaacaatgtcactaattcacccgggacacataccatttggatggacaagttagaactagtgcaacccattaaaatcattggacaattaacgtagtatagatcgactagccaaatcaagcgaagcatataactgaaatgtaaagtattcataaaacacgtaagtaaaatagtatatgaactatgtacacaattaaataaataagataattcctttattacatctctagtcttacaagaagagtaacgtactaaagacatatcagaataaactataggacggaaggctgtgttcttttcccctctttcccaactcacttccctcattttccacacgcacgctttttaaactgctaaacagtgtattttttgcaaaagttttctatataaaagttgctttagaaaatcatattaatccatttttcaagttttttaggttaatacttaattaatctcactataatcgtgtgctttgttttccgtgtcgggaggcaaggttgggaacttgccctcccgaacatagcctaagcctagctccactactactagagagaatacagtatatggaatgaaagaattgctcctttaggtgtgtattgtgaagtgagagagctcctccttttatggttgggaaggtcggtaactcccataaccgtcattgagaagccaccaaggagcaccacgtggagggtggagatgagagggagtgatggaggatcggccgaaccctgggcccacccctctcaaccgcctttcacaagggactgacatgtgggctcctatgaagattaaggatggtttggccccacattaggttagttttaagctgcctagtgggcccatcgatctgtgtacacgcacgtgattcgctggcggagtgtttccttgcatgccgactcatttctccttcacttcagtgtttaatacctacatccatagtaattctccaagaaaagtggaactacattatttataactaatatacacatagaaaatattagttctctctttatttattga

SEQ ID NO: 40864 - DNA, 12695 bp, Oryza sativa
cggttggtaacatgtttagtcccgggtatttgaaccgggactaaagatagcgatctttagtcccggattcgtagtctcggttggaaaaccggaactacaggggttctaaaccgggagtaaagagcatttctctaccagtgaatagtacttgcgtaaaaatattttaaaagcaacataaaagtttatttcgaaaagaaaatctaataatgtcattctaacatatcaacgaaattacatatttttccatatcttagccagttaagattttggtgttttgtttcacggattgtaagatatcatttcgttgagaacgtatgaaggtaataattgcatgaggttgttattcaatttattggattactttatttagtgacattgtagaactaattagctatgcatctttgtcaatctatttacaatactccatgatttatttaggtgacatgcaaagggttacgatatgcatgctaaaataatattatttttacaagtcgaaacatagtcaatatcagtctgtcttgaattgtttatttaatcttaaataatacaatgatgcgaacagattaagaaattgaatatatgtcgtaggcactccggaccttccattatatttgagagatgaagtgaataattcaagtcatcaaacaagcataatgaaacatccgacgcctcgagagagaaatattggagacattgctgagcccttagattgccagtcaacttcagcctgatatgtgcccgtcaaaccactcgaaggcggcgaccagatgtgttacacattcaggagacttgacaaaaatggctaaagatctacaacctctcaaatattcctaactcatactcatgtaaatctagttcctaggatgtgcactagattcacactttcatcttaagcatgattatacatagcaaacacaactaagatgaaagaaacttaagacttacaacaacttaataattacataggccgaccggccaaatagacttattagagaacagcggaagcttgactaccctatcacaagcacaccaactaggagtttaccccattaagttctcatcctagaagaagcaatcggaacccgcatcactcaaagactaagtctaaacctgcaaacaaaaggttttatcaacagcaagagtcactacattaaacaagttaatgtactggcaagcacaagtcaatcctaccatactacatgtaaggcatatattcaaaggaaggcaatatgtagttcaatttcagcataaagcaagttttgtttcgcaattcttttgtaaaggagttgatgcttcaattaacaaagacaagttttaagtttcattattaacttcttcataattccatcataatcaatctcttattgccatacttaacaataagtcataatgtatcaccacacacacaactcaacacatttatcaatttcaaaccaatatcacatgatcacatttttaaaacatagtctatactcatgacacatcaccaaagcactcatgaccgtgagcacggctaattgattagtttaaagaactctgcagagtttgtacagctttacccacatgatatgaactctctagtttgttttgagtttgcaagactccaccacactcttcatgttgaatgtgatctagaggccataacgaagcctttacactacttagagcctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacacgcttagtcacctaaactaccacgtcagggtaaataggaagctcctctgaattatacgaactcatacacaccggcctactagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcacaaatacccatcatattaattttattccaacaaggtttcatgtatcaaaatcatattttaattatagatggaatgagcatttacatagttctaagcatggctaagcaagtagttgcacatagagcatatataaaaccatttgagcacaaagagtgtactctaaccatttctaggggttcaaacagcaagaggatcaattattcaaggtaggatatgcagcaaatatgtcataactaccttaaccaaattttaaataccgatataggctaagttcacatgcaactttgcaaacaaacattttcattcctcaaatcatgggattcaatgtgttcaaaggatgggaggataaaacttgccttgatcagataaatgttagcacctaatccactccttcaccgattatgcaattatctagataaaggacacgatatgcaattaaacaccgaaagagctgaaaatccaaaatgctctaaaatgcatgatttatgcacagtggcttggtactgatctaaaatgaatttaggtgaaagaatttttattttatcttattccattagggagttatgaatttttagaagttttatcggtttatagtaatatagtcttaggtagtgttatgaaatacttttgtaaagtgatttttattagattagacttcacaggggtgtagagatgtgttttctaagactaacacatttggtttcaccatttttggagttataatgattttcttatagattttacaagttacaacgtgtttttggtatatagtgttttatatgttcatgacttttgagttataggttcaaaatatgctaattcctgtttaagttgaacaaaaggaataatttggttaactaaaacatttttatttcacatgtttatggtctttactactatggttcatattttataaactagagatgctctaatctaaactagcaatatattatattaacctagaaattgtcatatgagctaagttcttctaagttttagtggatgaggatggaactatggcttcactggtcaatcagtttttatttaggtttaattagacctaaagtgtatatatacttatacatgtttatgtattacttaaacaacactatgtgtttaaattcttatttcactaagttaaggttttgatctatgttctctacaaaaggtgccaaattttattttactatgttgaagataactatttgctggttctatggaaactttgttcatttcatttggactaaaaatgaattttctacaagttttacaaattaaaggttgctctatgttagtaaatccttatatgaatatttagagacttttactacacagtaagtatataatcttatttcataacatggaaatatgtgttttggtgatcctacagaacttaagtttattcaaattgaagctaaattgggttctacatgaatttctaaagtttagcttatctaaaactaatcattttagatataatagttttagaggcatttgatgcaaagtaagtaattacttttatttcacctaatcagagagtgcatgatgatgaatctgcagtttttgagtttgtttcaaaatgagttgagatgaattttctatgtattttataagtttgtacatgttttatgtatgacctatcttagataaattttagagacattatttgtacagtgagtgtcaagttttatattcctggaataaagttcataacttcaataatctacagcaactggaatcacttcaaaatgagctatatttgattttatatagattttacaactttgtgcatttttctgctaaacatatatttgtttgggcattttcttaattattcttcagattttaaaggatggggtccacatggctgtgagggaccaatatgcacaaagactcttgaggtttctaggaatcaacccgcagtcctaggcccatatgtcagtgtgtttctacaattgtaaacggatccctgcacttaatctgctttagatagagcagagctagccatggctgagctcgatctcgagctcgccagcggcaaacggtggctcgtttgaggttgaggtcaagagataaaatgaagagcaagctcttgtgattccattcctctagttttcttggttagaggacatcggagtagcgccgatggcgagtgtgagcggcggtggttcttggggtgaaagtgcatgtgtgcatggaagtcgattccgaacgaaaaggatgcatgcatgtggtcttctagccttcaggatgctcaccgtgggtcgagctagggttgtcgaggtcttggtggcagcggtgacttgtggaacggctcggcgacggtgctcctcctcgggtgaacgacgacggctcgaacgggacaatgagctgcttcaagcaagcatgcacgagggttgtgaggtcaaggagatggtatatgcgcaaggaatcgaacaatggctcaccgaggcagcggtaatcgatgatgacggcggaggcgattctagatcggcgccggtaaagaaaagatgcgttctccgagtccttcacatctccggctagggttcttgaggcgtattgaagaggaggttgaggcgatgacgatggcgcagcggcttcctccgaggtggtcgagaatggccggacgacgacgatggttgaagcggcggcgctccggtgcgtgctccggggcgttgtcggtgtggcttgtgttcccggcgatgcactgcacgagaggggtttaggtcaaaagaggaaatgcttggcattgtgtggagagatgggaacgcaaaagagatggaggtgaccttgactcaacggagatggcgaaggtcgtcgtcactacaaccggcggcgaggttgaggatgacagagaggctgaggacctctccctcggcttcttcagctccagagtgatgtgtggagttgggcgactcggtctggaggagatggaggcatgactcagtgacttgaaggcgtcgacatgtcgtcaccacgtgtcgacgtgtccaagactcggttggctctcgatctctccctctttgtgtttcttagtcggctgaggatgagggacagaggaagggcgagctggagatgctgccaggtggggccaagtcgatggaagctaggctaggaagagaggtatgggtaggagtttggatagacttagtttttggataattttcggaattatttctttcccctaagtttgcaactcaatatcttaatatgtggaccagaagaattagtgtagattttactggtggtagatctttatatctagattccattttctttggttgcacataaaaataatgggtagacttctcacagaaattaaacaaacatcggctattagaaagctagattgaatttttaggaggcttaaacagaggaggaaaattctagaaaaattatatttaggcatgataaattatctagtatttgaataaattattttgcatgttcacttatgagcagttaaatgtacttttggatgaagtatggctttagccgattaaaatttaatttgattccttttagttttctgctttgactgattaatttgtggtattaaacttagttattaacttgtaccaatattatagtgaattgcttgtgctaaacattgtctatttaattttttttccatggtttttaacttgcacataatattttagagaattaggattactttactttgtatatgtgttcctacttcataattgcacctaatattgttacagggattacattaaacttcttttgggctgagaagatgatatttgagtttaatattaagtccacatgttatcacccaagattaactataggtttgtttagtaattttaacccttttagtttatgctcacgagaccaattatgaaaagcgagaccataatccaaatgcacaagggactcgagcctaggcatgcattatgcacatgtatgctcaaatgcttgatgacatttctagtctaatgttgggaatgaaaaggttttattttgttctcaaattttaatcatgcaatggtttaagttggtcatcacctaaattaaaacggaaatttttggctctcaaaaattggagaagttaacctctaactattttgacaagaaattttaagtcctagaatttcgggtacgttacaatatgatttgattgtcatgattatttgaaatacttatcagaaattatggtatggtattcccaaataaagtactgtagagataaaagggagacgtgggggtgcctacatgccttggataagaggatggttcacgtgggggtggatgaatacagggaaataaaggggagtgagaggaaatcgagtggtctaagataatgtgtccattcgtttaagtgaaaaccgacgatctgagagttttgttgtttttatgactttctcaactttttaaaaagtataatagaagtcctaggagggctcggatgtttaatagaccttttggtgatagatataaatatgtagatagagacatatatatagaagttgatatagatagacatatagatatggatatagacatagtaatagatatagatataaatttagatacaaacatagatatagatatagatataaatatagatatagatatagagatagatatacatgctggttgattgattgattgatggacaaataggtagatgataggaagacgtaatagatatagatatagatagagatagagatatagatatagatacagtgaacgtatcctacgcacaaagtcttctcgtgtacacgccgtacatatcaactagcaaatttcacaaaaaaaatagaaaaatttggacttttacttttaatagcaatacatctatgtgtaaagtctcatattcacattatatttagggaacaacaaaaaaaagactgaattttaatacatttatacttttcaaattgtcaaaaaaaattgatacggctaaaatataatgaatgaggttatgaatttacgcatcggtttaatactattggctgtatagttttgttttaaaatttctgataaaatagttcgttgtcgtgcatgatgtgtacacgaaagctttgtccacaagatatttttcatagtcatagatatagtgtatatatagatatatataaagaaacatattgatagacggacaaatcaatagacatgttggctgaatgattgatggatagatagatagataagcatagatagatagaaagatagatagatagatagatagatagatagatagatagatagatagtttagaaaaactgcttgacctcatttgttagataaatttcaaattcgtgccacataggtccttttcctcacatgcatgcctcttctatctgttgaagacttcccctctccttcttaacatcaaatcttgaacatacatccattggtcctgtgtggtgcaactagttggagcaatggagatagtaggtgagtgcatctacaataatccccccgtgctggttaccccaagcaaaccaacgcccaagcttgctctgtacctctcaaacctcgatgaccaacgcctcctccacttccccatccagtacatctacgtcttcaccggcacccttgacatggatactctgaaggtggcactctctagagtccttgttgactattacccactcgctggtaggttgagggctagcaatgagcacgatggcaaactcatcattgactgcaactcagagggggttctctttgctgagggatttctgcccggcctcactgctggggacttcatcctagggcatgccaagcctcataagtcttggaagaagctgctctataaagatgagcagagctttgtgtgcacgccaccactagtcgtacaagtaagtacttttatatagttacttccattcatataattaattagagaagtctatgaccataccttatatatttatcatacgatgcagatagtctatatatggtcatatatatttgcttcgttttttgatacttacaaatattggtaggggtgcaagtgggtcacccgcgaacccacttatagatcaaaataaacgagttcgtagattagtttagcatataagtgggtttttacgggtagccgcttgcacccttaaatattggacatcgagtaacacctgccaagagggtgcatgttcgatctagtagatggttggacagagaatacgtcacaggttgatctaacgggttgtggggatgggacatgaagttggacatatatatacacaggacggaattaattagaattgttcagatgggtgaaacttgtggtgtgtatattactagaagttggggacgattcgaaccattatatgtagctgtatgtatattagccgaatgacagggatcggtcgaccggcgggggagcagaaatcgggcgctccccccgtcccctgccccccacgcgcatgcatgccacctggccccaccacagtctctacccccacctgcaacaaatcacccacatattttggaaactctctattaagtggatttggtttattttttgtttcaccaaaaatattttacctagtgtactcacaatgttttactatgtatagatctaatgttgcagtgaactgaaatattccattgcaacaaaaaacccatatattttggaaaccccctattaagggaattcgttttattttttgttccaccgaaaaatgtttcacctaatatacttataatgtttcactatgtatgtaccaaatgttgcagttaactgaaacattctttcactatttgctgaaacattgtttttatataaggtgaaacaacacccgatttaaacgagtgaaacattttcgatctacttagtgaaacaattccgatatacctggtgaaatatcgtgcaacatttaaaaataattcaataataagctattttttttcatcggaatatatccatgtgtggtcttgttttggagatttaattgcaatgaatttaatggtgcaatcggatcatgatttggataagtaatttaagagaaaaatctgtttaaaatagctttgcacgtaaatctgacgctgacgtcatgctgacatccgtgcccgattttaatctcctcccatcgggcgcccgagctggagtcacgtccggtatattaccaataaatttccattaaattatatgcataatttaaatcgaacttctatacatagtgtattgcaaggaattggatttgtacatctcgagtgcaggcaccatcatttgcttctcactgacctcaataatctagcaaattttgtggaccaaaatatattgatctagtatataaagacatactccctccgttttataattttatattaatagaaaaaatatccgtgcgttgcaaagggtgaacgttattttaatcttattattgttatatggtttaatcaaagtgaaatacactgtgggaattcgcttggatatatatgttatttttagctaatcatgagctgcaattagaaatccatcgtctcaagttagcctgtgagtttttttaagagatttcttataagactcctaaattttcaaaagcgaactaacttaaaaactgactcaaatacggatatgtactttcaaaagaaaacaaacttaaaaaactgactcatacacggatgacgtaccaaaatactggtaaaaatatctttaatttttataatagtagagataggtcattttgacttttaaatttaaacttcttcaaaattttaccaaatttatagaaaaatagtgcaattattatagcacaaaattagttttattaaatctaacattgaatatatattgaaaaatattgctatatttttctacaaatttagtgaaagcgaaaaaagcttgacttaggaaaaaagtcaaagccgcttataatatggaacagaggtattacaaaatagtcaaattcacttatgaataatgccggcgctattcattgaaaaaaaatgtgtctttggtttgatatgtgtattggattaaatttcatgttggatggctgtggagtgacatacaacattttaatctatattctgaatttgttttaatttagaattttctgaaagacggatgagttgatgtgtatttaggctgcaaatggacctatgtggttgaactttcatgtttttcgtaaagctattagcagtcacatgcatttctttcgcaacggaaaaaaaacagacatgctatatttatggcgacacaccttgatcacagtcggttaatctgaccgttgaatatcatgtagattcatgctacactattgatgcttaatttaacgaacgtttgattcgcttagtctactacaaccctacaaccctactgctcctgttattcattagtttcccattgaatttatactaacatctcttttatttatatcgacttacgtatgtaattttaagacttacattatatatacataaaattacatatgtaatttagggatttacaatgtaattatatgctgataattttttagaaaaatatgatggcataaatatagggagttccagagaaaatcattaattgtaagtcaatgtgacgtaacctggttttcgtatccacgtggcacggacatgttcaggtaactcacctcagctgcggtggcaccatcctctgcaccgccatcgcccactgcgtctccgatgccttcggtgccgcgcacttcctccgtgcctgggcgcgcgccgccatgtccgaagactccgaactcgcgcatcccgccgtcgcgccctgccacgaccgccgcgccctcgcgccgcgctgcaccccgcgcatcgcgttcgcgcacccggagtacaccgctgccagcgggggcgatgacgcctccgccgtcgcggaggcctcgtcgcgcctcttcgccccgccgctgtcgccggtttccgtgaccttcacggccgcgcacgtcgcgcggctcaagaagctgtacgcgccgtcggcgtcgcctctcgagcagtgcacgtccttcgaggcgctcgcggcgcacgtctggcgcgcgtgggtccgtgccctcgacccgccggcctcactccccatcaagctcctcttcaccatgggcatacgccggctggtcaagcccgagctgtcgggaggctgctactgcggcaacggcttcgtgctggcgtgtgccgagtcgacggccgggcagctggcggcttcggcgcccgacgcggcgaggctggtgcaggagaccaagcagcgggtcgacgacgactacgtgcggtccgtgatcgacctcctggaggtgcggcggggctgtttgccggacttggcggcgaccttcacgatctcctcgctgacgcggcaagggctggaggacatcgacttcggggcggggacgccggtccactttggcccgcttaccagcgaggtctactgcctgttcctcccggtgatcggcgacccgcgcggcgccaccgcgcttgtgtccgtcccgcaggccgccgcggacagcttcgagcgttgctgccatgatggactggatgacgtggacgtggaagacaagaatcagctgcctaacataggagatggcatggcatcctaaaatcctaggcgtttgaatgccatatctcttctagaaacaatatattcatatgtctctccatttggctccaaaataataaaataactagtatggtggtccgcgcagattacgcggctagtatcattatattttctctcatataataacatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaaattatatatattcctatatggactctagactcgtcttttaattttttttaattccgaattttctgtaaattatatttctatatattatatttctatatagactctatgctcttcttccaatattatttatttttatttttgaattttcatattatattatatatacgtgttagttattaattattttgaatatcaaattttagttatttgtaaattatatatatttctatatggactctatactcgtcttttaatatttcattttttaattccgaattttctgtatatagactctatgctcttcttccaatattatttatttttatttctaaatttttattatttctaattgtatttctatgtggactctaaacccatctttcaatattctttaatttttagttttgaatttcagttacttttaaattgtattcctatattgaccttaaactctccttcccatgtttttcttaattttaaattttagttatttgtaaattgtattttcatacggactctaaactttacttttaattttattatatttattccaaattttagttagtttaaaattcctttatggactctatattctacttctaatattccttattttttaattccgaatttctttttttcttaattgtatttctatatggactctatactctacttctaatattccttatttttaattccaaatttatattatttcctaattgtattcctatatggactctatactctac

SEQ ID NO: 40865 - DNA, 18393 bp, Oryza sativa
ttcctaattatatttctatatagactctatactcctcttctaatattccttatttttaattccaaatttcagttatttcctaattgtatttctatatggactctagtctcctcttctaatattccttattttttaattccgaatttcagttattttctaattgtatttctatatggactctagtctcctcttctaatattccttatttttaattccaaatttcaactatttcctaattgtattctatatggactctagtctcctcttctaatattctttattttttaatttcgaatttcaggtatttctaaattgtatttctatatggactctgatttttctttttctccgattaatgtgagaatttctaggccatgagagcgaacgtagagactcttttttctattcctttaataatataatagatagatagttgtggtgccctagcaaattacctttttttttggcgtagtacaacagtctcacatttttttaagatgtccagcaactttaaaagtcatgtagtaaattttaccataaaaacatactagaattttggtagaaatgaaagtgtaaattaaataattgcaaaatagagaaaaatataaaaatgatcaatttcaatagaccgcaatgagaatagaatgagcgagatagactcattgggccaactttcctccaaacctccataccttgacacaatgagccatattctttacgaatttcatataatttcaaaaaggaagcagtcaggggcatcacagcatgttatattcaggtttaagcattactctgaaatagttcagtgatttactatgatgccaactgattatgtttgtgcctgatatgtatgtatttgtttaccactgtaaaaattcaaaactaaaagtgattgagggaaaggggggggggcggtagcttcagacatgaccagcttttatattggtaatagcattcagaggtcaagacctgttgcatgattctatttgtaaatttttgtccacgttatctgaaatcagcgaagaatatgggtaacacatttgttgttaatttaggaatcattaagtgaagaatatattatttccacacgttatgttcttctgtatataggattgtcatctctcatctttcttcatgcgtttagtaccaagtgttgatttaattgggtaattgatccattcaaatcaaataaatttcaaggctcattatgctaggaatttgtgtatattcattctcttatgggatatcagtgggacgaagagttttgagaattaatccatttgattaatgaattggtaacctatatcaattactcctaattgatggttggttgatggttgtgtactggatgatggttgatggctagttgatgacaatcagtcactctattcctcttcctattctattggttaacatatatcaagtacttgatataggttaccaagtactctcctaattgatggttgtgtagtgaagaatagttgatgacaattagttactctattcatcttcctattccatgactatcttactcttcatctttcatttctcctataaaatgagaatggatttgatctcatgcgtgaaaagagatatacacacttttcatccacttctaatgcggttgctgccacgataatctcatcccgacgagtgtgtgcacatacgttgggagattaggcctccgaaaccatgcactgctgcgatgtttgcacggacgagcgagagatcaggtttttggggagcgcaaggcgcgactactcactattcgtcaatgtctacttcattcatcaccatgtcgactgatggaggcgtaaacggtggacatgtcggtggcggtactggaggaggcgagaacgacaacatcaacggaggcaacaacaacaatagcaatatctcattctctggagcattctctaggtatattactctattcaccttagtgttaaacatgttgctagatgatgctattactattactagcatgttcatgtttagcactataactaaatcatttcgtttttcacatgtcatgtttattatcttgtttttctagattaaaatatgtcaaattatgaccatatttccaacaatccaaaaacctgataggtctttttcggtagttagctttgccgcatcactaaaaccacatgccttcgatggttcagactataagaggtggaaagcacgtgcactattgtgtttgacggctatgcttctctgtttcttggagcaaaccgagtgaaccgcctctctctcctaaggaggaggctatgttcgagtctgcggattgcttgttccatggagcattgatcagtgtactagctgacaatatattggacgtttacatgcacatgccttcagcgaaggatatgtgggatgcagttgaggccaagttcggagtttccgatgctggcagtgagttgtttgtcatggagcaattctattactacaagatggtcaattattgttttgtagtagagcatgctcatgagatttaggcactggcaaaggaatttgagaataaaaactgtgacttgccgggcaagtttgtggcgggtggcattattgcaaaattgctaccttcttaatcggactgtgccacttctctgaaacactggcaagagttcggtgttactgatctcattggctctttgggtgttgaggagaaggtgagggcaaaggacaaccccgataaaaagatcaagagaggttctagcgctaacttggtgcaaaagaagaaccctaatgcaccccacaacaataacaagaaagtcaaacgtgatgtcaaactaaaggcaacaaccaattttaagaagaaatgcaagggaaaggcgaagggcaactgctttgtgtgcggtaagtctgggcattgggccaaggattgtcctgatcacaacgacaaaaagtctgcaaacatggtcattagcgagggcgaaggaacatcggggtacggtaaatttttacctacagttctctctattttccactcacctgattggtgggttgatacttttcgacattttaggtcacgactacggtatttgcatggtttggagatcgttggtgccagggtatatgcgagattgaagtaaaagagatagagacaaggatttttatataggctcgggccccttatctaacaggtaatagccctactcatgttggtcatagccggtattgctctatattcattagaatcacacaagtacaatattttggatagcctatctagctgtcatcgacttggcggcatagataaccaacacgtagtcgacaacagggtagtcttcctcctcgagtacaaactcgtcgagatcagagatagcgctagattcctcttgtcggcctccgtaggcaccatattgggttcgtccaggctaatctctgatgtcgatgtctgacggcgtgtgttggcttctgtgtctcgtgtccattgtgtgtctctgtatctcccctctcctcctagggggtcttgtatttatacccatagatgtccccttgtccaagtcgaactagggagactaatatggatacaattcgagtagtccttgttgtttccatatagaactctactcatccttccttatccggaactccttctatatacgagatataattctgtataagacttggtatatgatgggccccgctgagtttagtcgattactattgggtatgtggtatccataaccatgacaagaaggtggagcactgttatttgtggagtcaagagaaagaagttacagggatagcgaagtctctttattatggtgagcttggtgaaggttcatcggggtggcttgacgtaagcaacggaagaatcaaccactactacagaaaagtccattggtgtcggttgggaaccagtcgtaggtgccgggttttccaataggcacccagcaggcggcaccgatgacttcagccatcggtgctggttgtagaaccagcacctataataatgtataggtgccagttttacccaagaaccaacacctacaagaatgaacatgagaaataaaaaactccaactcagctcaatcaagccgacccaagcacatcaagaacataaagaacacattaacatcaagacctaaaagaaacctcgccctccgcaccagccttctccaccactgccgccgtcgtcggatggaggggaggagaaggagggcgccaccgccgcctcccctcccgccgtcgccactgagagagggagagagtggtgtagtgagagagaggtgagggagagagagcggtggatggaggaggagagagatggagataagatgggtgggtgaggaaatgaggaaagagggggttgggtgggtgtggtgatttttcaggtcttggctcgatttttcaggtatcggttttttaataaaaccggcacctaggtgctggttttaaaaaaaccgacacctatgtgtattgatggtggtttttatttagaactagcacctgtaattgctcaaatgcgtcggttctatatactttaagccagtagaagtgggaaaagatctataggtactggttttagtacttccgacacctatagtgccaacctctatgtgcatttttgtagtagtgaactcaagtcctaggacactgagattcaagcaagtgacagattcaggttggcgtggtatattcgtcaaggtagagtttgttagagtttgtttcgaatatatatacatataattgatcgattacagtttagaacttggagttatactagatacaggaatagagtaatattatatagaaaagagcaagacgcatcgatcgtggttttgtctttatttcaatccaagctgaagtacatcatttactcacttatttgatttgactaatgttattattactccctctaattaagacataacacaaacacacagcgcgtgcatgtaacgagcgagggacgatgcatgcgtgctagacacatatatatagcttgttgcaacaacgtcgtatgatcagtagggcctgcggccaacgatgttgccacggggctcgtagttgcagatgatgaagatgccgcggttggcgtcgcaccgcacgcgggcgcagccgacgttggtggagtcgcgccacaccacctgcgtgtagtggccgcacaccttcccggcggcgcagctgttgctggcgtagttgtagtacttcttctcgtccacccacgaccgcaccgcgtccgcggccgtccagtcggcgccggcggagccccagaagatgttctcaccgtacggcccgcccgagtgctgcagccggcagtcgcccttccgctgcctcgcgtagtcctccgcgaacccctgcagcttcgtgctccagctcatcggacccacgccgacggcggaccgggccgcgttctgcggcgacaggtagtcctgcggcgagttctgggcatcggagcagtgaaacattgtagcggctaccacggcgagcacgaacaagctgcagattgctagcttggatgcctccatctctgcttgtaaacgtagctgctttcttacttctgtatatagctggtacatgcatgcagaggggtatttatagtcgacgtgtgagagaattttcttcgttttgcatggaaatgttggcgaggcgtgccggtattttccttgtgctggcaaagaattctacgaacaggcgatggtactgcatacttatctgcagcctactcgattctgttatttagatgaacgtacaaagctccagtcaagtcatggcatgtttaattgatttgttggatagagaatactgtaacgtgtaccgttaagataagaacacgtatatatatgtttggactctcagctatagtgcttgggagccaaatattggaccgctccggccggtggtgtgctctgaagaatttcgcagagtactggagtatactagccggatggctcttgtgtgcgcatgcacgtcacattctggcaggaattaagttaagacgagagatgtatctatacgtatcatggaaataactttcgtgatacatcatataagactgttaagcaaggtttctcaaggcatatgtctgctaatgagagaatcggcctaacttgatcttttttgggagtagaccgatttggccctggtcattcaagcaagccttggaccatcatggtgttttattttggagtagaataagtctatcactagaaaatatttgccgcgcattagtatatataggctagctcaattggatggacccagtgcactgttaattatgaagtcaggtaaataagaattgataataactaaatatgtatatccaaaacaaaaaaaaagagctacataatcacaaaattttacattcaacttacccgataatctagttttacataccatcaaactcagttgcttttgttactgacaatgagagatcaactttgtttctccttataaaaacaatatgaggttcatatcaaatatgttttccttacaaagatattacatgatcaatactttgtgattagcatcaatgatgaaataaggagatttaactatttgtaatgaatagaaagtaagacaatattttcagtgaggataataatataacttatcattgaatccaccgtcttgtgatatctcatttactacagccttgtttggcatgagcattgctctctcactgaattgtacagtggttaaagtcccagttctgcacctgcatttctcagtcccagcactctatgtcaacttaagaaaatgtaaataaggaacagaaaaaacatgtgttctgaagaaacggaacataacatgaaacataacatggaacataacataacattaacaatgtagccccttgaatttgagctatggtagactttaattcagattttaatatctaaaggataaggcagtgactcggttatcagaatataacatgaaacaaataattttgagagagcataatacaagtatatgtgatctaaaagaaatgcagcctgttatcaagacaaagttctttgtgactatagggtagcccaagcagaagttctggttgtgatcttcattcatgcagaggtgaaaatggaaagcaaagaaactctagttttaaaagcaaaatagaaagggcaatttctttctgctgttcttataggtcaaaattgtcccactgatgtgagcatagtagaaacgatttcttggggttagttttgctagattactccgtgccataaaaaagataaagaagattttataaacaacttgacaaatgtccataaaattagcatcaggtaagcaaaaggttttggatcttaacgaacaatcatgtgctaactttttttaactaatgctaactaaatttaagctcaaaatgccttgctatgttttctttttctctctttctttctttttccttttgcagattagtgtagcagctacctgaccataggtgaaagcatcgctgctaacaaagtatacagataatgaaatgatttggaggtcatttgatcgatatctgattgacgtcctcaaccgttgacacatactcatcagattataatatacatgaaggttacgggtcattaatctgctgattgtatgcatggaaagcatgaagcatcatgtcagatatggaaaccttgctaatagattaattgaactcagaaaaaatgcatttttccagatcaattaagaaagtgtagatgagtcagtattcacctaaagaaacgagcaccggcattggtaacttgtgtgcatctccggtgagctttattgcctctttgccagagaataaacaaaattgaggatgacggtggatgaaaggctgccgccgtctagctcgttcctccacagcgaggtcagggagaaggaggcctaaagatgagcaggaataaagggggaaaagctgcagcagctgtggattaaccagagaccgtcgggggtggtcgactggagcatctcgctgaggaggatgtcgtcgtcgtcgtgtcatcgacagcgtcgccgctcagcccgtgcatgtcgtccgaggggagcccagaatagggatgggcaggaggcagcgtcggcgctcgttctgcccggatctggcacccttgagctcgtccgatgagggactggtggcgtggcttggatggtgcagcggtgacgtctgaaggggatggataggaggcggtgatggggaggagaaggttgccgtggtgcctggcatgggaaggagatcaggagaaggatgcagcggcggccggcagcaataggaggcggagcgatgaggagggggaggcggcggcgtttcgggatgggaaggggcggataggtacgggccgtgttacgggataggacacgtggcacggttttatcatatgtaaaattgcttccagttttagccacgtggccaatcaacggtaagggattggacccaaaaatcagtataagagatgcctccctcaatacttgctcctgattgaatagcctccctcaaccgcaataccaggtataatgtctccccactcttcaaaaatctgaccaaatcaagtcccttggctgtttggatagcggtttcatcctatgtgacgctcatgggatccactgtcagtgataaaaaaataaaaaaaataacgcccccacataacggacttcatatatagttgagaacttgtgagtacaactccccaacagagattggttcaacccgtgcgcacatagctgaaacaacttcattgtatccttcaccaagttgagttacgatatactggattagatcttcttcgtcatgtggacaaccgctagccatcgtcatctcctcggcaagggactccatcttcgcaaagtactctgggactgatagggggttcccttcatggtgttcatgagcgcaattctggtgttgattgatcgtgcccgggtgtaagttgagtacatcacttcaatcacacctgatgctttagtcattatctcacacgtcgcaacttgcatatggacatcccttgatagggacgagagcaagtaacccatgacctattgattggtcttcttctccgtcttgccatcggtggtgacggagacctcaacaatagctaggtttcttgctggcattaatgagatgcccttggagtcaagctccttggacagcagtgatgatctgcaccttctagaacacatgattcgccttcccttatttctttgaaacacagtggccttgaagcggattggtggccattgtgtttgaggatgacgacaccatgaggatcgccctagatggatcgacactctgataccatgtgagttttctggatggaaacgatcgcaccaatcccgcgcatcgcctttgtgttaatatagataggaacaacacctattgtgtcttacagagatatgcgctgatagaatcggtaggaccacaaaatcaggaaaggcgaccaatgatctatatgttctgctattatcaggtgtgaccaatgatcttatctaacacttaatcgtgactgagctaggttcaggttgttcttcaaattatccagaagtctaactgacaatggcttagtaaaaccatctgcaacttgatcactagatgaaacaaaatcaatttgtaaaagtttatgacttacccgttctctgatgaagtgatagtcaacctcaatgtttttttttgcatggaaaattggatttgttgataagtagttagcacctagattgtcacaccaaatattggttgcctgaggacttataattcctaactgcaagcaaggtttgcatccacatgatttttgttgtagcatttgcaataaaattatgctctacacaacaagatatataccagattgcgcttctctggcaatgtcatctggagttcaattattacaatacaagtttattgcagcgcatagtccaattaagacagtatgacataatatacaagtttgaataatggaaaaaataataagacgatgagaatttgttgtagtgttgttaacaatggaattttgtatcaaactcggagaagaaggaacaagatcgaagcggatttggtgcaagatcaagttggttttgaagtcggactccgcatcggctagacactgtatcggctgcaaactgagcttaagtcgataacagttgataaggttgatagccaatacagccgatacggtataacttgggctcggtttgcacctagattaagataaccgtcgttgccaattagagatagaactcgaataaggtaattgtatctaataattaggatatttaagtcagttttgttagagatttggcaagagaccaccgtgtagtcttgtttgtatcttatttttaggaaaatttgaatcgagtccataatggactaagtttgtactcaggcataaatatgaaccccatagcattataatcggatggacaatctaatacaatttcggcacaacaccaccctttttacttttctattgttcaacgagtttatacttgtcatggttatttgcatcggcagggttagggcttcgacactctaatcttgtcaatgtaagtacctatctatcatatatcttagttaatctagtttgttagttcaatttatttgtatcagctaagattcgttttagggtttatgccgatatcggctaaattgctttaccagattagattaactaaggtgtctaccaccctgaaattcagtcaagggcttgattgtctacatattatgtttattttcatactttgcgctgcatcagccccagtcgtgcttagaaccataacctctagcctgccttttgatttccaataagggtttcatcggggtttcagccgatgagttatctagatattgcatcggcttataaagattatattcaagttagatttagccgatcgcgacaaaggtttcactgtttatctattcgttttgatttaatgacatcggacttctagccgatgcatgttttaaccttcggatcaatgcttattctatcatattgttagccaattggtttctactggattatattgttgttttgttgcattatcatcagccgattgtctttgtttacatcaagtgtcagactctacatcaaccatatagccgatagctcaaaatcctatcgctatcggttggtatcggcatcggccggaattactccaccggcttgtcagccgattggctcattgatctactatttgtatatcttgtcagttataggatcaaactgactggcacacccgtatcttatcaacttttggacctgcactggagctaagcagatatcccaggccgttgtgttcatcgacttagttcgcgccaacacagttttggcaccataagctagctaagcgcggattttttgtcaacaagtgtacaataatcccagtggtttactggattccttttaatatttattattctattagaacccacgttttggcatggttatgtattcatggatgttgctctattaataactcgagggttagagctaggtaaggctaaactggaatctacagtgggcttttattttgtttagaggatatcctatcttccgatatagttggtactcactaaggattatttactcctataaagcaagataatacaagaagccacatcatcaataattttaagtcattagatcatattggtacaaagataataaccgttggatcaagaagctatacttattcattcaattcaatcatttattagttatccattcacctccctttgctccacctcattgtgcataaaaccatgttttccgaatataactcaaattattgtttaatatgtgtgttttattttattatgcacgataagatagcatataattattaggtatcgttacctaaatctatttttagaaaaaacttgagtgaagtagagagatgcaaattgtctaactataacgatacccatattgcacatgaaaataatattcatatattataacaatacacaattgcgcttggaaaaataaagcatgaattgtattgtaatagcatatataagacatatataaatccacattattatatattttataaatacatagagttacacctaacaatttaaactatgattttgtttgacgataaaactacaaaacccgtggcaaagacgcggaatgccaactagtttatcatatgactatgtaacatgaggttctattgtctcctatagtgatgcacgggcattttttaagttaaaggaataaaaaacttaagtgttgaaacacgttcttcttaattagaacagaggtcacaaaaaccaagtggactcagaagcaacataacactcattgctaagccgtgggcaacaaaaccggaggccatggcatctggtactgaaacacaggctcactcgcactaaaactcgcaacaacctctaagttgctgagacgaaaggcaatgtagcggtcgttcaggcgtcgtggcgagtggaggcacatcagcacgacgccggcgtttacggcgacaacgcggcacgctcgatcataatcccatagcatatcagcagcgtcttcggtcgacgtcgtcagcgatgtttcctgttcttggtccagcacccacgcgcggccgccgcatccagactttccaagaagccaaactctgaggtgccattttttcttagacaacatgaccagcctcatcgttcctctctcctccatgttgaccaagcacatggagccgtcgtcggtgtcgccgacggcgtacgacgggcccaggaggaccccgggcggaggcacgacttcggggaaccccatggtttcggcgtccagggagacaagactgttaggagagccgccgcgtagcctcttccagcagatgcgacctggcgcgtgcatggctgaataacgtttcactttgagaggcagcggcatgtcgatgtcgctggtgttggtccacgggcgagcgctccacgcacccgtggaggagtcgtacacagccagtcgctccatgtccagccgttgatctcctcccgaggcgtatattactgtcgtactacatctctgcatggtgaccacacggaacgacgacgacgacgctgcctgatcgccgacgcggccagggatcaagaagctgccggagttgtgatgaaatgcccgcttgttgccatgccgcggtggggtgagcttcgccaggacacggcgggctacagggtcgaaaacggtgagctctcgttggtgtcgcaattcctcagtaggaggcggccttggtggcagtcttcaacttcaaggcggcccatggacgtgacgggagtgaggaagaaatcgccatgtcggacgaccgcggatagttcggggtcggagaaggtgggctgcgctggttggaacaccggccgcgaagagcattcagtgtagtagtagtggccgaggagaggttgggcttggccggggtggagggcgtggaagcggcggaggaaggcgggggacgaggccacccggcgccaccgcttcacagcgcaggcggcgcgagccagcgacgggactgacggcagccgcacgaggaactccgcgatgacatcgtcgcagaacgagtcgacggttgtgggcgatgcggccggcggtggatcaccggaaaaactggagggtgatgccttgcgcttcatgcctcaatacacggtgcgtagtacggcatgacacaactcggtcgatcagatcgctctgggactcaggaaaacttgacttcatatatactataaatattcttccttgcagagaaagagttcgttctggattggaacagagctctcgtatctatcgaaactactaaaaaatattggagatatatggaaaactcaatttatcccttaagaggatatcccatcatttttcatgtcaactaaaaagtcataaaaaaaatttagtagaatagatcaatatgtgatattgtcacttcacaaatatgcaaattcaaattcaacttatacaagtagaaacaaaaataaaaaatttactatgaaaaaaaaatcagtagaatagatcaatatgtgatatgtcacttcacaaacatacaaattcaaattcaacttatacaagtagaaacaaaaataacaaatttaactataaatagagcggtcaaatttattgtttttgtttcaaattgtataagtcgaattttaacacgtatgtttgcgaaaagatatatcacatattgatctttcctactaattttttttaaaaaaatttgatgactctttgaacgacatacacaaaacgagggaatgtctctttgagggacaaaattccacttctgagatatatctgctattttcaaaacgaggggatgttccctcgagggacaaaattccacttctcagatatatcgctatttccaaagaaacaggagaaaacttgcaaataccatgccttcaaattgattcgttccttccatcttccgacccgtcgtcgctgccgtcgccgatcgctttacgcgatgagacgcggcaggaaacgcaagcgcgccggcaagccgacctgcctcccgccggcggacgcctcgttcccttcaattgattctctcaacgacgacgtcctcgaggagatcctcgtccgcctcccgtgcatcgcctcgctcgcccgcgccgcctgtgcctgcgcgcgcttgcgagcgatcgcctcctcgtgggcattccttcgccgcttccggacgcttcatccttcgctcctcggccacttcgccaccgacgccgacgacgagtcagtgataccgaccttccaccccgcacgtgcccagtttgatggttgctccgacgccgccgtacgaggcggcgatttcttcctcacccgcgtcgacgcaaacgctgggtggcgcgtccaggactgccgccacggccgcctcctcttcgccaacgagagcgatctcctcgtctacgacccgctctcgcgccgcggagtttccatccgtcgaccatcgtggtacccctccagccacttcacccactgccttctcgccggctacggcggtgacggctgcccgggctccttccgcgtggtgtccgtcgagcacaacggcgagcgcgcggcgcggggcgcggtgtacagctcgtgcaccggcgcgtggcggcgcggccggtgggactacgaccgcgtcatcaacccgaagcgccccagcgagtactcctacttcccggggatgcaggcggcggggcggatctactggaagcaccgcgacacgacgaagctgcaggtgttcgacgcgggacccatgcggttctcgtacgtccacctccccgagggcgtgcacccgcggtccaagtacgccgtcggcgaggcggaggacggcgggtgctgcctcgtcgtcctcgcggacgcaccccacggcacggtgttcaaggtgtggcgcctcaggacagggaaggggtcgtggccgtgggcgtggacgtgggagcttgagaggcggctgccggcatgcgaggtgatagggaaagtacaataccctccgattcgccacgtgtgcgcggtggtcgccggcgtggtgctgatctgcttccagaatcacgctgggcctcaccggcacatcgcattctggctcagcaacatgcaggtggaggccacgttcaggagcgctggatgggcttaccctttcctgatgccatggcgccactcatcacctctcttgttgccttctgcaaaattttagtctagcaaatacaaactgcgttgctttttctcgataatctgagactcacaaagccatgtttggccactctttcacgtcataaatatgtgaggttttgttaaaacttttgagttttttttatcttaaaaatacaagtccatatgcccatatgggtgcatttttttaaaagaaaatataggtgcatttaccacaaggtataacgagatcggtggaccatcaacgagtttgattggagaatcatttaacagatttactaaaaatgttgccaaattttcagcttgatttcagtgagtttcttcgcctgttggatcacacattcattctttcaattttgttatatatttgcagataaatttgctgctaaaaatttgatagatactagtataatttttattttgttttgtgttcatttgggctaatctctttaagatccagaagcctttgctagctggctctataaagtaaatatttaacctctccaagtgctaaccggccggatggctaaactcatctgggcattgacgaaggccgtgttgagttcccaactaaaaacttcacactatcacatcgaatatttggacacatgcatgaagtattaaatatagaaaaaaccaattacacagattgcgtgtaaattgcgagacgaatcttttgagcctaattacgctatgatttaacaatgtggtgctatagtaaacatttgctaataacgaattaattatgcttaataaattcgtctcgcagtttccaagcggaatctataatttattttattattagacaacgtttaatacttcaaatatgtgtctgtatatccgatgtgacacgcaaggccaattttttttttgccaacagggtctaaatttggccacgatatttcattggccaaacccacatcgacggcggccggcactaagctattccatcccattgtaggacagtgtagttgtcatctcattcagcgccaccgttgatccaccccccctcgcttctctgacatcgtcgctcttgtctcttcgacaccggcaccctgatcaggcgcatagttgactcagtttgtatcattgacatccagtgccaccgtcatcccttgtagcctcccagtcctcccccataccgacttggccttaaaagtttagatgggaataaaacttttaagtctctatcacatcggatgtttgaacactaattataaatattaaacgtagactattaataaaacccattcataatcttggactaattcgcgagacaaatctattgagcctaattaatccatgattagcctatatgatgctacagtaaacattctctaattatagattaattaggcttaaaaaatttatcttgcaaattagcttttatttatgtaattagttttataagtagtctatatttaatactctaaattagtgtctatataaagagactaaagttaagtccctatatacaaacactacctcacaacctttgccttcaactgttcccaccgccaccgcaattttttattggctccgtcactcctactgttgcatccttctcaaaattgcacgctgctgatcgaaggttgtcctgcatcgccagcatacgggtttttttttttttagataatgatcgccagcatacgggtgggtgggaaaaacaagagaaaagaaaaacactaagacactaacaagtgggacccaagaaattggagagtgggaggttgaatgactgttgaaacaaagagggttcactttatttttcgatcttgcgaaataggcaaaatgaagatcaatattttgcctcggtacgaaatagaccaatatttgacagggctcttggagagctctaaactgttgattcgatgttattttgatgaaaatacctattacagtacatatttatagcacttttatataattaaaatgtagtaatgtctaacatttacaaataactagtttttcaaagtgagcataactcaattgattaggttttttaatggagccagtcaaagaaatctttttttttaaagtaagcgtagctcaattggttagattctttgtaatggagccagtccacccaagttcaaatcctacatttaatatggtgctcacatttacggctaattatttttttaggggtaggcaacgtacatgttggcagcgagacacctgtggtgacttcgtcaatctcaagatatacttgcccagtcattcggaggtactccttctggtagaatgtgcgacttcgtcaatctcaagatataccaatccagttattaggaggtactcctccacgtagaatgtgcgtgtgtacgttcataggggtgagtgtgcatgctgtcacgcccggaatttctatccaaaattccaaacgcttacatgtgtgtgaaccctcgtccaggaatcagccgaggcacacaataacaaattgataatagagtacaattattactctagttaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcatggtgagtatatgacatactcagcaagccacgcagcaaatatgcaagtgcacaggataacaaaggatggcatagtagggtttcatttgcacaaacagcatttaataaacatttcagaatttaataaaacagttaagtaataaataaacaatattaatccaacgctatacaacataccctgttgtataggcccaacc

SEQ ID NO: 40866 - DNA, 8828 bp, Oryza sativa
gtgtgagactaatcacaaaagacattgttagacccgcccataaccgcgggcacggctattcgaatagttttactctgatcagagatgtaccactgtacccacaagacacagccctacatcatgtcaccatgtgcctcaataccaccacggtacctcggaaaggagctgtgacaataccccttgcataacacaatccaccgcagcgcaccattcctggattataaatcacccccttataaacaaggcatggactccccagcgacccccgtgggcttatctccgccacttctcagtctggtactccgcaataaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttaattggctagtaattaattaaccaatcacgattgaccatcgtgaactatcattaagccatcattaattaatagtgaatcataagttatcccaatagtgtgctaatgtttctaagcatggctaagcaatcacatataatatctagctgaaccaatatgtatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacaggatcaacatgctcaaagggttgtttgggatctgtgtgacttgccttgctggccttagaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaagagatttattgcgtcagcggctagggtttgcggtggaccgggtgcacggcagcggttcacgggaacgaacggccgagatcgatccatccaaaacggacggccgagatcgatcgggtctacggcggctcacggagacacgacgacgatgacgtcggcgatgacgtcaccaccggcggcggctcgagcttgcaaactcgccggcgaacgacggcgcggcgacgcgaacggagggcaccagcacgtagagggcgacgcggcgaactcaccggtgaccaaagaagcggcggaggagcaacggacgacgtcggcgacgaggtcgaagcggcggagaagatcgggtcgacggcggcgacggtgctccggcggttgacagcgacggcaaaggagcggacgaggacggcgacgacttggcgaccatgatggcgatcttcccgagcgacaacgacgaccggaacggcggcggcgcacggctggagcggcggcgacgacggcggctcaaggttacacggcgctagggcgcttccgacggcgagagatgaaggcgagggtggcgacgggtagcggcgggcttggggatccttttataggggcaagaaggcggcggcgaaggcccacggcgaccagcgacgcgaaggaaacatcggggttcggaggaaagagaccgatccgatttgacctcgaatccacgaatttccaaacgattttagccggtgattccaaaagagaaaaggtagaggagatcccgaagattgtttcccctcaattgatttcaccggataaggaaaggcgcggccgaatttggaaggagacggcggcggcgcggcactagggtttcgggcggcggcggccggaggttgacgacgggtccgacaggtgagccccacctgtcagcgacagcgcgctcgcgcgggcggctgcggctgcgtactgggccgactgggccgagggagagagagagaggggttttgggctgactttcggcccaaagccaaaagagacttttaaaaacctttttcgatttaaattattcatgaaatgcaattccatttattaaaaatacttccttagctcaaataaatcccagaaaaatctaggaattatagaattaagcgaagtatttaataaaattttatctggccccattttatattggaatttattaattaaaattagatcttctcttctaggcttttaaaataaattctaataattccaattaaacaacaatttatatatttaggatttttagggtgtgacacatgcgttgagggcacttgcatttgtaccatgtttttttataaaaaaatagaaatctattttttatttatgataaatatggcagcataaataagaaatgcttagtctaaaaatataaaaaatggtgagttgcctcgaagagtataatactcttcgaacaaaattatcgtaagcatcacgatcatattagattatataaacttatttagttttaatttattctattataaagtcggtgattaaaaaggctgctctaatcttactcttaaatatccatttatgctgtaaggaatttgtttttcgagaaatccctgtccattgcgaggatgtgtcattcccacataagcggccaatcaattttttctacgtagttttttttttgatctttctacgtagaagtatttggtttggataatgtttggctgctcggtttattttaccagcctcagttcttcggcctccacgtgttaaagatgatgaggctgggaagggcgccctgctgctactgcttcaccgagccgcaccccgccggcggcgtcgcggccgccgtcaggctgcgactgctgccgcctgcccgcgccgcgaatacctcctcagagccggcggcgcggctgagggcggttctcgagcaggtggacgaggagctgcggaaggggaacgacgaggccgcgctgtccctcgtgcgcggctcgcagggggcggatggcgggctccggttctttggcgcggcgaggcaggttggcttttgttgtcatgtaatatttgtcctgatgttgtctcgcgattattagcagctgtgatgatgatgcattcacccgctctgctttcgttcttagattggagcatttttatgtgcatcttaaactgatttggcaaagaattcatgagccgagagggcgataggatatatttagtgctgatttcaactaatgctattcataattttgcctaaataaaatgaagctttagccttttccttttctctacattttgatcttggtagtcttttttttttctactgaaatctatatcaggtacctcaaagactttatacattggatgagctgaagttaaatgggatcgatacttctgctttcctatctcctgttgatctgactttgggatcaattgagagaaatctccaaattgctgcagttctaggagggctctctgtatcagctgcattcgagctttctaaactccaagttctgtttctgtttttgggtctactatctctgtggtcggtggatttggttagttacatcataatgattctttccaatcatctaaataaattttcatcattatatggccttttagatcatcgactttatgacttgtagctgttgatctactgatttattcaagtccatgttatggttaaaaaatctccattgctaatttattcaaggagtatttaatcatctgtaactgtggaaatatgaagtctaacatattgttccattcatacagtaatgtgctttcaatcgatgatcttgagcttttctataatctctaactgaaaaatcttagtattacttgcatacacttcttagaactctaattcatttttttccttgagctcatttcatgtacccaaaaaattaattgtctattaatgtcatcttatcatttgtcccatgtcatgaccatcagacaacccactgtttcttgatcttacacaactacagctttctaggtatatttcggtggtggagtgagaaacttgattcttgatacaattggtcacaatcttagccagaagtatcgtaatagagttattcaggtatatatatgtcatccattcttatttacatgagcttaagttctgtgagtttagaaaatttgacaatgctttcttctaattgattaaagataattcgccatgaacccaagttcataaatgataaaatataaatgtttacccactttgttcctttaccactgttggatacaattttttaatttattagtgtacaatatagtcacagttaattatggcatctctagtttatgttgttttgctgtcagaggtatgagggttcaaattttggaattgtggttcagagagaaaaatctaccaggattacaacgattaataagtgtgtcagtttgatgatctgattaatttcttatcaacagttcttagtataatctatttatgttggtgagtttatactaaaaactcgggaagtccacattagaatatatttgtaaattggtgcattaaatgggtgttaagtctgaagggataaacatgatcattcccaataatttacttggttgcagagccaacatggctggcataattttaaggaaaactaactgttgcctctataagtctgcttcacaggctttgatgcctggtataacatagatatgtatggggaaatgttttactatgagtacattgcgcagctttcgttgttagatcaagctttggcaaagtgattagcggctgaagtagcagttctttttcccccttcatttcatattttatcataaaaaaaactcatagtgatcaacattgtaaaaagtaacatgggtatttggaccaaatggtgaaggaacacatccaaatagcttacttccagcaataaggcggttgaatatcttcaaaacaacagcttgaaatatggcagaaaaaatgaaaaattccaacctattgaatgctgacgttgtggtttattttacataatctaagctaacatccttttatgtaaaattttgaagcacgaagctggccacttcttgatagcgtatttgcttggggtccttcccaaaggatacactatcacaagtttagatacattcataaaaaagggctcactgaatgtgcaagctgggacagcttttgttgactttgagttccttcaagaggttagttttcttatcacctccatttttaccaccactattttggaaaatgatgatatcttattgtctgtaacctttaagtttcgagatgccctgtttctatcctctagatttgtgaagtgtatgatgcacaatcttgtgactcgctgttgctgttactctggtcaaaggctttcttcagacaacccccctatcgactagtttgtcatggatgtacaaaatggtgaagggtaattgttagagatattagctattctagcaaaaccagagtcacagtctgaaagcagtgtactgataagaaccagcattacctatccttttttctccattctcttttgcccataataaaggatgaaatgttattgttattgcatttttatgacgcagttaataatctattgaacacgaaaaagtggatgaactgtatcaacataacacatctttaagcatatggtgaacggctgttctgatataaatttctgagcaggcattcagcttaacatgagtacatgacttctgttttatgccatttcttcctggttaaaacaaagagttgagaagataaaacttgaagtgtgtcttgatgtttgaatccttcatgatgcttatgttacagtaattatttatagtataatgcccaccagttcagttcatcatattaaaaaggaatgcaataatcatgcaatgccattcatatgttatggtttaaaaagtattgccattatgtgatcgcaaaataaatgtagtgtgcattttatattgttattgttctacgccttttttccaaaaaaaaaaaatattgcatgttatatgcggactaggctaataattatcttttatacccaggtcaattcaggcaaactatctgccacggtaagggtttctaatcaacattatcttgtataaagcatgtaaaatagactgagatgtgattcgttcagcttcaagacctattgttggttggtgataatccttggattatcttgggggtaaacacttgtcggaagtaggtcagacagcggcgacttttggtagaacggtgctaggtggaagagtgcactgattgagggagaaacacatctagaatagctggccatggaacggattagagctgaagtttagaactaggacccatttattcatttataaaagtatgcacaaccccattcttacatagttatggaaaggaatatataacagtgtaatctagtcttatatctctaaaataacaaaatgaagatgctgctggactaatgtgcatttctgtttgcatacatgaacaatgtcagaactcaaaaagagtccgtaaagcatattctgataaaaatatatttactttaattcaaattcgacatgattttttccatttagtgttgaataatgaaagtaacatcgaaataaaacagtctttattgattcaggagaaatttcaaggccttaggcctcccagtagcccccaagaaatttccatcatccatttaatacataaggcgtattatgtgtagatccattgattaaggagtggatggaaccaagagaaagggaggagaatttacgaatttacgttatccttattattcaacaatttaaatatcttgaaaactggaaattgaacaagaaaatcattacatataaacgcaggttagatgggatggagtaaagtggggggaaagaatgttaacgtcaataaatttgcacacatcttacgttttgaaattagagaagactatatgcttcataaaatggggtactttgtcaataattgatcattccctttttgaaagctcccttttgcatagttgtatgcatattactccctttgtttcatattataagatgttttgattttttttcttagtcaaacttctttaaatttgatcaaatttatagaataacgtatcaacatttgcaacaccaaccaaacaaactatcaaaatatatttaatgttagatttaatgaaactaatttagtgttatatgatttgttacatttgtgtataaacatagtcatagtcaaacttatagaagtttgactttgaaaagtcaaagcgtcttatagtataaaacgaagggagcaactattataacattgtaacttaatattcaaatgagaacatttgcaccatagcattcagtgttggtgttaagtctggatttttttctttttgtgatgatgtttgtgatgaacagttgactatacgttggatctaatggcagatgttgaacaagttctcatgcattgccttggctggagtagcaacagagtatcttttgtatggatatgctgaaggaggactagctgacattgggcaagtatgtaggcatgggtagtcgacagactctgaattttgatagccattgtggaaccacatcaacattgtttattttatgcgtccttttttttttttttttgcaattacagctagatggattgctcaaaggtctaggtttcacccagaagaaagctgattcacaggtgagatgggctgtgctgaatactgtacctgcactgcgtcgccataaaaaggccagatcacagctcgcggaggcaatgtcctctgggaagtcagttggatcttgcatcggggtcatagaagagaatataaactctgaggatatttagttagtgactataaagatgatggaaaatatagatcacatatgtacaaactttcacaatggactgtaccttttaacttgggctttgtatttagtctgttagcaggaaatacatgtcaaaatcatggtttttattcagtttcatatattaaacgtttaagtctacgttccggaggtgggataatgatattttatggtggatgcttgatgatatatactgttttttatgtttttgctatgaaggtaatgaaaaaagtaccgtttgtctgaacaatttgtattttctgattttacgtaaagacatgaaggggggagggaaaggataggttcgctggctggatgcataactgccatgattttaattcaatagtctctagagagttggtcagaattgtgttccacagcatggcttagagcagagatgtaccataggtctaaaaattacttagatactacatccgatttaaaatatagtaatttttagctatatatttggacatacttctcagataagccagaagttattatatttagggacggaagtggtagctaccatacatttttctcttctgataggtgctatactccaacgacattaatgggagctcctgttgcatcgacggtgttcatcaatttggtcaggcaaatctcctgttgcaaaatacaccatcaacgggagtatatacaaacgatgatctctttttccctgcacgtttctcacgctgaagttcagttgaagttttttttttttctaatcattattaacaagttcttggatgtccttggtaatcactatccactggagcacagagaagctggcaccgtagccaatctctactcgtattagacaatcaagactaacagaggagatcaaacaaggtgttgacgcgaaaacctgtgtcgaaaggttcacaggaaagtgtacttagtagatgaactgcaaaatttcaagacctaaattat

SEQ ID NO: 40867 - DNA, 1159 bp, Oryza sativa
ctacccactatctcgcgaatgaggtgataccgccgtaaaatgtgtttggacttttgatgcgatctaagctccttggcttgcgcaatggcaccactattatcgcaatagaggtccatagggctagaagcactagtcatcacacctagttgagaaacgaatttctttatccaaacagcctcctttgctgcttcagaaacggcaatgtattcggcttctgttgtagaatcagccactgtatcttgcttggaactcttccaactcacagcgcctctatttaggcagaacacaaatccaaactgcgatctaaaatcatctttgtcgatttggaagcttgcgtcagtgtaaccatttacaacgagctcttcctgtcctccatagactaggaacatatccttagtttttctcaagtacttcaggatattctttacagctatccagtgactctcacctggatctgattggtatcggcttgttgcactaagtgcatatgaaacatctagacgtgtacatagcatagcatacatgatggatccgattgccaaggtatatggaatcacactcatcttgtttcgctcatcagtcgtttgaggacactgattcttgccaagattaatgccatgtgacatcgttaagaaacctttcttagaatcttgcatgttgaacctcttcaacaccttgtcaatgtatgtactctggcttaatccaattagcctctttgatctatctctatagatccttatgcccagaatatatgctgcttcccctaagtccttcattgaaaaactatttttcaacgatgtcttaacggattcaagcatatgaatatcattcccaatcaataatatgtcatctacatataggattagaaacaccaatgcgctcccactaatcttcttgtatacacaaggctcttcttcgtttttgacaaagtccaacgccttgactacttttgtcaaaacgaatatttgaactccgagatgcttgcttcaacccataaatggatttctgcaatttgcatatctttttagctgattgtggatcaacaaaacccttgggttgtgtcatgtacacatcctcatcgagatttccattgaggaaagctgttttgacatccatttgccatatctcataatcgaaataggcagcaatcgctaaaaca

SEQ ID NO: 40868 - DNA, 3069 bp, Oryza sativa
tctaaaagcataaacagatctattaacaattgatttagatatgcattagcttcacagtttgatggtagtctaaccttcgttgccaaggcccatctgtggttcagcatataaacatgcttctagctccagcatgaacaatttgattcgaaccccatcagcagtttcatacttcagcttaagatatttatatcttgggattgattctatgctgcgtgcaaacccacaaatgcaatattcttttttttctctgcatcaaacctataggtttgtgcatcgcagaacgatgacaccagactctccattttcgttgggtggctcgcatgctcagggacatccaatcttcagtgtctatgccgtactcatcgcgccactccacatcagcattaacaactgaagcattctccattctaccggcaatgatatcatagataaataaaattcaatagcccatacaagacatagccaatcatatcaacaaacacttcttataaaataccaacatctatctagccatttataacccagccacagttccggattacattttaaaaccatatgccttcaatctttcctctgctattgagtgcaaacttatcactcaacattgctacatctaagaaggcaatcttttgtgtatggaactgacccctccttagtaccaaacaacttcgcaccatcttgtgacttaaacaaaaggatataggattggttaaatgcatttacatttttctaatactcgcatcgcactagtgttgctacagtcagtaccatagcgctagagctatgtgaatccaagttgctctctacagtcgatgaaataaattaaaaaaaacacacacatcagccatactacataccgagacattatgttgcaaataaactacatgaaaacaccaaacgatcctatcatcccattcactggcagtgaaaaaccttacaaaccttgacgcggtgatgcgacaccccagattccactcctccctgtacgttccccaaaatcgcagcctaacctccaccttcaactgccctagatcacgctccagcaacaaaaatccttcggatctacacgcatcggtgcacgcaccagtcaccaccaaacagcggagcaaaggcagcggaacttccgatgagaacaatggaacgaatgaatatcagccgtacaaaaaaggcagaaatagggcatcccaaaacagaaacctaaaaagcccatatacagcctctatgtccatactcgcaggcccataaagcccatgcacctctctcctaattgtctgcgcagtcgcaggtaggccatcatcctttcgctagcaacatactatacaacatagtggctgcacattcagttctgtccagcactgccaaacaagtgctgcgcgcaacgcgcgcgttcgcccctagttcccttaatcacttcatcaacctcctgcattgtgaaaggtcttatcatgtttgttttctcctcctccgaaagtttcagtcccgtctcccatacatgttcactcaaatgcacattcctgcatccttcccttccaaacagattcttataatagtcatatatgtttctgaatttgagagaactcagaaattatatcttccccattctgaagtgaaaaaaaaatgtttcttcctttttttctcccattagccaccccatgaaagaacagtgtgttagcatcccctgtaagatccatttctctcccccatcttaactgccactaaatctcctcctagaaataaatcttctctacttcttttttccagatcatacctttctatccattcctgttcaaatagatccctttcatcagcctttgaatcaatttcaatcagtctctgctcaatcttttttcttctcttttttgtatcactcaacatgttggcaccccaccctcttaaccatctcctcatgcaaggcatcaggagatgccagtaatctaaaacccctttctgaagtctcataggccagcaccccttcagctgatccctaaaaccctattgttggaaccagcccatatcatatctaaaagaattgcttttgcatctgtcttcctctctggtgtccagcaaaatgggacggtgatcagaccccacccttaataaagaacaaactaaggtgagtggatttttttttatcccatgaattagaagcaaagactctgtcaaggaccaccataactggacaattttgtttatttgtccaggtaaacttgccaccaaccctatgaaactcttgaagactatgatcattgatgaacttattaaacatttccatccttctctcatctacaatcccattagatttatctgagctatatatgtatatgttaaaatcacctcccatcaagaaagggtacaatcattgagaaatttcatcccccattttcgccaaaaaaacatctctcccttcctggtgtgcaggtccatatatatactattaaaacatattcatgttacatttattgaacctaattttatattgtggatgttactagtttttttctacaaaattagttaaacttaaaaaaattaactgggaaaaaaaaatcaaagtgactatagatggccatatggcccgagatccgtggcctatcccaaggcacgccattttggcccggcccaagcatgacacggcctgactggggtcgcgcccgtgctgacccggcccgacagtcggggcgtgcctaggctacaccctcagcatggtgggccggcccggtatggcacgatagaagaaaatagtatagggacgaaaaatatacttaaataaccatagaaggcatggcccaaataaaagaggaatacaaaataaacttattttccagctatatgaacatagcccatagagtttagggatgaaaattagacttattgtatggagaagcacgatatactgtcgtgccttcgggccggcctagcacggctggagtcgtattgggccgtgactgggccatgtgtgcagcacgtgggctggcacagcatggcccggcatgtcggttgggccgtgctagcccaattaacctcggcccaggcgggcctagaccatgctgtgtcggacggcccatatgggct

SEQ ID NO: 40869 - DNA, 7418 bp, Oryza sativa
atctggagcgccgcgtccatggagccgctcttctcggcgccttctcgccatgcttccatggttcctcctcctcccatctgccgccgcagcacagcaggttttcccgtgatcctaactccaacgtgcaaaactgcagattactacgttctagaaacactgaaatcaactgcgcgtgaaaatttagcgaagaggtgtctgcggcggcggcgacgcgcgagcaggagcagacgctgcgcttattcctccaagacatcgagagatcaatcgtcttcggaatctgcaagaaccccgaaacaacggagttcttccgggaccaccggcgacggctcgacgactacttcgccgccgccaagaacctgctgcagatgttggagcaccccgtcttggcgtacggtgatctgcacaaccgcgcaaaatccctcctcgtcacggccatgggctcccttgcagtggagttgtgccacctcaagatctggaaacctgacgctctggcaagttatctcggttgcacacctacatctatctgggagctcgcgaggtccagctgccgcggaggcggcgacggttctggctctgcctcgtcagcctcatggatgagtacctctcgctcctgctccggcggtagcagcggcccaaacggtgtgagctttgacggatattacatggcactcagtgaggagagaacagtgcgaagtggccaagcttcgtcagttacggccagtcacattgacctcaagtcagtgtccatcctcaacaagattgctgatttcatgattggggtcggacacgaacagatgctccgaggagctttcgatcaacacagtgagcatctggtcaggttcgtatatttattgattcagtatttctgttgatcggttgcttgatctttttgtttctgctagctgattgattgcagcaatcgtttgtcctgcacaagttcttgcagccccaaataattgtacctaggcaaatacagtaattaaattgtactacctatttctttaacttgattatttatacgttttgtaaactttatttcgtttgtgatcttgactaatatggaacaggtacattgaaattcttgacattgataaaattttgggtaaccacatggaggaatccacagaattgctattgaaggtctggacatcgacaatgcggactgtctttagtgttctagatgagatgcgaacgcagttgaatcagaaagaccatggaacattcagttcactaaaggtggactacttctctgcaatcgctaaggaatcagtcatgaagctgcttaactatgctaatgcaatctgcattcaggtgggtccaaatgatccttcctgcagggatactcatgcatcagttaagcattttccatccaaaatggtcaatctgttgattatgttccaggcattggagtatgccaagatggaaatcttagatttgttcttgggtcaaactaagggtcccattttaatggaaattgaaaggcttacaaatggattgtcagcagtttttcttgtgctgttggttgaactaaatggtttgctcaggtcacaacatttggtcatttctaacacgggtgtccatcatgttacacagcatattatgggtcttatgcggttgctggttgaacaaaaggacaaagtccatatgatgctaaacgataatccagataaatttggtcaagtagtgactcaactgatctcatccttggagtttatgttggacatgaactctaggagtttggcactccaagggcagcaactggtgttccttctgaacaatataaacttcgtgcttgagcaagctaacaattatactgatctgaagctgattctaggagaaagctggtgcttgcaacgccatgtccaacttgatcagttcttggcaagctatgtcgaagcttcttggacacctgtgatgtcatcattcataataactcgaattcctaaaattttatggccccagcaattgttcgataagttcaattctcgttttgagatgacctacaatgtgcagaagacatggaaggtcacggatcctgtgattcgacagaagctgcgtgagaagatcacccagaaggttatcccattgtaccgaatgtacttggagagctactcggacaagaagcaaaagtctgcgaggttcaatgttgagcaccttgaggctcgattgctggaaatattcgaggggtaaatgaaagatgtgtctgtgcagtaaatgaaagacatttaggacgatgtgttactgtaaaaagttgtgggtgaacttcttggatagtactattgtttgaaagacttagattaatgctctactagtttacttaattggaaaatgtaaatattttgttttagaggtaagactactcaaacaagtattcgtaaatttacccctccttactttccagggttgtacttgtaattgaaatactatacattttttttctctaaatgatactacctccgtttttaacatataatgcaagttgattttttaattcatttgattaattctctttgaaatatttatgcaaataaacaaatatataatgcacatttataatacttttgatggcaaatttagtgatacttttccagtttagttacttattaattaagtgattgaataaatattattagtcaaatttgaataaaagttgacaatgtcctatattaaaaaacaagtatagtaaccaattacgaaaatttggcaaggggaaaggatgagtccaaattgctacaaccaccaaatctgatgtgagagagattttttttatttctatttttttttatttttctactacttgaaaacggagtcatccttctccttcctcaccatcattgttcttgcagaacgatactaccccagcaaaacaatacgtgcccctttaatttgaacggaaaacataggattctttttaagattcatcttttttctatatgatcctttgaaacttgaaaactattgaatcctataaaattcctcaggaataccgcaatccatacaagttttataagatttttaacataaggtcccacctcacggaaagtttcctatgactctatctgtcccatccaattgctacatttttccaatccaatcaaacaatcttctgttttgagcttgaattcaatcgtatgtttttaactatttctccctttttctcgaggacaatgctttctatcggacgcctgattcccggagaataaatcgggtgctgcccttggagcgaggtcacgaagcatctttctgttagcattaaaagccatgcatccatccctctccctctctttctttgcatgcacagagccacaaccactctctctttctgcatacatgcatgtaagttgctacttgctagtatggtttatataattttttctcttaaaatatttatctgatgtgcaatcgaattacattattatatttattataattaaatttttataacaagacctcacattattatattctaatcaaagaaaattacatgcttcatatgttaaaatttgatgtttcatacgttagagagaaatgtttcaactttcaacaaccctctatgtgtttcgatgatgtttcaatagcactttctgatgtttcactaatgcatttacaaaagttgcactcgatgtttttgatgttttagtaagtattttataatgtttgatatttttttatcaaaatataatcatgtgatattttgttgtaaagatttatttacaataaatataatgggtacaatcagaatatatattagataaatactttagaagaaaaaaaatgattcaaaagcttgtttagaaagttgatagagagataggagtatatcacgtaggggtataactactaaacaatatatggtatgggagtttgtatgagcataatagcgctaagggcactcaccgtgcgtatgcatatcttgcagggaagagcatctgatttgtgagaaaaaaaaatcagagtgttcaagtagcctgtaaacagtggtgaagccatcgagggtgttgggttggcatggcaccccaatgccaccccaccctgggtaattagccaccagtttagcatataatgtcatgggattagctgcaaaataaagcagctagctagctgcccaatatttcttccttagattacttgtttacattattaattaagagaaaaatctaataaatgtcattgacaagctgcccaatagttcttacttagattacttgtttaaattgattagtcaattaaattggtgtaatatagcgaccttattttaaaatggtattttttagatatattctactgttcatatagacatatatgaacagaaaatgtgtgttgaaagacgtccagaaccacatcaagaaacatcatataatccttataattataaaaggtcattggacatattaaatttactagttaggtacccatgcgttgcaatgggaaatatttatataaattcatatatactctatcacttgtctctctctcgccccctctctctcgggccgtcggcgcgggtcgagcggcggcggcagcgggtggtcgacgtccgtggccagacagcatgggtcggctccggcacgatgctcgacgaggtgtactacgccatcgccaacaagacctcccgcctcgggttccccgaaagtgtcagcctgacggtcggcatcagcgggtacctcagcggcggtggctttgacctgatgctgcggaagcacacggcctcgccttcgaccacgtccacgacgccaccatggtggacaccaagggaaggctcctcgacaggccgccatggaggaggacctcttctaggccatccgaggcggaggcggcggaaacttcgggatcgtcttgtcctggaagctccggcttgtccccgttccggccaccgtcacggtgttcaccgtccaccgctcaagaaactagtctgccaccaacctcctcatcaagtggcagcgcgtggcgccgtcccttcccaacgacaccttcctccgcgtcgttgtgcccctgtacctcggcacacgcgccggcctcgtcgccgccatggccgacaccttcccggagctcaacgtgacggtgagcgactgcaccgagtgacgtggatccagttcgtgctctacttcgtgttctacagcacggggaagccatcggagatgctcctggacaggggcaacggcatcggagatccattggggtcatggatgcgattggcgaggtcgtcgtagtggtcgatcgggccgttgtcaatgaagaagtcgacgccatcgccgccgccgcctcgcctcgcttcctccgcagccacgctcttccattgtcgcctcgcctcctctgtcgtgcttgcgaagccgacctcgctgccgtagcctcgcctcatcccgagctccgcctccagcctcctccgccaccagccaccaccctcatcccgagcgccatcccgaccagtggcggaggcggaggcggcggctggaggcggagttcgccgccgccgcctctgcgtcccgtgtggtcgctgcctccgtgtcccttgccgccgctgctcccttccggaccacaacgccaaacgccttcctgccgccgcaccgtgcgtgctgtcttgagtgccgacatccgcaccgccgtcctcaccgatcgcccgtccctgcgccatcctcaccgaccgcccacgcccaccgcccgtccttgccgtgcgcgctgcaagagagagagaggaagagcgagagaggagagagagaggaagaggggaagaagagtatgataggtgggtcccacatttttttattaaataaatgctgaatagctactaagtacatagacttttctataaacttaattaaacttttaagaagtttgactgcagaaaatcaaaacgacttctaatatgaaacgaagagagtattaatttaaatccatagctaactgtagtttttttttccagagcaccatatttacaatctcaattcacaattaaattttacaagagtgtataaaatatagacaaacaaattctccccaggtttccacacatgacaaagaagttcaaccgatttcatcacattgtgccagtaatcaaatcacagaaatctaacagttcacacatcacactcatattgtacaggacaaaaatgtgaaccgattccatcacacatccaatcaataccattcaaaatcatagttagtcagttagtggccaagttcagttggtggaactccacataaagattcaaagtgcagacctagaaggtgtattaatcagtgaacaactgctatagttacatcacaatatatcgcagaaaggtacagaaaattattggacaagagattatatgaatagatgcaaacatattaattccatgagaacaactgtattgccaatacagattactgaaacaccaatagtagcaggaagttccacatcctatctaatttcaaaatatggtataaaataatatttgcagatttaaacagaatttctgcccagaacatgaatcccagggatataaatctgattgttctaattggtcctctgtgacccttatacatgtgaacgcatatttttttgctttcatcccaaatcctagctaagatctgtatctaaagaacaagatgcacgggcatattactacgtcgttgaccaggggatcatcctccaagtatatgacttcaatagtccaagatttttaatttgtcacttctaaacctttgagagaaaaatagcccagcaaacaacggcacatttttgtgctaatgcactgttatttgaatgcaattttttaaaaaggaactaaagcatggcttgcttaaaataggtcacattttatgagcaaaatgatcacgttttaaaaaaagaaaaaataatcgggcgtttgttaatagtaaatcattaaatttctcaaaaaaattatatatttgcaagagggcataagaaaggaagacatgggcgaaattagcatgcaaagagtgcatcatttgagtcaataacatgcacatggctaacctgattttgtacttgatggtgtggagcccccaacaatcttaaccatttctgaaaataaatgagatgatagatcaaatattatgaatttgtgaaacaaccaacagaaatatgcagtgcacacgtttcattgatgacgaggctagcatcttattatgcatctgtttgatagatcaaaaatagagagaaaatagtgaacaaaaaagaatatcaaactactccccaggtttcctcacgtgacaaaatagttcaaacgattgaatggcatctcattgttctaattgctcctctatttaagtatcttaaaaacaagatgcaatggagtgagacactcaactttcgagtcctgatagtacatctcaagaattttagaacaatagtaaaagctcgaaaattcagcagtaaactttcaagtgtacagggcatctttagaaattcatag

SEQ ID NO: 40870 - DNA, 6488 bp, Oryza sativa
agagggcagtagctcttcgatccaccgtcccccaagcatccaacgctactgatgaatagcacatcactggatctcgttccccacatcactgtccatcaagccattagcgagttctcacgtctcatggtcaacacccccaaatccaatcgccaaatcctggcttcagtgcccgtaggcgtgctacactacaaacagtggacgtgccatgccacgacagtgtgtcgcgggctagcggcaacttggcgatgcaatgatgggcttttggctgctcccgtggtctgtgatataacgctccacaaacatgcaagctcaaattcaacttctatatctcgtaacaaaaaaaacaaattaaccgcaactagttaacgtatattcagagtcaaatttgtttttttcgttgcgagatgtaaaagttaaatttttacatgcatgtttgtggagtgatatatcacgtgtaaatatatcttctcaattttttcatagccatttagatcccaccctaaaattttgatatcaccttaaaatttttcaccctgtcacatcgaacgtttgaacacatgcatgaagtattaaatataggcttaaaaaaataactaattgcacagattacgactaatttgcgagacaaaatttttaagcctaattgctccatgatttgacaatgtggtggtacagtaaacatttgctaatgatggattaattaggcttaataaattcgtctcgtagtttatagacagaatatgtaatttgttttgttattagactacgttccgtatatccgatatgacacgccaagacttttcacccttgtttctaaacaccccctacatccaaacaacgaggatcaaaatccacttccggtctgtgcaccgcggccgcggctcagttcatcgccgtcctgagcgacagcgcggccgcaggcgacctgttcctcggcgccgccatgcacacgcggtacgccaagtcgcacctccctttcagtgctgtcagcatgtgcccacactaggaaagtcggtgaatgttgggagtatttttactaaatgaagcacaaatatggcatcgaaccttgcgaagaacactactctgcatggttgacgtacttgcccgtgccaagaactttgagaaggctgaggagttgattaaagaaatgccttttaagcttagttcaattggttggacttcctcgctgagtgcttgtaggacacatggaatcatggatcttagagcaagagcagccaaagagattctcaatttgactccttacagtgcatcaacacatgtggtgctctcaaatatttatgccactgttggcaaatgggaggaggctgcacaaatccggaaactattgagaaatcggggaatcagaaagaagcctggctgcagctggatagatcttggcagaatagtacatattttcgttgccaatgatatctcacatcctaggatcaaagacgtgtacaaattcttggaggtgatgtcagagaagatgaagcttgcagggtatgttccagataagatatgggccttggcaaaggatcatgctgccggaggggagacaaggctaaggcacaatagcaagaagcttgcactagcatttggtttgattaatacagtagaaggagaacctatacttgtgatgaaaaatctaaggacacgtggagactgtcataatgccatcataatcatctctgccataactttcagacagattactgttagagatgcacatcggttccattgtttcagcgatggaagctgttcctgtggagattattggtgagacagaaaagttgactcaaattcataagaaagatgagattctgttttgtttcaatgattacatcggatgaccatcatagttcttcaccacactagactggaatatagtcaatttggtcaaagtagcagcacgtatgtcaaactttcagcttccctaaaaacttgagttgtcccaattgctactaagatcctcagtagaaaagccattgagctatgaatttatctgaagctaatgactcaactagctcacctcacaacccaccttcatggtataaatcttgtcatcttatcttgcataatagtttttacatgatgaagcatttgctgctcaataaattttataccactattgttttttagggttctctttagttaagatcattaagacattgtactacttggaaggctagtaagctgtgatgattaaaacaatattcaatggtaaagattacatgaaattaactcttgttgacaatagaaagatactaaaattaattgtttgctggataatgcaagtaagatcacttacttgaagaagaaggtgttcctgatgctgccacaggttctccagctttcttgttttagtatatgaacacgagtttagcagacgttgcatcccttcatcagtgtaagactccaacttttgaatttgtagatgcttgatgcttgtactgatattacgattccaattcttcactaattaatagtaagagagaaattgatcttttctcgatacaccactaaaagcagtaataatctactaactagttaagctttttattgcggggatactaacatagttaagctaacaacctttagtaaacaaatggtcatagtactatcagattgtgctcagaaattgttctggaactacaaatgatatgactatgtgtctaaaaccataaaaacagattgtgccttgtgaaaagcagacccaagtgggatccctgatcaaatatcatatgtggaataaatatgtttatatgatcagcacatgtattaattcatgatcatgtctcatggatcatggtatagagataccaaattaataatgtggacacatgttgatgaacatgttggatagacccaacatgagacactgcaagagccatatgtgttgtgtcatcagtgatctcattgagtattggtgttgaatccttagacctgagattatcatggttctcaacatgtgtaatagcttacttagggactgctaaacgctactccgtaattgggtagttataaaagtagttttcgggtatgctatgaaacatgtagtgggatatgaataatcaagatgggatttgcccctcctatggagagatatctctggacccctcgatgttgtagattatggaagtgtatggccatgccaaaggtgattgaggagtcaatcataagttatatagtctatcaacaggttcgagtgaatgattgagctattagaggatggcacatatctagccttgagcttaatcgatatcgtgaggcaaaggggttcatacaagtatatactagaggttcagccgatatgatctttatgtatgcccgatgggtcaataagttctgctacgagccactgttgacgcgtggaccgaaaaggagttttcaggttacagccaagtatacatgaacctacagggtcgcacacttaatgggccggaataagaggattggatagagatccaatatgagcttaattcggatagggatccgaatagtagtcctacgggccttggaggcccgagtgatggatcctatatattcgtgaggggtgtgaccggtggaggtcagagaaaccctagccgtcacttccctacccgagcaaaaccctagccgcgcgcgggtgctagcacatctgcacgtggcgttccgtccctgtacgtgtggatactggtagaggcgccgctggtttgcggtgctgattggcgtgggagtacggcgaagagaacgcacgaggaggagaagccgagccagtgcgatcgactacttcctctacatcgacgcgcgctacttcgcgagagttccttcgacttctcagcgtcttcttccgctgcacagcgcgttgagtggtaacgatctatgatctaatacttgcatggttcctggtttacgcgatagaaaattttgatttatgctatagtagcctacgcgtatcccaacagtggtatcagagccgccttgtatagtttatgatctagatcattgcatataattgatatgcggatgtagtagatgagatgtattatgttgtatatgagttcttaggtgatcggaacatgagatgaaccgatagccacatgggttgatgagatcaatcggtatgtatgttggtgacttcactagaatgtttagtactcaccaacgccgagcgcgagtgtgttcatcggatagtccgatgtccactggaaccgcacgccaatgagaaaaacaagccaatgagattgactcggtttcggcataatttgattacgccgttaaggttttcacccgcgggggacggctctcccctcgaccccctgcccgctaaccggctagcgggaccgccgtgtgcgttgccccttagatttcgcttgggttttattatatctatcttactttattgctgttatatatttgatatgatatggtaggatagattccctcagaaaaattaagtaatttatgctcttccaataattgcacctattacggttgtgatcataagtgatgggtttgccatagcaaagtgtcactttttatcatgataaaataggatagatatcggacatctatatgcggagatcattggtttacttgacaaggttatcaaaacagttttggaccttggggcataggttgggttggacatggagatgtcaccccaatagcacaagagtcacatatgatgtgattagcaaggtgttgcttacctattttgatagttgtctagctgtgatgccaaagcttactagacactaataaaatgaggatcttgactcactatgttactagagggaattttatttcacaatacatagtgggagtatcttttgttaaattgtttaatgaaaggttaaatgtaaacatggtgctgattttgcatgcatatatttctattatagatcatggcagctcctgcaccatccaattttaacttgtggtctattcttgagaaagagaagttgactggaataaacttcatggattggtatcgcaacctgagaattgttctcaggcaagagcacaaagagtttatgcttacacagccttttctagctgacttgcccaacaatgctcctgctgctcaacgtagggagcatgaaaggtgatgcaatgaataccttgatataagctgtctcatgcttgctactatgtcccctgagtttcaaaggcaatatgaggcattggatgctcatacgataatcacgaaactacgtaacatgtttgaggaccaagcaagagctgagaggtttaatacctcaaagtccttgtttgcgtgcatgcttgcagaaggtaatccagtgagcccacatgtgatcaaaatgattggttacaccgagagtctggataagcttggctttccccttagccgagagttgactactgatttgattctccagtcgctccctcccagttttgagccattcataatgaatttcaacatgaacaacctgaacaggaccttggcagaattgcatgggatgctaaagactgccgaggaaagcattaagaaaaactccaaccatgtgatggttatgcataagtgcaagcccaacaacaagaaaagtggtcaaaagagaaagctaaactctgatgagatcacaagtactagcaactctaagaccaaggttcaaaagacagggcccgctaaggatgcagagtgcttcttttgcaaggagacatgtcattggaagagaaactgtatgaaatacctagagcagctcaagcagaagcagcaggatggaaagagttccacctcaggtattaatgttatagaaattaatcttgctacttcctctactgattcttgggtatttgataccgggtcagttgctcacatatgcaaatcgttgcaggggctgaaaagaagtaggagcttagcaagaggcgaagtggacattcgcgtgggcaatggagcaagagtgctgctattgcggtcggcactatgccattatctttaccgtcaggattagttttggaattaaataattgttattgcattccagctttgtgtaagaacgttatctctgcttcttgtttgcaagaagagggttatggttttagatctgtggacaatggttgttcagtctattataatgacattttctatttccatgcacccatgatgaatggcttatacattgtgaatcttgatggatgtttagtctataacattaatgcaaaaaggcaacgtctaatgatttgaatcccacttttatttggcattgtcgcttgggtcatataaatgagaaacacatggagaagcttcatagagatggacttctacactcgtttgattttgaatcatttgagacatgcgaatcttgtttacttggcaaaatgacaaaggcacctttcgcgggtcaaagtgaaagggcaagtgaactattgaaactagtacatactgatgtatgtggaccaatgagctcaactgccagaggtggttttgggtacttcattacctttaccgatgactttagtagatatagttatgtctacttaatgag

SEQ ID NO: 40871 - DNA, 1043 bp, Oryza sativa
cttttaaatataagtgatttatatctgtccaatctatcccaatcacttagtttaaatatattttgaagcatagattatatattgttaatatctacagccgagaaaataagtttagttctttatcttctatatacttcattgctgatccaaattatattgcatcggcttgacattagacgatacctcatcggcaatccagccgatcggctatcagttgtagatttaactttggtttctttgtttttttgttggttgcaggatcaaaccaactggcacgctcaaaacccgaaagaaaatatttggatctgcactagagtaaagcgaatctcttatgccagtatgtgttttttgcatcaacaattactctattttactatataaaatttaaaatacgtaattcaaacatataccgaacaacaatggaacattaaaaaattggtaatatatattacatcatcttaaatcattctacattgtaaaatttaaagaaaatacaaagccattaagtcactacgtatgacattttaaaaattagaaaaattattgaaattaaaagaaaattcaaaacatctaaccatcagtttctacataaatcaatgacctattaatattattttcaaccgttaaaattacttttagaggaaagcttaagccacgacaagccacatattaaaaattaggaaaaaaatcttgcaaatctgagaaaaacaacatataaacatcagctttcacttaactcatttataaaaaatataaaaataaggtcaactccacctcccccctgatgtgctatccaatcatatattgtttagcaaacatgcaaaactacattagatatataataccaaagaaaaaaaaatcccaaatatgaatagtcctagccactgcataaaaaattcgaagggacacactccattgtccttttacatgtcatccaaattgccataaaaattataaaatgatttaacaacacatattttaccatcatacatttttttgtaagcatgcatagctaaattaagaaaaagaaagctagcttgatg

SEQ ID NO: 40872 - DNA, 1061 bp, Oryza sativa
ctgttgtagattgagttagaatctaaaaattctctcctaagtatcttgttatgatctcaagtgagcctatttttcaaaaacaaaaaagcatgcgcgcgcgcgcgcgtgttattagcacaaatcatctaaaaaatatcttaaacgaagaaaaaaaaatttataattgcttcaggtattgaggaataagggcagctatggcagcagcatttcattttatgcatcttacaatcattttcagtttgcagtaatcatatcgaaaaatcttttgtataatttagagttgtttgtactagaacaataccctcagactcagaattaggaaaatggtagatattccaaactaattttcagaaaagtatcatgattgacattacattgattgcagcagtttattgttctttccagtataagatttgcaaaacattcttaaatatgtgataatcaaaattatgatggcttcaatttataaataccatatgcgcagaatatattagctaattaaagattcaatactataactgttgggatacgcgtaggctacgatagcataaatcaaaattttctatcgcgtaaaccaggaaacatgcaagtattagatcatagatcgttaccactcaacgcgctgtgcagcggaagaagacgctgagaagtcgaaggaactctcgcgaagtagcgcgcgtcgatgtagaggaagtagtcgatcgcactggctcggccttctcctcctcgtgcgttctcttcgccgtactcccacgccaatcagcaccgcaaaccagcggcgcctctaccagtatccacacgtacagggacggaacgccacgtgcagatgtgctagcacccgcgcgcggctagggttttgctcgggtagggaagtgacggctagggtttctcacatgatgcaatacctccaccggtcacacctctcacgaatatataggatccatcactcgggcctccaaggcccgtaggactactatttggatccctatccgaattaaactcatattagatctctatccaatccccttatttcggcccattaagtggggctgcaggaattc

SEQ ID NO: 40873 - DNA, 1351 bp, Oryza sativa
ctctatataaggacttcactttctcacttcactcacacacctcaagcaagagctctctcatattctctcaagttagtatagtgttatctagctagtggagtaggaatacagtagaaatctaaagtctggaagccttcggaagagttcgcgtatggctctagtagctttcctttccttttttgtaagctttgtactttatttagaatactcttctttgtacatttatggtattgaaatactttccgactatatgaatgcctactttaaattatgttcatgttatactgaatatgctgctagcttatctagaagatgctttggtgcgggtataatgtttgtatatgcaattactctatgtcatgacgatgatattaaagtagtatctggtagtttagacgtggtgtctagattacgggatatcattatttggggttatatgctgcggatgagaggtgggccgctgatggtgatagctcagtacgggtattcctccgtatttagccccggttgtatggtcatgacgggctgttgtaaggaacttgacagtcagggtggcttctcgaagtactaggagggcatcgaatagagggtattagctagtatatcatataactagaatgtatgtatactatgtgtactagaagtataagaatagattctctttctcttttctttccacttagctaggaaatttagtatgagaataagtagctactgcttgtgtgtgactctacccttggattatcttaacccctacttagactttgattttcacaagtaacatataaattattagtcaggttctctctatatgatcttcccacgggataaaataaatacgatacccttggaatactctcaggtgaaatggtacaatggtatattcgtgcgcttgcggatgaactttgtaaccataatataccaggagtatttctccgccattgctgggaattatatttctggtaatgtcgttaagaaatatcaacaatcggcttctccctatccaactcggtatcagccgatgcagacggtagccgatgcgtactctgattttgagaacaacgaactccttccaaatccgcttcggcttcaactccaaatccaatatatgatttgcgaaatttggttgtgatttacttacttaattacaaataaaataatagttcaagcaaattgaaaaccagatgttatttgtttgccatatagaaggatatgtgtgtgttaaaatggtgcaatttaatttttttatatagtaaaaatatgtgtaatatggatcataaattatttacttatctacttataaaataatagttcaaaaaattaaaaatcagatataactttgttagttgtt

SEQ ID NO: 40874 - DNA, 10870 bp, Oryza sativa
tttgtgcggtgttctacagctaaaaccacaaagtcgtgatgtcctgtagcaaaatttgcctaagaaaaagtatacgaagtacatatacggggaggagagattttttggatagatccaatcgaccaaccaaatttatctacgacagatctaatagccaaaataatgggtccatcaatttaactggaaatcaaaggttggatgtttttttttttgaaatttctaggattttttaatttagtgccacatggtgatatagtaatgtttggaggatgtccatgtggtggcttgagagagtttttaggaaagtatggacttttagtatataactaggaaaggtagcccgcgcacatacgtggtgttttcgctaataatttgtttgggattaatttttctctgttagttatgaatttcctatagttatccttgcaacatataaattctaaacttaaattacctacaattgagttggttcctatgtatcatttgtagcgtgcacatatcttttagaatatttttggcatattttatttttggagttccaaaactttaagtaacattattttcttgtatacaatagttgtcattgtggatttaaggatatattaactaaagatattttgtgttgaaaaatatggttaatagcattgtttcatataataaaaagattaaagtgcactggcggtcatttaactttgcgcagctgtgtcaagccggcccccaaactcgcaaaacgggcatttaggtgcctaatcactgttcgggtttcactctagtccaaccgggcgctgggacatgcatcattttgcagtaagccccttgactgttcgtgtggctctctcatttctccccccattagcccacgactgttcgtgttcctcggcggcggagacgaatccgaggcgaggacggtggagctcagagaagcggagtgcgggttgaagccagccacgctggagttgtccgcagcggctggttagaaggatgttgccgcgattgcgagggaaaacagaagggccaccgtcatacggtgagtccatcttccctttctacttgttatttgctaggtttgtggatagtcgtcatagttgcagggcttcaatttgacgaaggaatggatcttagggtgtggattgttgtttatgatgtgatttgttagggttctccatcttctgatgaactgtgttaattcctgtcgataatgtaggtcctgatagtgatgcattcaccattgagttgcaccatggaggtttttttgctgggtgcggtcatcttaggtcttatgttgatgaaaaaattgactggtttgactggattgattgtgatacatggtctgccttatggtttgaggatatgtttgaacaactgggctacgatagtgtgacagacattaagttttattggttgtttaccagggaaagatcttagtgatgggctgagggtaattgcaacagatgaagatactaatgtaatggtcagtgtagttcgcaaggtgagaaatctggttgtgtatgttgatcatataggcagtatgaacagtgttgactgggatgactatgttgctaatcctgttaattagttgcctaaggttttaagtccacagaaagttgtgtatgagaaaaacccagcacaaaagagtagaccaagctggaccaggccaacaacctgatggagatgaacagcaagaatctgatggagatgaacaacaagaacctgatggagatgaacagcaggaattgtttgacagtgactatgatcttagtgatggagatgatgacttattagaggatgctgttaacttggatatgccaaaggttagaggcaacaagaaggcaaagcgaagccatttgaaggctattgagatcagagtacctactgcagtagatgatgatgcagacacagaggatgatgccctggatcttcctgagtctgatggtgaaggagaagagagaatgagattcaattcttggaaccaagaggacatgaacaacccagctttctctgttgggcttgtctttccttcagttgagagtgtgaggaaagcaattacagagtactctgttaggaacagagtggaaatcaagcttcctaggaatgataagaaaagagtaagggctcactgtacagatggttgcccctggaatctatatgcatcttgggatagcagagtgaattcttttgtggtgaagacatattatggaaaacataaatgccagaaagagtgggttctgaggagatgcacctctagatggctggcagacaagtacatagattctttcagagccaatgagaagatgagcgttactagttttggtagagtcattcaaaaggactggaatttgacaccttcaaggagcaaggtagctagagcaagaagactgatcatgaaagtcatccatggtgatgagatcaagcagtatgactatctctgggattatgcacaagagatcaggaggagcaatcctggcagctcactgtatctgaacttagcaggaaatctgtttagtacttgcttcattgctttggatgcttgtaaaagggggtttttggctggttgcagacccctcatatgtattgatggatgccatatcaagacaaaatttggaggcaaactgttgacagcagtgggaatggacccaaatgattgcattttcccaatagcaatggctgttgtcgaggtggagtcatttgtttcttgggagtggttattagagacattgaaatctgaacttgggatagataacacatacccttggaccataatgactaataagcagaaggtaacccatttgctacttgaatatctcttgtctgtattgtctgcaagtgtactgactaactgatgcttgtttctctgcagggactaattccagctgtcaagaaggtattccctgacacagagcataggttctgtgtgagacacctgtactctaactttcaagaaaagttcaaaggcgagattaggcacctaaatgcccgttttgtgagttaggggaccggcttgacacagctgcgcaagttaagggaccgccagtgcactttactctaattaaaaataaacttctatttactcctgctcccactttttttatatgcttagttattttctatgaagaaatgaattgaaactaaattaagagcacaattataataatataattagtatgtgtagttaaacatcatagaccaaagtacacttttgttaggtcaactattattatatagtatatttttattgcatgaattttgtttattattatttgtacttgttcctgaattaatcaaacttagtatatggaatatcacataccatgtgtatttaatagactcatgatgtttactcattctgttcttttacttatttagggcattaatgaaagaacacacagcagagaatttcccaaacactatagtcaaagcctctagccagatgtgtatttcggatcacacctagtgtttggtacagattggtacttcaattcctaaggcctctattttcagattagaaaacttttgggtggagcttgagggattttttgagctactgaattcttcatggataaattatggttgctggaatgatgaagaagaaaggcaaattttgctacagatatcgcgacttcatggttttagttgtagaacaccgcacatactcacttttgcgggaaaacactttttaaacatggttatttgtcactggacgcatctattaaaatattaatttttggttgaacaggagagataaatgcagtgaaagattaaaaatacccctgagcccacttgtcatattcttcttcctcctcaattccccttttctcccatatccacgctgccgccgccaacggcgtcctaaccacgggattccgtaacgacgaccgtgctaggctggtgatgttagagtcgacaggatgtgcggcatcttgaggcgatgcggcccactgtggggagccctcaccgccatgggaggaggtggtggctgctgctcctgctgcgattgcgccgcaccatgtcctcctgctccaccttggatgtgcaccctaccgacccccgcaaaccggtgctgctattgccaacttcgtcccctgcattgcatgctgccgtcgatgctccctgcatcctcttaccgcgcttcacttgatctatgccacaactgccaccgccgatgtcatcgcttcgggcatgggcgacgtcacgcggtgtccccgcaccgccgccgtcctgaccgtcctcatggccgcaccgccacgcttttgtcatcgccgtgcactccacccgctggtcgcgacaccactcatggcttgcagtcctcatcggagaagagagaaaagaggcagacagaggatgagatcaagaagaagagagcggatgaggaagacaaaggatgggcattttggtcactccgcataaaattatgggccccctatcgcctcgtcagcacaaatgcattattttaatcagtgcggtgtccgttgtaaaataaccacgtttagagcgtgttttccctcaaaagtgagttcgtgcagtgtcctacaactaaaatcacaaagtcgtgatgtcctattgcaaaatttgctaagaaaaaatatattacagttaaacttaagtgtttgaggaaggcacttaagaagtggagcaaaacattgtcaaagctaaatagcttgataaaaaactgtaattaagtggtggattctgttgacaaattaatggagtcaagatatttaacagtaaccgaatggaacttctgaaagctgatcaaatcaaaagctttgatctacatacatgaagtacaaacagatctactaaataaagatgtaacatatttttgtatatggttgccatgcaaagaatggggtctatgtccaaaccacatacgtctaggatgataatgcataagcacgaagcagaaaaccaatccaaatggctaaagtcatgtatggaaaagaaataaaatataataccaatccaaatggctaaagtcatgtatggaaaagaaataaaatataatgtattctctggtacctcggccttacgctaacgctagattccgaggcttcgggtttcctcaactttgaggttgagtgagtccctcgtcgccaagaaaataagagcacaacgactagggcccaactattgctttttttactaatagttagcggttgtcctcgtacctaatcttattccgtttaactacccgagattagactcgagggtgggtaagatccggagcgaggttgtccacgagctgaggcctctcgaagaatactttcgtgtataacaaaatatgagtaatattgatctcaatttatttgtataattataaattaaataacagttttaaaaattaaaaactggagattttgtttaaaagttatgctcatttaatttaactgtttatagaagtgctagctctaaaatagaagtgctacgcactttagtacttacgtgaccactttgatacgtacacgagggagtgaggtggaggtgatcgtacgtacaggaggaagggaggtgttggtggaagggatttatttttcaaaagatttaatttaatggttaaaaatattgggtccactaaattgaaaatcaaagctgagatgttttgcttttttcttagattttttcggatttcctctaatttattagagtgacacatgatggattatgagcgtttataggatgtgatgtggcggtgtacactggtggagaaaacgtttgtagtcccggttcgtaaccccctttagtcccggtttccaaaccgggactaccaatccgggactaaagatcgctatctttagtcccgggtgaaataaccgggactaaagatcgatctttagtcccggttggtactaaagatgtctcagccacgtggccggctgagccatctttagtcccggttggtgactaaagatcgagctgacctttttttttttgcatggccctgttgctgcaaggtttatatatatatatatatatatatatatctttcttatatatgtttcaatacatatgtacatgaataatatatatgtatttatacatatatatatatatatatatatatatatatatatatatatatatatatgttatgcaaatgcatatgtatatatatatatatgaccaaaatatatatttacattatagaaaatgtgtacacatgcatattgaaacatagtcatgtattaattacaatccattatatgtcctagctagctatgatttcgacgtagtagtagtcgctatctcagaagataatgacctatgaattgtatttctgtcgtagtagaatttacccttgggatcaaggatttattcgttgatgaatcccatgagttgttcttgaaccgccgcgataaattccttgtgtgtgatcaagttatccctcatgcgaataaactatataaatgtatgaaattgattagtaattaaacaaaaaatcgatacgtaatgaaattttgaatttatttgtacgtacatcgagctctcttgtggtgatgatttggtgtgcaaggcagtggcaatactcgcacacatagtagtcgcacaagttagttccctgcttttgctttgcgcactataaataaatgacaaacgacgagagatctaattaatatacacttgtatgtatttgaatcggagaaatataaatgtagagcatgtgtactcacaggaaatttgaacttccgcctaagtctttctctccatttgccacggaccaaatgacggaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagaatgttcgtatgggaatgaaatttggtattggaagacagtaaaattaaactaactctctgttgtacggcaacagtatgaacgtcttgtaatgttgcgccttcaggagatggacgagattgtcctctgtggcttgcggatattggtcgagcattgcgacatttacttttcgagggtcgatgaatccagtatcgaaaacccccgccgtcgggccctttgaatctccattctacaacgataaaagggaagatatattatatatagtctacttatatacaaggacctaattaattaaaggaaacgtagtaagaaatctaattgaacgatatacttacaaaatccagtaactcataatagagacgtcgagggcgtccagctggtatatttcgtagattcccttgaaattgatccagagaatgtcatctccttgcaagaagtccgtgtccctgatcctcgctctgatcatctctctaccggtggcgctcatctccatgtacagctgatggaacttgtacatttgtgtgggtaaggactgcagcagctcaggcttgacaagcggtttaccgagttcgtacatgtatttcacttccgccttttcgattggtgcgtctcgtagcaattgatccgtagttagcccggtgtcattaataaagtcttgtatttcaaaatcttcaccggtcaccaacggctcgatctcctggtttggttgctctccaagctgagggactggtttggactttctagaagatgctttcttgaatgttcgctcatagtccgatagctttatggcctccttggcaggtgcagacatacccctgaagaagttcttgacactcgggtctataggaatgttcttttctggacttcgaggcttcaattgtctcctgacttctgatgccacgtaagcgtcaagctcctcttgcgtgcaatcgtaccctgggtccttgttcttggcggcgtcaactttcgccttctttgttgcccttgtgggggcaggcggtggagcttagggggcccttgacttggaaggtgccaaaagaggagcttgcggaggagtcggtgtaggagcctgaggaggagtcggtgccggagcctgaggtggagacggtgctggagcaagaggaggagacggtgcaggagcctgaggaggagatggcggagctggaggagatggtgcacgagacgccgcttatcgcctagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgactttggagtatcctgctggaatcggcctgtagtggtaagtacttgaagggtccgttaggatggccatgcccgacgccaccttcatgtggtgagaggttatttattagtaatcaacatatataagaagcaactagcggaatggccaaatctaaaatctataaactacgagcttacctttattgataagttcttgaagggaatatgcagctcacatggtgtccgctgagtgatgtcatcaacggggcaggtggtttcgtcctgggtttgcatggcgtccatgctctgtgatcctacctgccccgttgaggcgcagctgctacgatttcctcacgggctcaccattgcaggaggaatggtcggctggggatcatgggactgatatgcggccatgcgttcatcaaccttccttgccacctcctcttgcatgccgagctcgtagctcgataccctgaactcaagatctgcaatcttcgcctcggtatctctcttgctcctcatccgactcctgtacgtgtggatgtcctccttgaacccaatcttccaaggaatcacccctttccctcgtgttcgtcctagatgctctggagtctgcagggcgagtgacagctcgtccttctctatgtccggtcagaacgtgccctgagaagaggcttccactgcgtctgttagtcgacgcgcagccttgcgtatctaatcgccgaagaccagggagccatcagctgggttgagcgttccaccatgagcatagtaccagaacttcgattgttccggccaattagcggtgaccggttcgatacccctctcaagcaagctagcctccatctcctcccacttcggcatcgcgacgctatagccgcctgaccccaagtggtgatggtacttcttcttggcggcattttctttgtttctttccatcatcgcctgcccttgttcacctgtcttatatgcaacgaactagtcccagtgatcccttagctttaggaatgtgtcgaagttcggtgtctgccccttcaggatatatttctggtacagatctcccttgaagctctgaaactgttctgccattttcttcagagtccacctttttactttgtcctctgtacccgcgggaagggtgaatgtctcgagcattgtggtccacggcatctctttctccgaatctaggacaaagctctcatgatctccgcgtgcccttgttctgcgccagtacaccgtactgacaggcacgttatcccccacaacccaaccgctgtgacgtacatagttcttggtggcttctgccagggcactaggtcggccgtcttagtccacttccgttatgatgtgccgaccctcaagcttcttcgcggcacctcgttgcctgcgtgccctcttctgtccagcggagggttgacttccactagcctcctcctcctggttcccctccacatccctctccatgtgcccctcctggttcccctccacatccctctccatgttcccttcctcattcaaatactggtttggatcctcgttcccctcttcttcgttccagtactggctgcttcaatccgctattgtatcgtacaatatatgttcctcatcgcgattagccatctgttcatacaggaaacagttgctaagtcatgagacatttatgttttaataatcttatatgctaataatcatatatgctaagtcatatatactacgtctaactgtcgtatatgggaagtcataaatgcttagtataactgtcgtatatgccaagtctaactgtcgtatatgctaagtctaattacaaatctaataatcgtatattaaaacaataataatcttatacgaaaactcaaataatcttatactaaaactcaaatagtgatatatgctaagtctaggtgacgtatattataggaccctagctagtcaataattatatactaagtctaattacaaatataataatcttatattaaaactcaaataatcttatactaaaactcaaatagtcatatatgctaagtgtaactgtcgtatattagaaccctacacaatcttatatgctaagtccaattacaaatctaataatcttatactaaaactcaaatagtgatatatgctaagtctaggtgacgtatattataggaccctagctagtcaataattatatactaagtcttattacaaatctaataatcttatattaaaactcaaataatcttatactaaaactcaaatagtcatatatgcgtagtctaactgtcgtatattagaaccctacacaatcttatatgctaagtcttgttacaaatctaataatcttatattaaaactaagtctaagtgtcatatattaaatctaatagtcttaattgcattacaaatataacaataatatatataattacgtcacttgcctgcgcgaattccttcgagggctagctaccactccggcttgagggacgacgacgacaacgtcttttctgcaacatacaaaaagatgtattaggataaacgcgaagtaacatatattgcatttgacgttcacgtttcgttcacaatcgttcacattcgcgttctcgttaaggtcacg

SEQ ID NO: 40875 - DNA, 1910 bp, Oryza sativa
aaagatattttcccactatttcgaaatttttttaaacccggttagggttaagaaccgggactgctgacaagcgcactgaatattaatttccattacatatgtgtttctaaaatagaaaataatgcattaaaattatttgaagtagaaaaattaatgacaattacttcgaaaaattattgttgtctgtaataaattaagtggataaaacgtaataagcaaatatatgatttaaaagtaataaaaattctaataatcatatatacttagcatatgaatgatattaaattgttaaaaactctaattaacatatgtatatacatacgccatgcatgatttagaattaataaaaattgtaataatcatatataattagcatatgaatgatattaaattaattgttaaaaactctaattaacatatgtaaatgccacatgcatgatttaaaaattttaaaaattcgaatagtcatatataattagcatatgaatgatagtaaattaattgttaaaaactctaattaacatatgaaaatgacacctgcgtgatttaatacttttaaaaattataattatcgcatataactagcagcatatacatgatataaaagtgttaaaacctctaataatcgtgcgtaattaacatatgccatacaacaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgatagggtcaatcgtcaccgtgaaagggggttgcccatccaactgatcgtaatccttgtctgtcttgtcctcaactccgacgatttttcttttgcttgggagaaccacgtgatgcttaggctcgtcaggccctctgcccttctttcctttgctagacatgtccttcacgtaaaagacttgcgttacaacattggcaaggacaaaaggttcgtccgaatatccaaccttgttaaggtcaaccgttgtcatcccactgtcatcaatcattacgcctccactagtcaacctaacccattggcaccggaacagagggaccttgagaggaccatagtcaagttcccatatgtcctcgatggcaccgtaatacgtgccagttgttccatcgtgtcccatggcattgacacgaacagcgatgttttggttcgtgctcttcatgtcttgggctctcgtgtagaatgtgtacccattaatctcatatccctggaatgtcgcgatcgacccagacagtcccctcgccaggaaggcaagttgttggttgatcgactcgttaaacatgagatgttgccgtagccacgcggggaaagaatcaatgtgatgccgtgtaatccatgcatcggacttaccgatgttcctggcacgaactagagccaagtgctcctcgatgtaaggagctaccaatgaagattgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggct

SEQ ID NO: 40876 - DNA, 1075 bp, Oryza sativa
tctagatactccacgaatttaaagcgaataataagcacgaaggagaagaagttcacaaacctaaagtctcatgactgtcacgtgttgatgacacagctgctaccagttgtaataaggggtatcctcccagacaatgtccgggcaacaataacaaagctatgtgctttcatgaacgcaatttcacagaaggtcatcgatccggatagattagaagccctgcagaatgatgtggtgcaatgtcttgtcagctttgagttgatatttccaccttcattttcaatataatgacgcatctgctttgtcaccttgtcaaagagatcggtattctcggtcctgtgtacctacacaacatgtttcctttcgagaggtacatgggcgttctgaagaagtatgttagtaaccgtgctcatccagaggcaagcatcaccaaggggtatggaatagaggaggtcattgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattgcggtgccatcgaggacatatgggaacttgactatggtcctctcaaggttcctctgttccggtgccaatgggttaggttgactggtggaggcgtaatgattgatgacagtgggatgacaactgttgaccttaacaaggt

SEQ ID NO: 40877 - DNA, 5124 bp, Oryza sativa
caatgaaaatactaattataaaaaattttcatataagacggagagtcaaatgttggcacgcaaacccgtggtttacctttttttttggatggagggagtaaatgatagtgtaaatcatcatataattaagtacaccccctctcatctttcccttaattaatttctatcctaatctcgtttgcggacacctgaggcaacgtttatgtatgctaagtcaacgttgacatagagttaatcagcgatcgatcactggttgcagatgctagcggcaatatggcaatactgttaggctgcgttcgggagttatagttccctaatcttttccctcatttttcgcgtgtacgcttttcaaatggctagacggcgtgttttttcaataaggaagttgctttaaaaaattatattaatctattttttttaaaaaaataacaaatacttaattaatcatacaataatagatgcttcattttgcgtgctgggacaatccctctggaacacagccttagttatatgcagcacagggcagggccacgggacatctatatatgtatatgctcaaaaacatgagttttatgtccaaacaagaaggaaatatttgcattgacaaacacaagacccccgaagaaattaggatgactcccacacgggagtggattctaatccctcaaggggatatcccctcgtatatctttttttttcaaattcgatgtaaatagttgtgaaaaattctaaaaacaattgacaatgtagagtataatgatacctattagtccaccaaaattcatgttcaaattcgatctacacatcgagaaacaaaaaagacaaatttagatataaacagtgcactactattcatacgctgaatttgtcctttttatatctcgacatgtgagttgagtttgaacttaagattttgggaagttgtatatatgtgttgtatgaatgttgtcaaattttttcagaatttttgataaccgtttagatggttttagagcaaacgaggaaacatcccctcgagggattagaatggtttcccctcccacacccacgatgcaacatgctgctgcgagtgtcctgatgctacttgcaatgactatctacaactgtgactcggcaaatctgaggctgcagctctcgcatgtggacgccggccgtggactcacccactgggagcttctgcgccgcatggcgcagcgcagcaaggcccgggccactcatctactctctgctcaagctcaatcggccggccgtggccgctcggcgagcgcccccgtgaacccgggagcctacgacgatggcttccccaccacggaatacctggtgcacctggccgccggcacgccgcggcaggaggtgcagctgacgctcgacacgggcagcgacatcgcctggacccagtgcaagcgctgcccggcctccgcttgcttcaaccagacccttcctctcttcgacccctccgcttcgtcgtccttcgcctagcgagagcgagactactcctccctgcggcggcggcggcaacgacgctactagctgggcctgcaactacagcatatcctacggcgacggctcggtgacacgaggcgagctcggccgcgaggtcttcacgttcgcgtccggcgccggcgagggatcatcggctgcagtgcctggcctggtattcggctgtgggcacgcgaacagaggggtcttcacctcaaacgagaccggcatcgctggcttcggccgcgggagcttgtccctgccgtcgcagctcaaggtggggaacttctcccactgcttcaccaccataaccggatcgaaaacgagcgctgtcctgctcggcttgcctgccaatctctacagcaacggccgtgggcgtggcgccgccgtcgtccagaccacccctctaacccacaactctcgccatccaaccttataatacctgtcgctcaagggcatcaccgttgggtcgtcgaagaggcagctaccggtgccggagcacgccgcgatcatcgaactccggcacgtccatcacttcgctgccgccgcgcacctaccgggccgtccgcgaagagttcgccgcgcaggtgaagcttcccgtggtgcccggcaacgccacggatcccttcacctgcttctccgcgccgctgcgggggccgaagccggacgtgccgacgatggcgctgcactttgagggcgcgacgatgcgcctgccccaggagaactacgtgttcgaggttgtcgacgacgacgacgcgggtaatagtagccgcatcatctgccttgctgttattgaaggcggcgagatcatattaggcaacttccagcagcagaacatgcacgtactctacgatctgcagaacagcaagctgtccttcgtccctgctcagtgcgaccaactttagactcgcatcatcgccctagccacgatcgagcccacgacatccgtacatcgtccgtgctcaatgcgataaactttatagtcgcgtcagtcatcaccccctagtgtggccacgatgtgtttgccatctatgttttgtttcacttactaatctacgtgttaacttgttatatatagctgaataatttggtgccatacttagtttacaccgtgtaaaatccttctcttttaccttgaggacggtcaggacccaaggtcatataacacgaggcaattagcagttcaatctatatatgcacgtatcgtgctgctatctgtatcaaattcattgccgcggaggctgcaaattttcctttgcgaagaatattcagggaatcagctatgccaagtggcgaagccaggatttgaggttgaaagagtgttaggggataagtcgtaagacctaaccgtagcaaaggaggctaaatattcactgtcgataacaatcaatgcttaactagtcctttaaaaaaacttaaaatttagctctttaacaataataatcactactagaaaaataatttttcatgacgtcacactataattttcactggcggttatatgctaaaactactagcaaaaacataagcagaggttgggggtataggaccaccagcgaaaaccgattttctctggcgcccacgttaagacgtccgccataaaaaatactctatttttcgatgcggacctcttaagtgtccgccaacgaaaaccaacattttcactggcgattactaaacagttcgaccagcgaaaaaacagagcccgctaaaaaaatgacgtcatttaaaatcacgcgcatgctgagatattttccctcacccacccacccactgcctctctctcctctcctcctctccacccacccacccacccacccacctccctctcctcctcctcccccacctctctcccctcctcctttcctgcgcccccaacctcctcctcctgggaggggcgcggcactgacgacggcgaccacgacgggcgggagggcgcggcacggatgtgcacggtgactggcgacggcgacgacggcgaccacgacgcaagcggcaaggacggcgaccacgaagcaagaggcggcaccgcgccctcccatcgtctcctctcccctccgccatatctgtccgaggggaggaggctgccgtcggggaggacggacgcggggaggaaggatccgcccggcggcgcgcacggggagcacggatccaccccggcagcggcgcagggagcacggccacggggcctcgggcggtggagcgcgaccgtcggcctcgaccttgtcacgactgacgccgccgggccgcgggcagtggtgctcggatttctgtggatttgtgtgcatttgtgtggatttatgtggattgtgaatggaaaatatctgttgatttgtgtggatttgtgtggaatgtgaatgaaaaattttgattgcctttattgtaaattgttgatgtaaatttttgtgaatttgtgaatcgaggagtggatttgggaataatttgaatcggtgttgatggaggcgaatggagcggtgttgccccatcattttttttaacctggtcactactttcgcttgcgactggtataacgcaactgccagcgaaaatcgtttttcgctgacggccggtataacacaaccgccagcgaccgaaaattgattttcgctggtggccgatctgctagtgtacaccttgccaactatgtacagcacattttggccacgagtagtgtgcagtccatcatatgaatacacatgtggcagtcattactgtcagtgacgtggcgtaggctatcatgacctatccaggtcaacccgtcacacatcgagctcaatattcttctccgtcacatcaacccatataactcccaactcccagagtcttacgcaacgatcctagagacttgttatcgggtgtgatccatgaaaattattctatattattgaacattatctctgacatcacttgtttgaatacgtagtccggcctacactactaaaaaaaccctcatagggaccggccttataggtgccggttcatttataaccggcacctatgagacttttcccatatccgcacgttgaaaaaatatacaaccgacacctttaagggattataggtgccggttcattaggaaaagctggcaccaatattataggtaccggttttaagaagaacggcacctataatataatatattataggtgccggttaattaaaaaaccaacaccaataatatattacaggtgccggttaattaagaaatcggcacccataccaaaccgagccgaactgggcaagccaagccggcctcatctccgaacttatccgcgcgtaggtcttgcttctcttccttatccgcgcgcgagagaagtctcgactcctcgcgctcctctccaccgccctcccctcctcctcctcccgctcccgcccacgccttctcctccgccgccctcccctttccctccccctccagcacctgccgagtccccctctccctccgctttctctctctccagccggccgctccccccctccgtccccatctcgcagcgacgcatggatcggcggcccgtgacgaggaagagcagatccggtcgcctcttcctctccctctccgttggcttcatcgaaggcggccagatctggggagggggaggtcggggtggtgggttggtggcggcgatgtccggcggcggtggt

SEQ ID NO: 40878 - DNA, 5143 bp, Oryza sativa
ttgtgattgattggattgttgttcactcgggactggtgattgtggttgttgatctatgaagaattttgttgttgttgttgttgaccggatggaattgcatatgtaattgttgttgttaaccggggaattgcatctgtgatttgtgatggaatgcatcggctcggctcggcttggagccggcttcttcttttttttgatctgggagagcacaaaggtgccggttctacaaccggcaccagtgacatagggtcattggtgctgaccaaaaggtgtcggccaggaaaccggcacctattgccggtttccaaccggcacctataagagtttttttactagtgctatcaaccataagccagtaaaatcatattgagtctacttcaccatattcctaaccagatccacaacttggatcctaagctaacacaattcaaaaaactagtcctattggtgtgaactgttttcatcttttaagtttattttttccactctcaattatcattgtgggactaaaccaaatagttatagtgtaaaagctataatatattcattctagaaaacgaagaaaatgggacgaaaaaacaatcactgtccatataagtacgcaagtacacaaaagattttcctggacgctggtcccatttggtcgagcttaaacaaattaaaacccctatacgcttcaatttaaactgtgatgctagctagggacactgttacgtactgatatataacagcgttccatcatctggcttatgttcttcatgtatcattcagatcgaatgactatatgaaattacgtcgataattccacatattatgggtagtgtaggagacatcctattttcccttggagtcttaattaccactacttagcttttaatttgcctatgagcatcaaattaaatgtgaataacctatccttctctctctttgaaacaaggggcgcttccggttctgtgcaagcttctaacaattttgtttgctccatattaccatatctctagagtcaataattttctatgaggaactactgaactcaatcaggttgagtgttattttgtcatgcctaggaccagcgtatgaagcagaggataatggagaagaaggtagaaggcagcaatggaaaaaaaaaaatcttccttcttcttctccatctttttcctccgagcaagtcgtcctctacggcgaccccaagctcgtcggcaaaccgaggacacgatcgatttccatgtgaactggccgctcttatttaccagactttggaaatgatcacatgaatatattttgagataatctattctattttgtacaagttcaacgattttacatcgacattgtctctttctataatttaccggcgactttatcgaaaatacgtcattgggttgggtattcttttcaaaaatacccaaaataccctcatggacatacaaggttaacaattgatttatcatattagaactttcaaataatatgaaaacttttatgtggccttctttacacaacatgaaaatttagtatatttaatatctttacaaaactaaattttcataaaactaaatagacctttttagaccttttgatttgggataaatcaattgttaaccttgaaaattttgtaaatttttttggtatatttacaaaactaaatataccaaaaacaaattccataaaacttccacgttgtgtaaggaggccacataaaaattttcttatttttttgaaacttctaacgggataaatcaattgttaatcttatatgtctctaaggctgagttcggatgggggagatgggaacccaacttctgcgtacggaaaacggagcagtccattaacgcgtgattaattaagtattagctttttttttcaaaaagggattaatttgatttttttaaacaacttttgtatagaaactttttacaaaaaatgcaccgtttagcagtttgaaaagcgtgcacgcggaaaacgaagggaaggggatgggaaaaggtgcatgcgaacacagcctaagggtattttgggtatttttgaaaagaaggtctgacccaatggcgtattgtagaacaattgataaagtcgccggtatattatagaaagagacaatgtctatggtaaatcgttgaactcaaataaactcagtggtatagaatagattctcttgaaaattagagaccccaacactagtacagttcctcttatttgtacagacccctactctagtacaaaccccatacatgcttgcgttttgtgggacgtcacaacgaagtcatctcaaacagggcaaaaagatgcctactcgcacaaacatgttagatgtgcatagagcccgtcacggatgacacctattagtgacgggacccaacttgaggcctgatatagagaaccaatgatatctttgtgggccttaacagaagcccatcaccgatgtccatcattcgtgacgggctccaacttgaggcccgattgagataactattaggtctgtcaccgatgtccatcatccgtgacaggctccatcttgaggccggattgagataactattagacccgtcaccgatgagtcaccgtgacgggctctagactaagcccgattgagataatgcttgatcatatttagattagggttcactctcgctcagatctagatcgaaaatttttctaagtcccgccactctctgaaccctagcaccaccgccctatgggagcctgccgccactgcgcctccgtttgggagtgcgacgccattgtccactgagcccggctgcatcctcgagcctgcgttagccaccgttgacctcctccacgtcatcccccgccgtccttgcgccgccgcattgacgtcccctgctgtccccgagcccgccgtcctctaccgacctcctccacgcagtccccgagtaggacaccgtcctccaccgacctcctccacgccatcccccgctgtcctagagcacgcctcgagcacacccaccgccgacaaccttccccgagcacgctcgcttcctcgacctcctcctccgccggttagaaatttttgtgaattagtaggatattttttttgtaacactaatgtatatatttatgcatatatttgttatgtttatgtatatactcacaatgctaaatataaatttgttctaatttacaactcggttttgcaggttttgatgcttagcatttgaagatgttattgtgaaatatgcgaataatggatgtgtgaaatatgtgaataatggatgtgtatgtgaatggatgtgttaaatatgtgaatggcatatgtgtatgtgaatgattgtatatgaacggggatgatgggatattgtgaaatatatttgtttctgtcattttgcagcgggcatagctagcaaaggactgaggctagccaaaaaaacagaataaattttctttcgggggaaatactcatcagtgacgggctttaacttaagaccaatgggaatgacctcatccgtgacgggtttaagttaaagcccgattgggttgagtcatctatgacgggctttagtttaggtccgattgggattgtattcatccgtacatgacgggcactaattgtggcccgattaagattaggtcatcggtgatgggctcttgtttgactagtcatctgggtcaaacctatcggtgacgggcttcagtttaggtccgacaaagataagttcatccttgacggccttatgcctgatagagatgacttcccaatcagtgacctttacaccgtgatgggtgccatatctgacaccgatgaggtttgccgcccgattgagatgtgggtgaccgttgtagtgcaaaatattaattatgtgtttgaatttaagctactactttcgatatatttaggatctatagattcctttttttttcagttttcactcttccaagttcactgaatcggctaaaccaagttgtttccttctcaactctgacagatggttgatggtaattataactacatctgagaagtgtatttcgtgacgataatatgaacatgtgttctagacgataggaattcatttttctatttagtaagagaaaattgaattgttgtaacagttcttcttctacttagcagaaacgctactacacatatactcctatgtaggtggatgagattctttgatatagctctaattgtcgttggttgtgaatgaatatctgcttgtttgctaggagaatctagatgaaaaaaaagaagtgtatcagattaatgccagcattcctaacgtggttgaaaggcaatgaagatcaagaaaaaaaaaacagtggtataagagacccgtcctaattttcaggaatgctgcgtggtcgcacagcttgtgcgtccgtacggacgggcctagttcccgatgcttgccaagcccaagatatctcttgctcgagacatatgggatgctaaccataagcatgaatccgagaccggacaaaaataaaatgctggtggtagaggcgctttatgtactccggtttgggctctagaccacttatagctcaaggaagaccatatctactactacttaaaaaataagaggtgcttccatcgtccgtcaaaaaaaccgggtgaaaaaaaaccggaacgaatccgattcatcaacgcggtaaaagaatatgtccgattccacaaaaataggaaacaaactcccatctgttttcgtttgagctgattaggactttgtttctgtttgggcgaataggacttggtttgaattataccaagttctattcggttagcatcaccaggagaacaagtgcatatatacatacatagtataaaaaatcatagcacataacaaagaatcacatgcagccttatagcactttgcaaaaaaacaaaaaattagatcgaagggggtcgccgccagcacacatatatccaaataaaaacaaaaaattagatcgaagggggtcgccgccgctgccgccgtcgccgtcgccgtcgttgccgaaccgccgccgtcgccgtcgctgtggatccggtggaggggagagcaccgccgccgccgcctcccctcccgctagatccgccggcggcggcggcagagggcactctccggtggggggggagacgccgccgccaccgtcagcggtgggggaggactccaccgccgccgccgctcgcgggaggaggggc

SEQ ID NO: 40879 - DNA, 1234 bp, Oryza sativa
gagagggagtgggttttgtttccccactattgacgctcggtcgtccgatcaaaaccatagagatcggacggctggtgtcgtccgggccgaaatcggcccaagagggatcgagagtgaggcctcttttccggcccaagcccaggttgcggcctgggggaggaaaagtgcgcccgcgcatgcgcaaaaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataagaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatggagaattttacttgtaaatttatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtatataatataatatatatgccatatctcattgtcccgtgtaagaaaatcctatagcgtatatgcgatattaattacagtaaaggactaaattattattattctttttagaaaaatgactaaattattttttattgcatggaaaatgctgctgtcgagtaccatgatttgtgtgggcattcagattttaacaattggtagggggttgagtcatgtacccatatagctcaaccatcacactagctagcttcccctttcattattaatttgatcctgcaataattcatcacatcgaaatggtttcacttacacatgtaacctgaaggcccaacgggatatgtatgtaagaaccgaagatcctttattttgtacttccgtatttggcataattactttaattttttcatcacaaatataacaaaaatcgtgtgtcaccaaatttgatgaagttagtccagttatgcatgatataaaaaccgaaaaacaaagaaaaatgaagctagaataatat

SEQ ID NO: 40880 - DNA, 1207 bp, Oryza sativa
attcctgcagcccgatcgatacatcgatgacatcggcccaaagataaatgatatgtcatcggcatttagccgatcggctatcatttatagatttaaccacggtttctttgcttctatttcttgttgattataggatcaaatcaactggcacgttaatacatccgaaggcgagttttggacatgcactggagttaagcagatctctcaggccacgtgttttctgtcaacacccggctagttcagcagccttctgggggtcgtcatctctgaacttagcatgttccttaccccctctgaagacggttaccatgaacttctccttgttctcatctttggagttggagtcgtggctcctaagcactcgtggcacctcagaactggtagtggccttctcagggaccgtggtctcttgcacctcggggtctttcgcaggagaagggtcttcaaatatttctggctctgtaccgtcccattccaatcctggtacttcttctatttctgacccgactgatgccacaaattgcacctctggttctgccactgtaatctccatgggcacatccggcactggaatctccatggctgcctccggcggtgcaatctccatagctgcctctggcaatgcaatctccggtggcacttccggcactggattttccttttgcatctcgggttcctccgccttatcaatcaccttcctcttaggaggtctcggaggttttcccaaccccggtttaggcaccacaggtttttgcgtggcgtcggtgcccaatccaaaggatatatcattcttgtgccaaagaattacaagatcaaccgcatccccaagtacggatacaccatatgcagtcaggaagtcaatgtcgtaggactcaaacccttcgtggaccacttgcggctgcaccttggcatacgcatcgggtatgaactcttcattgtatgttctcccagggatagcactggctgtagcggcctcaagagttttcccggagcatccaatgggaacgtgcaatctgtagggtgtattctccttgaggtcatcgaaggggtaatctggctcaggttctttggtttcggggcaaggcaaaagcatgtgcttgatgcagaaatccatcatttgcctttcaaactccgcagccccttcgtctctaagtttatccttgtacgcttcacgcttcttgtgggggtcatttttgaacccttcctt

SEQ ID NO: 40881 - DNA, 11914 bp, Oryza sativa
tccccaagccttccgttgccccggtgagagcagagccccttctgcaggccttagccgcagcaaataccgcagtgttgaatgggttaaatgcccaggtggaggccctgcagacggagcgtgcggagctgcacgccgcatgggcacgtgtcgagaaggggcggcactcggtgcagtccatggtggaagcggtccgcaaggcacaccgccggcacgtttcagatcttgaggcccgcaagacggcactgccggagatcgctcgagaggtggagcaggagcggggggctgccctcatcgccaccactgtgatgaacgaggcgcaggactccctccgccttcagcacgggaactgggaggcggagctgaagaaaaagctcgacgccgcccagggggtccttgatgccgccgctgcccgagagcagcgagcgacggagaccgaagcggcgctccggcggcgtgaagaggccctcgaggcgcgcgccatggcgctggaggagcgcgcctgcgtcgcggagaaggacctggcggaccacgaggccgccgtcgcctcccgggagacaacgctggcggcgcacgagtctgcctgcgccgaggaggagtccgcactccgcctccgcgaggacgcgcttaccgagcgggagcgagctctcgaaaaggccgaggccgaggcgcaacggttggcggacagcctgtccctccgtgaggcagcgctgacggagcaggcccgccgcaatttggaatccgtccgcgccgagagagccgcactggagcagcgggctgccgacctcgaggcgcgggaaaaggagctggacgcgagggcgcgcatcggcggggcggctgcgggcgaaagcgacttagccgcccgcctcgcagatgccgaacacaccgtcgccgacatgcagcgcgcgctagactcatccgccggggaagccgaggccctccgtttggcgggcgagatagggcccggcatgctctgggatgcagtctcccgtctggatcgcgccggtcggcaggcgggcctctggaaagggcagacaataaagcctgccgccaacctgggaggccttgcccagcgcctctcgaagatggccggggctctccagcagctccccgaggagctcgagaagaccatcaagtcatcctcgagggacctcgcccaaggagcggtggagctcgtcctggcgagctaccaggccagggaccccaacttctctccgtggatggcgctggacgagttcccacctgggactgaagacagcgcgcgcgcgcaggtccgggatgccgccgaccacatcgtccacagcttcgagggctcggcccctcggcttgcgttcgcccccaactccgacgaggagggcgatgccagcggtgcagacgacgtggaagacgaggccggcgacccgggcgcatcggattgagcccccaggcccccgccaatcttcaatttctttctttttctttcttctaaggccttcaggcttgttttttgtatagatcaacttataatctgcaatcaaaaatgatgaaaaaattctttgtgttaattttattttgctatgcggatgagatgaggatgatctgtgccgtggtcctctttttgtgtcttagcttgatttaagggcccgtgtacaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgatttagctgaccgaaccgagcccccgagggcaaggttgagcacgagcgacctcatttcaagtcaaaattcttcaaaaaggaaaaaacggcacagatacagcccttaggaaattgaaactgcttttattgaaatactgaaatgagagaaatgagaatgtgcatgtgtggcagcccccggccaaccctgcacacccgagggggggtgcggggttggcccgagcccgaaacctgacacccgacccccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagcttgctcaatccagcacgcgtttgaacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcaacctcgcagtacatggtggcccgaggagacctcagggtgagctcggatgggagaacctcttctgcgccgtagacgaggaagaaaggcgtttccccggttgctcggcttggtgtggttcggttcgcccagagcaccgctggcaactcctcgatccatgaatcgccgtgcttcttgagaatattgaaggtcttggttttaaggcctttgaggatttctgcattggcgtgctccacttgaccattgcttctggggtgggcaggtgaggcgaagcagagcttgatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttggtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccgaaccaggtcgaccgcgtcattgagggcagtcggccaatagaatccttgacgaaaggccttgccaaccagggtgcgcgaggcagaatgggctccgcactcgccttcatggatatcggcaagaagctcaacgccttgttcccgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagcttggagcgctcccctcgggtcccgaggcctgggctccgacgggcctcggggaccgatcaggcgcgtccgtctcccctaaggggtcgggtcgcgccgacggctgggcaagcctttcttcaaagacgcccggtggggtctgggctcgcgaggacgcgagccgtgagagttcgtcggcaatcatgttatcccgtctgggcacatgccgaagctctatcccgtcataatggcgctccatacgccgcacttggcgtacgtaagcgtccatctgcgggtcagagcaccggtactccttacagacttggttaacgactagctgggagtcgcctaacaccaagagacgacggatccccagtccggctgccactctgagtccggcaaggagtccctcgtactctgccatataattggtcgctcgaaagtcgaggcggaccaagtatttgaggacgtctccattcgaagaggtcaacgtgacccccgcgccggcgccctgaagagacaaggagccgtcgaactgcatcacccagtgggcggcgtgaggcagctgcgaggggtccgagctagcttcagagactgaaacggtctctggagccggggtccactctgccacaaaatcggcgagggcctggctcttgatagcgtggcgtggttcaaagtgtaaatcgaactcagaaagctcgattgcccattttaccacctgtcctgtaccctcccgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacccttcggtggggccgatccccttcgctaagggccatatccccggggcgctcctcgtccaagtggcccctcggggcgcactcgtcttctgtgccgatgacctcggggtcggaggacgataggggcggccttcccacagtggccttggggccgttctgggggtcgggggctcctggcgtcgtcggacaagcgggcaaagggccaactctggtcgtcaggggccttaggccaccgttcggctcgggggcctcttctccctgctccctcccgggtcgaatcggtacagggttagcctcggggtcagagggcgatagatgcagccttcccgcagtggcctcggggccttcctgagggtcgggggtgcccagcaccatctgacgagcgggcagagggccgactccggtcgtcaggggccttaggccaccgttcggctcgggggcctcttctccctgctccctcccgggccaagtcagcacagggtgggggtgcgcggaatgaggattgtcctcatcgcgctccacaaccaacgctgcactaactacttgggggggcgccgctaagtagagtagcaggggctcatttggctccggggcgactagaaccggaggagagctgagatatgctttcaactgagtgagggcgcgttcagcttccttcgtccaagtaaacggcccaaagcgcttgaggagcttaaataagggtagcgccttctctcccagcctcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcagttttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggagtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggataaatccggcctccagaagtctcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaaaacgtcagcgtttgcccgcaggaaggagacgagcgcgtcttcctatttgccgtccagaagaccaccgatccgtgtggtcttggacgggccgtcgcccagtgcaacctccttgaccgggacctcatcggacgtgactatccgctgcctcggggcggcgggggcggatgcgccaagcctctcgtcgccaccctcgggcttggacacgacggcgaggcggtccgcacgctgctccatacaagcgagcgcgactttgaggtcgccatggacagagatggggccgtcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcggggaaaggatgttgagggctgctcctccatcaatgaggacacgccccaacttcacgttgcaaacggtgggagaaaccaccatcgcaatctgccctccccaggcaacgcacggcgggtggtcggtctggtcaaaagtgagggcaacttccgaccaccgcgcccggcgcgtcgcctcatgagtaggggccgcagccagaagctctcgcttcatagccttgaggctccggcgagaaacgtgagcacacgctcctccatcgacagtggcaatggtggccccaggttcttggaaacctaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccgcaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgccgtcggaacggactgacctctttttcctcctcctgtctcgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacctgacagaaccgctgaatgtacgatcgaagcgactcatcgtcccttcgctgtacggcgtgcaagtccgcttcctcaccggggcgcggatacgtgccttggaagttcatggtgaactactggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcgggattgacgctgccatcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacgacgcggagccggtggtagcagcaccagaggccttggtggcggaggaccggccaccagcatctaggcgccgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacgacgtgggttcggctccccgtcgtcgccactcacactgggagagaggtcgggcgcctttgcttgctcagccatgaggctgatcaagaaaaacttgacgcacacggaaaagcgcgagagctcagaaaacacacgctgagccccctacctggcgcgccagatgacggagcgcggtgctcctcaccgggagaccgcacaggcccccctttgccggttcggccgggggctcagggtgagatctcaagctctccgtgtatgtgggaagatcgcggcctctcaaaagagcatgaaacacaagcgatgtatacaggttcaggccgctgagaagcgtaataccctactcctgtgttttggtggatctgcgtatgaaggagctacaaagtgtgagccaacctctccctcgttctaggttctgaatctggaaaagatcatcccctttctctatgggccaggtcctccttttatacttcaaggggataccacatgcacccctccctttccaaactggacttttcttctcttcataaatggacggagatttgcacggtcgtcctccgaacatcctcctgacgggacggcacacacctacctccacttctgcctgaggcgggcacgtcgtgggaaggtggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagttccagccggggacgagtgcctagaagctctcgtcttgacgggatggggcgaagcgggcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccctcggggagaccaagaggtgggcgcacacatcaccctcgggcccgacgtcccccgagggtgccaggccacgtgggcgatggcgtctgcctcaagcctctagtcatgatactcccggtcccatgtcaccgacagtagcccccggcgttatgccagggcgatcgcccttcttatgggaagcggccgggcgtgacgccactcctaaagcctggtgacaggtgggaccggtctccatggttgggcagaaacccaacggtctcaaaccatgtacaccggttatggtaatttagctgtcaataatgggcggtctcttcaagactgccacatcacctgagcggcgaacgaatctgggcgagccgatttgcttcgcctggagatacggtaatgtcgcttcggtcggcgagcgtaattaacgcgcgcacgatacgatctatctcgactgccgcaaccgcatatccacttcacgcgccgcaagcgggcgaatgggatcagtggaagcgtgggcgcgagaaacgagggggcgaaataatgggcgcgagaaacgaggagccgggcacagcgttggcaagggtataaaggcactgaggataggatttgtttccttcctttcgccatcattccccttgccttcgccgcttgcgccctaactccttcttccctgcgcccttctttcgccacacacgctcgctctccatcttctcttcgtccggcgccatggcacggggctccgcactgcttgatggtagcgtgctgccgccttcccgcatcgtgagcgagaagcaggctgggttgccgcgccgctttatgccggaatctgccaccggccgtgatatagtcacgctgggcgagggacgcccggcgccagactacccggggaggtccgtcttctttctcccctttgcaatggcagggctggttccgccattttcttctttcttcatggatgtcctggagttctacgatctccagatggcgcaccttacccccaacgcagtgatgacattgggcatcttcgcacacctgtgcgagatgttcattggggtgtgcccatctcttcggctgttccggtggttcttcaccgtgcagtcggtatcgccaccgtcggtggtcggcggctgctatttcctgccgcgggggccggtgttgaaccgctacatcccctgcgtcctccgcaaaaagtgggatgactggaagagcgactggttctacacccccctcgccgacgaagcgcgcctccgacttccgagccagcccccggcgcaggcctccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcggggcgcctgggagtacaccgggtccgaagactacatgcggacccaccagggagtcagatgggattgggctcccgaggacttcaagatactggtccaacgtgtgctaaatctcaactccgtggaggcgtccctcatcccccacggtatcctccccctctgcagcgatccagatcgcgcctccatcttgaccattatgacggcggtcggggcctcagaggagcaggctcctaagggccatgacggcgcaggcgggagccgccgaggggatcaatctacccccggagggggtcgtgcttctgggccccgcgtcgggggctcggggagcagccgccctaccgacgcccgggggaagaggaagctgggaggaacacctcccccatctcctccccgagggggcggggcggtgcgcgccagcagcaggcgcccggagggggccgcgccaacatcgcagcccgagggggagcgcaagaagaagcggctgcgcaagatgggggagacagaaccatcccggggaaacctaatttctcctccaaggtggtcatttaaccgaccccctcgcaggttcgtcccacgctcattgcgaccgtcttttcttctatcccaaaagcaagttttctcttacctatcttgtttgccttctggtttttctttctgcttcagtgatatcgcatcgcgttcctcccaccatcctaagtccggccagtccgaggccgaagatccggcggccgcagaggcacggaggcgggaatctgaccggcgagaggccgcagaccgcctacgggaagctgaagaggccgcccgggaggccgcccgggctcgccaggctgaggataccgctcgggaggaggccgcccgggctcgccaagccgaggataccgctcgggaggaggccgcctgggctcgccaagccgaggataccgctcgggaggaggccacccgggctcgccaaggcgaagaagccgctcgggaggaggccgcccgggttcgccaggctgaggcgatggcggcttccgaggcagttcgcgacgaggccgcgggcgcctcgcttgggtccaccccttcgggtgacgcccaggaccaaacaggtccgggggcggctcgcgacgaggccgcgggcgcgtctattggcgggccgagccgcgcggcatcttctccaaggcagcccttccccacgccttccgtcgccccgctgagcgcagagccccttctgcaggccttagccgccgcaaataccgcagggctgcaggaa

SEQ ID NO: 40882 - DNA, 6597 bp, Oryza sativa
ggtagcccactgcgatcgccatacgacccagctctgccacgaagccatccatgccctgaccgtgtgtagggggaaggtttgacatctatagaagacaaagggtaggaatctatgcatgctcaaatccaaattaaataaagcaataaatgactcaagtaaataagcaagcaagagcaactttttatgcacagaacattttacatgaaccaaataaacatactaatgacactgattaaacaataaagtaatgcgtaaaataaatagataatagtaataagcataaagattgcatcccatcgaaccaagacatgacttaatgcatacctcccattaaataaattctcgactaactatcaaatgaaattccaattgaccccaaatctatttacccaaagttactaataccctagactgacctaaattttaaatatctcattcgaataagcgatcaagatttttccctgtaaaccaaggaagaaaattctcaaattttccctgaaacaaatccaaatgcaaaagaacatatgcgtatgaaagagtttcagtgagctcttaaggtttccagttggcttgtcctatggtcaaggtcagctctaataccaacttgtcacgccaagaaatttacgaaacaaaattccgagctgcatgtgcattaaatgacataggcgtgtctatcaaaaccatgcgccaatagcccaccattaagcatattttagttgtttgaataccctggtggtacacgtccaatatcatcatcattaaaccaagatttaagttacatgtgagatcccccatatagtaagctagttgatctaagcatggctaagtatgtttcctagttgatctagtcatattaatacccattttatcaatgggttaaggtaaacaatctatggacaagtataggtaaccatcccacatgacattgtaaaatggcaaaatttgctacaactcaaaaaatatgtaattagttgcgagacataacaaaaatatgaatttgcctgagaacactcagtgtggtaatttgctgtaggataccgaacacattaaaatataatatccacccaattgatgagagggaacccatacaaaatgaccgttttgcccttcttcttctcccaatcctccatcgattccccaatccatcgcagaccggccgacccaaatccccatcaccccatcaccccatcgatggacgatggctgatgtggagcctagagccggcgccgcacacgagagggcaggcggaggctaggaggggtgtggtcgccgggttcgtgggcagtggcacggtaggtggcgagcaggcactggcaagctgggcaggaggcgcatggcgcaatagcagtgcaggtgcagcagcaactcagcaagcagcaagccaagcaaaagtagccatcattccaccagcagaaaatggataattcctaaatgtgaatctttgctatttgtcaatccatcactccagtaccccaccatgccggggatggctgcgaggagcttcctattacgcttgctctcagcggccacgttcctaagcttgtgcagcgtgtcaaggagaccagcagagcttgtggcgcgcacgatcagctggggacttggggggtagggatgaggccgatgacagtggcaagccattggagctcgttgcaagtgagcgttggaaaaagaccgaaagaagggagaagaagggcaaatatgtcattttgtatggtttctctctcatcaattgggtggatattatattttaatgcgttcggtgtcctgcagcaaattaccatacttttggagtgttctcgggcaaattcacgtttttgtgatgtcacacagctaattacataccttttgagtgtcctaatgcaatatttaatagaaaatgagacgtttgcgaaataggtacaatatgattaattaacatgtatcacttgccttgcccccggtgctgcaggaacttctgggaccacttcaaagtaaagtagagcttcggattcaccggaatctaagcgaagcacacatacaaaacaggctataagtctatcgagacataaacaaaactatttttaatggattttaagtttatttatgaatttactgtaatttgagtgggctcaaacggagctcggatgaattttttatgaattttaaaagattgaccgtgcttttagaaaagcccttaaataaaatattacgcattaaagccaacggctgacgtcactgagggagggggccggggctgacatgtgggccccatcggtcagcggcgcaagtgtccgatccaccgtggacaagtccacgaagacggagacgggggcaccaagtcacgtgggcggtcgaacgaacggccctgatctgccgcgtggcagatcaggcagctgagatgcggcggtgagctggcacgggctcagccgagcggcgtcgcgcggtcaccggcggcgacgcggggagtggcggcgcgcggcgcgggagacggcggttcgcacagggaacggcggcgcacccaaaggggcagcggcgcgcacgggaaggagagggcaagggagggggttcctcaccggccggcgcggaaggggacgacggcggcggtgaggaaggcgacaacctggcggcagagggcgcggacgggcagctgcgggacctaagagagagaacgagaggggtttgaggggaaaagagggttcacggcaagcggcactgtcggccgggaggcagcggaaaaggaggtgctcaccggcgactgaggcgagacgtgttccggtggcgaggagcaggcgggctcggtgagcgcggcggtggcgacggcgcggctaggcagcagccctagcagtggccggagatggtggaaggcggcggcgctagcttcgcacggcacgagagggaacgagcgagcggggaagcagcggtggttgcggaaagaaatggaggagagctcgcgagggggttttatagagccgtgggccggatggacctctctcccgtggtaggcggcaacggcggcggtgaggggcgatgtcggggcgtgaagccgggaggaactggggccgcgtgcggccgttgcgggcgcgggatgcgtggagtggggcgcgcacacgtgggcgaggcgcggacagtggggttactggggcgccgggcacgggcggatgttgttctccccctccgatttcaccggcgagaggaagggacgggcctgacaggtgtgccccacccatcggcgacccgtggaggagtgggcgctcgcggggcccagcttgctgagccttcggccggcctagcggcagcgagggcagttgtgcgcgcgctcgggctagagcaggccggcggcgggaaattgggccggaaacagcctatcggctgaaaaagaaaagaaaatggttttgaagttaataattccgataatttgttttcaattattaaaattacttcctttgtttatatacatgtagaaagaaattaattatattgctagcaagtcattagatgtctaattaataagaattaatgttgacatcaatttacaattttttagagtagctcttacagaacaatgactcgtatgaaaaaaaaaatactacttagggtttacgacaactgaaattgatgaattatctaatttatacgattgctatctgagggtataaacgaataaattaacttttaaaaagttaaaattttattttagaaaagtattccaagattttttttttcaaaaaagcaccatttagaaacttggaatgcatgaaaataaaaattgaaagtatagaatcaggaaaaaaataggcccttaaactcgcttataacacttacgtcctactaagagttctattgatattggttcatattatgctcacatttataacataatgatttctttcacctcatgaacaaataataaaaaatctaaatacgatataacacaatctatctatctatacctatattaattggacactttttatgagctctcacgttaataagaaaagtctaaccattgaatataattaattaatttaatcagaatcatagatgcaatagtgatttaacgccataggcctgtctaccgtcaactttatgggctctttccatagcccatatgttcttatctctagtcaattgtatccgggagaggcagggggcgacacgcgccagctggcagcctggcaccctctcctaagcatgatttttttcgttttctttttttcgcggtttttttttttcatttttcattttgcgctttttctaatttttttaatcttcagcacacatgttttcaaatgtttgagttaaaagtttttaaattttaatttgaaagtttttaaatctcaacgtaaaaattttcaaatatggacttaaaaattttcaaatctcgagttgaaatttcttaaatctccagttggaagtttctaatctgagtcgaaagttttcaaatctgagttgaaagtttttaaaatttgttttacaaatttgaatttcaagttgaaaattttcaatgtttgagttgaaagttttcaaaatttgacttcaaagtttaaatcttaagtcgaaagttttgaaatctaacttgaaagttcaaatttcgagttgaaaaaaattaaaaaattgagttttgagtgtcaaattttgagttgaaagtttaaaatttcacgtggaagtttctttcacatatagatttcttttcaatatgttagtaaaaaaatcttcaaaaaaaggaaaatctttccttaattaccgtcattatcctaaactaactcgaaactaactcggttagttacgttgattcctctggaatcgccggcgcgcgttagcttttctgcacaactatatctgatggagagagctaggtaacagtctagcagatggaagcatgaggccacgagcagaaccgtgagcataatacgagagacttcaccttgccggggtgtccattaacacgattgaaaacttcagcaaaggagtcgctccagccgccaattcgaacagcatatatgcatggacggatcgacctgctgttgagattgcatatcccgcatgcatgtgcaccaacctgcgcaaatggaaagaagatcgaagtagataagttcaattatattttgatgaatcggcggcggcgggggaatcagtctcattgtgagtagagcacagcaagttcatttggatctttaaacggcagaagaaaacgcatcagatatgcatcaactgatctgtacgttgtcctaacatatccaatcctttttcccgttgcagatctactattagttttgtaatacaatggccaacaatattcatgcctggattagggtcgaatatcatctgcacaaatacagttcattaattgttgaccaaattaatacttattctccttggccagcatacataatcacattatatttctatatcatgattgtgggtgtttgcacgcaagtttcatacctatgcttattgctcgctttattgtagtgaataaatcaaaatcacctatctaggtggtatcatcaaattaggagtgaaataaaagaagagtcaagacacatcatcgcaggttcctaattcttaaatttagattaataaagaattgaaatactaaaaatcagagccctaagaggaggacaatctagtattttcaatttaaattttcggtattatcaaactaaaaaaatttcgtatttattaactatgagtccacattagatatggctcgctaatatttttttttattttgagaactattaaattagcaaaaaaaactaaatcgaaactatagacaagcacaaagaacgcatttgatactcgagtactttgcattgagctattctacaatttaaaactatttaaaaaaattaaaattaagacaacagtaaaactttatgacgtgaaaaaactatgaacaaacaaaatagaattaataaatttgtattattaattcatattttttatcagtaaaactatgaattaataaaaaaatttactattaatcttaatctttagaaatatgaataaaataatagataatgtaatgtaaagtaaatactagaaaaagcgatgtgagttttttttcctaagaggatatggccctcggagccaaatatggccacctacgaaaatttaaactggggtggagcttgtcgttcgcctgcgaagatcagttcttttatgcggatcacttaagaggtccgcctacgaaaatacctttattttcatagacgggcctcttaaggcgtccgcttggaaaaaaatgatttttgcaggcagaaccttatgttgtccgtctgcaaaaattatgcctgcagaaaaaatatctaagtcccatcattatcttctccttcaccatccttaccctgttggccactcatttcccttccccttctctctttctctctcatttccttcccattagacggcaggtcacgtgatggcctccctctcctggtgatggtggtggctcagtgacgaggaggggaggcgttggccgcaacgaggaggagaggggaggttggcggttcaactcctccctctcccggcaacagcggcggctcagcgatgaagaggtcgtgacgacaacaacgattcctcctggatctgccaccggctcgccctgggcgcgca

SEQ ID NO: 40883 - DNA, 8962 bp, Oryza sativa
aggaggtgaggggaggggatgcagcggctcggctcctccctctcccggcgatggcagcggcttagcgacgaggaggtggcgacgacgacttctagatgtgccgctggctcgcaccgggtgcgtggatccaccactggccggccaccggcacgcggagccgccgtcggctggtctcgttgaggggagtggaggtggtggcgatgaggaggtcagggaaggggaggggatgcggcggctcggctcctccctctcccggcgacggcagcggctcagcgatgaggaggtcgcaacgacgacatgacgcctcttggatccgctgctggctcgccccgggagtgcggatccaccgccggctggccgcgggcgcgcggatccgctaccggccggtctcggggaggggaggggaggtggtggcgatgagaaagtgagggggagggaatgggatacggcggcttggctcctccctctctcggcaacgacggtggctgaacgacgaggaggggaggcattggccgcgacgaggaggtgaggcggtggctcagctcctccctctaccagcccggcgacgaggagggccagcagcggcttggcgacgaggagaggaggtggcggcgggggtaggggtggtggcagcaaatttgtttttgttcactgaaattatttttgtatgagggtggagatgctgcctgcgaaaataattttcgtaggcctttgtttactggcggccctttccccgcctgaaaaaactacttttggccgtctgcgaaaatgattcctagtagtgattgttttctaaagcgatttcgtattgttgacatttttgagtttgaggggacgatgcctaggccacgatgcatgagtccagtgtatcttgctgtgcaacattggatgacaaaggcgagcgtcagtatggagtaagattttgtatatattgttattgtcaaaatccacaattattttcaataggaaaagtaaattacttggtttttactaatctatttatctattaaaaaaatataattctacatttaaatcgatttataaattttatatctatggaaataaaatgtaacaattatgtcggaaaatcaagattcttctaaaatccagatccacacaaagttgtaggggggaatccactaattgcctttaagagatattttgaaaaataaataactgataattcagcatatgattaaaattgtaatacttatttataaaaacaataattagcctgtgcaaagcacgggttgacggctagtacattataattattttgtattcaactctttatttcagcttacacagagctaattgttggaaaaactcaacccacgatgcttaattcttctctccctgcctcatacctttaatttgttttaatgttattaacaaaattaattgttaaccatatatgatttgatatgtggcaaagggatagcgctgcagcggtcgtgatcaacttagctgcctcagatatgatgtttcatcatgcgtgcggaaggcaaagctacagacgtgcattgtgcttctacagcgggccaaaaagaaaacttcggatgctttatttattaacaatagatagatccgatgattcaaataatagatgtaattaaattagttaatatagattttaaattgttaatttaatgagtacacagtataatgatgtaaactttattttaaaacagtttcattgtttaaaattaatagtccaaagtaagtaataaaagatagatctgatcatttaaataacaagtccgccggtttaagtgcaaatataaattagttaatatagatcttaaattataatttgataggtacacaatataataatggtgtaaactttattttaaaatagtgcattatttaaaaataatagtacaaagtaatgagtataccgatttaagtggaaattatctcacattattaatttaacgggtaaatatataatggttcaaatttattttcaaacattatagagctaatttagttacctctatgatggtatattctttcttcgtaaaattatgattatttaaaatttttacggaggaataagtgttttacagaggaagtgccgaagataagtacatctgataaaaacaaatctagcagctctttacactacaaagctagctgtaggagcttggacagagggaatcttgaaatgtaaagtaccgttttcttgtttgaagataggaaaagacataatagaatcccttatatgccagccagttctcttacacatgccaatttaaattggcttctcctttatataccactggttaagttttttcacattttataccacccttagcactgtagcattagttgattgttagtcacatgttattttttttaaatgaccaatatgccttctcaactaaaaaatgtgtaaactttaaaaaatcataactattttattttaaatccgttttgagtgaacaaaattttgtcataaccaatgaaaaatgctctttgtattaaaaatattgttggaaaactgtatgtttcatacttatattgaaaatttatttgtgatggtgatggctaaaattgcatataatgcaaaaaaagaatcaattttcatatgttgtatccagtagctatattagtattaaaatacctatgattggttgtataccaactctcaagagcaaatacgtctttttactctgaagttaacggtcaactgatggtggagtgacggcaatggcataaaagggataacatacttgaaccggtggcatcgcagagagaagccaatttgaaatggcataaggaaaccggttaatttgaagtggcatataagagattctctaattattagaaccagatcggaccgggttccgaccgaagaaaactggaacattggccggtccggtccagcctaaaaaagatgggtgtgaaataatcagactggcggaaaccattgaacggccagtttttttcatagaaaccggttaaaaccggattactagaccgctgattgggccgatgcagctcagcacgtgggagggaagagagttgctatgtccatgtggcagggagggaaagtatcccatagactcacgtctatatatcatatactcgctccattttaaaatatttgataccgttgactttttagcacatgtttaaccgttcgtcttattaaaaaaatttgtgaaatatgtaaaactatatgtgtacatgaaagtatatttaataataaatcaaatgatataaaaagaattaataattacttaaattttttgaataagacgaacggtcaaacacgtactaaaaattcaactaaaaatttaacggtgtcaaacattttgaaacggagggagtacatcaactaacaaatactactaaaatatctaaaaaaattattgaaagtattatatctagctaggataaaatcttaacatcaaatacattatattttagtcgtaaaaaaaatccgacagttttaaggttgtaattctgttagaattttatctttttttactctctatgtagaatgaatttaaaaattcgactttgtgcgtatatgtaatactattagaagtatatgtatgaatttttgtaaaattatttataatattttttagttggtgtatatggtgtgtacacgtgaggtcatatatagatacgctcccgtggcagggaagccggtgcctgctttcacccccaagtaattgcctattcttaaatctttgctgcaatattggttagggttgttgcaatgtgacggaagactcttgcattgcattcaagcctcaatcttgctctatcagtctagttttttttatcaacattttagatacaataatgtagagtttaggtggcgatcccatgcatggttattcgtgtaacacaactaaaaaacgatttttttacgcggactcatataggttgcaggtggaccgtagctgatcacgtcggcaaaaatcgacctatattttcgcatacgactcattatgaggccctcatataaagatctattttcacagacgaggctcttaaggatcacctacaaaaataagcctaatttcgcatgcgagcctcttaaatggtccgcatgcaaaaatacctcctcttctccacaattttatttcttcctttctctctctttccctcctcatcacttcaaaaaattttctcctcctatcctctctcgccctttttctctcctggtattattttttctctcctctctctcttcctctcctctcctctcatatgagcgggagctggtggcagtgggcggctgtgctgccgctcgacaaggaggcagccgggaaagggtggcgccgccgccaacgacgaggaggcggctaggagtggtgtcattctcatccccacccggtgccgccacagccgatgaagaggaggaggcggccaggagcggcaccgccgccgatgacaaggaagcgactaggagcaggcgactaaatcccgatccctgcctgacgtcgctgtcgtcgccgatgaggaagaggcggccagtcgcgatggccggatcagccaccgctggcgccacaatagcctgatccgccatcgctggcccagcgacggccggatctgccggtgccggcgccacgacggccggacctgcgctgtcggcgcaatcgagagctagggtttcgctttctcttttttctgagttttttattatattttggctttttattttttaaatttggtcgacataagtactaattttcgtatgcgggcgtgccacccgtacgcagacctttccgtaccgacgagcaccccaaccgtatgaaaaaataggtttttgccatggctgtccatgagggcgcgcggccggagcaccctcacaggaccccagtcttcgagggcccctagacttaaaactctaacactagatatatagcccaactagtcctgaaaatctattattttctttttcacgttgtttcaatttcggtcatgcatccttgccaagggactatctaaaatactgccacaagttctttaaggaaaaaactttcaaatctaactatagtataaatataataaaattccactataactttattataactataatataacttatatataagtactaaaataatatatgtaactttatatctaatttatatagagactacaatgtagttacagtgcagttacactgtatttacaatgtactccctttctttcagggtataagacgttttgactttggttaaaatcaaactgtttctttcaagtttaactaagtttttagaaaaaaataataacatttgcaacccaagacaaatttactataaaaatatattcaattattaattcaatgaagctaatttggtattataaatattactataatataaattttgatcaaagttaaaacgtgaaacggaacggagggagtagttagaatgtaacaatagtggtgtaactacattagagttacacttcaactatacttacatttgaaagttttttaccaaaaaaaaaattgtgacagttttttagcaattccgatcgcgaattgtgccgcttcggctctcgagcaatcgcgccgcctgcgcctgacgccgtcgctgcccggccgagagagaatctcctgagtccctgatgaagtgacgagtgacacatcgacgcctgctggctgccggccttgccgcgtccctgaccggccagccgtggtgccgcgcagcgcgtgcccaccgcggccgccggactgcatgtccgcttcactgcttggtgcttggttgcttgcagatgattgccttacttcctggtaatttttaatccggtaaccctcgtgtcgcttttcaagtgaatattattgtatatcattttagaccattttacattgctatgaaacgtattacggagtataaattattgtaatattatattattattaattatgtttttatctttcgttacgactttttgcacatgcccctgaatttgatgggacagccctggttttggccgtatagaaaaatatttttttaagtactagtgtaaagacgctctcatgctcatggcttcatggggcacgtgcattcaccacagttccaccccctttcttgagtatccaatgagaatccatgtgctcactcgcttgcttctggcagacaaaaaaagtagcatagcatatgcatgcgacattctgtcttcttacactactagaaaagcattatcacaagcggccgaaaagagacttcgcaggcggggcgaccgtccgcctgtaagccaacgactgtgaagatcgccgatctttgcaggcggggcggccgtccgcctgcgaagataatttttgcaggaagacgttggctagtccggtctgcctgcgaaaataggaatcggccgcttgcaaaaaaaaaaaaaacttccgcctgcgaagataggtagaaaatattgaaatttaataataatttgcccgtaaattacttttaaattatttagtagaaattcttgcaggtagattattatgtacatatattggaagattatcaagcatttggtactgagaaatctacatatattgcataactcaaaagtgttgccaatatatatatatattacaatatttttttacattgtcacttcaaataacgtcatctagttacattatggcatagcagtgttccactcccgaagatccttgaattcgtcacttgccgctagggcaccctctgggccgaagaaatctcctttcacatgacaacactcatggcggatgaagtgacacagatcacgctggacatttgtgatacctgtatcgtcaaagcttgttcgacattctaatcttagcaactacatgcattgaaattaatcaatatattagtatcataaatatgtggagctgtctagtacatagtatagagacttatatcctccgcgttagtcctgtaccgtccattaaccctaaggaattcgcacgcataatacccgcaaaggaccgttcctcgcggttacttgtgacacttcaggacatatcatagaaaaaagtagttaaaatttttaattagtgaaacaattggaatacattaagtgagtggagtattaccagccaataggtacgtactagcagcttcaaccgtgttcgggtctgttctccacccttgaacttgtagtattggtatgcactgtatggatgtcgtaccatttcacagtaaggaggatatttatttataatacattcatatacaaatgcaagagtcataataacttactactgtaagattgttagaaattctttgtattgcttgtgactgtaatcgagagggtccaagactaccacggttccgtctttagggtggatgagtaaacagatataatgatcgctacatattaacaacaatatagttagttagtaccagctaaaataagagatatgtgtacaagataaatataccggacttacttaaaattataagcggccatgacgactttcttattttgaaagtgcaagaaggctcatccaatgtactgtgcgacagcaatcaatttttccttgtgcatgcccttcttgtattctgctatctcttttggattcttgcccttcagctggtcagaccctggtgctagcctcacggtatgctgtgtttggcagatctgagttggatccaagaagtcgatgggttcttttttattcttagcatccatgtattgcatcgtacagaagaagtttgttagtaacaatcacatggatttgtattgtacatatttttcatctaattatttaaaactcatactcacatgcaccaaacaccaacgtagttgacgtccatcttatcccgacgatatatggcgtggagatctgagaaatctagccatacgtaaccttcttcgccgaagcaatctgccggtgatcgagctgttatattgcccaagcctttcttgctggccttcatgtagaagttatgtaaccttctcatctcccatggtccttctttcagtgcccattccggcaagagtggtttcccatgttcgtactttttcgggcaatcatcagttgcgaagtatgttggcccggtgttaacaaccaaatttggtaacatcagcgtcggagagaagattagatcgaagcaaagtcggaagcgaagatcgagttcggaaatagagcaggaatcggctggggttcgtatcggctacggttaggatcggctgagtctgagtcgagctaaataagccgatatagccgattccgacaatatgacttgtacgcgacatcgggttcaagttaatgtacttcaagatgattgccacgcatggatagagtcctgggaaggcaattgtatctattaattaggatattttatgtaaattccttatagataagtgtgggcaaaagtctgccgcaaagacttattagatcttagagtttgttagagataatggtcgtgtccggtatgggcatatcttgtaatcctcgggtataaatagaccctgagccctatgtaatttttaacacacgttcaatacaatctcggcgcatcaccatccttttgctttagttttgtttcgacgagttcttgctttcgggttgagctgcatcgatttcgaacttcaacaagaggtaacattcgttatgacagattgcgttcttaggattagtgcttccatcttcatgatactctaatcttgtttatgtaattcgtcaagttatcatatatcttacataatctctagcaatatcgccatctgaactactatcggccaatatctgtatgcagaaggcagccgattaggttagatcttgacgttgatctggattatataagatatctaccattctatgaaacttctagcggcttgattgtctagatgttgctcttcttttcatacttaatgctgcatcagttgagtttgatctattaagtcgtgtttagaatatcaatctctagcctgccttccagttgccgattagaatagcatcggagtttcagccgatcgtatctgatttagccatatttat

SEQ ID NO: 40884 - DNA, 1623 bp, Oryza sativa
tcctgcagcccttttatcggcaacgctttacagctccggattttcaaaagatacttttccttcatccgtgatcttcggagttctagctcttacctagttccttgatctttgtgtccactcctccattggtaccggttgccccttcttcctcatttcctcctcctcttttgtccactgctccacctttggtgcatatcccgcggagcctaagtgatgaggaaatttgttcttcttggccaactctgcaaacatttggctcctttgaatttcttctgggaagttcttcaaggtcagaaagtcgtcccactgattgggggttatgttggcatacgtcgaaaatggtgtgcatcctgtcttcacaaatttcttgttcaaggtggttttccaaccacgccaagacttggccattgtttgcaatgcacaattcctcactgctgcctccgatccatctgagaactggaagattttcttcaactttttccataggacttccttatccccattcgatacatgatcccagtccttgaccgtgatggggatcttttcccttacaattatgccacactgtgaactgaatttcgcatgtgccgtcttaggggtgagcggctctcctttaggcgaaacatgggtaacaacatggaacccttcatcctttctattcacgcttctctcgcccttcattttcttcgcctttgctgaccgttcgcttttctttgtgccgtttgtgttagctggtacgtcgtcgtctttcgacggaacttttttcttcggctgccgttttgatcgccgtggcgccgtttcctatgagaaggtatacatggaagtttcgaattagctcgggctaatagttatcacggtgaacattttacatattaagtttacttaccccttctttagggggaatgtagtccttgtcgccttcttcaccgtcgccctttttccttctcttcgggcttgggcttggacaaggatcgcttggcgacgagtactcctcgtctttgtcagctacgtcgctgtcggaactaccttccggtgggactgttggttccggagcaaccacaacagcaagggactgctcttgctcccctaaacccttctcttcagtccctttagtactatcggtcatcgtttcaaacctctaatataaaaaaaaagagttatcagccacattttaaattactcaaattagtacaaacaactttgtacaaaaataaactgtatattaacaatatatcgtatgaacaaatttaaattctctgatattcccaaatttaactattatacaaaattaattagtacaaacaaatttaaattgcaaaatattattaattagtacttactattatgctaaattaattaatacaaacaaatttaaattgtgaaactaatgactacttactattatcaagtagtgcactaattgacagttatatttcatcgacatgttgattataaaaaattgaaaaggcaaacatatcctccacatttttttaaaaaaatgttaacataccctccaacatgttatttaaaaaatttgacaaattcacatatcctgcaaaattgaacataccctcccaatttcattcacatatcacccacattcccaaattcacattcacaatc

SEQ ID NO: 40885 - DNA, 4202 bp, Oryza sativa
tatgatcacacatcaccttacataccatcattacataactactaacttcttagattcttacatgccactcaacaatcattaccctttaacatttttgcccacaccgttcgtgcgcatgtaaggcttcacggtcttctgagtagatgtctcgacattcttaatcttctgtacaaactgacatataaagtggcatactatcgtattggttgtaatcttcgacatcttcaaccccatccactcccaatatcttttgtttccctggtagcactatatcttcaaatttgaagggtctttcacataaaacacttgtgccacgcaattggcgagtacccaagggtcatccttgtgacccacactcgtcaggtcaacaacagtaagaccgaatttatcaacattgaccccgttcgggtattttacccattggcacttaaatatggggaattgcattgtgtgcccatagtcgatttcccatatttcttcaataaacccgaaatatgattgtttctccccggcttcatcaattgcctccacacggacaccgctgttttgcgtacaagtcttattatctcgggctcttgtgctaaactagtatccattaatgtcatatccctgccaagaatttactgtagttgatggaccacaagccaactgcttcatagttatttcattggtagtttgtccctcaggtaagtctaggtctcgcaaccaatctatgaagagacgcttgtgttctttcattatccactcggtggtgcgacctttattgttagcttgtattagttcgatatgttgatcgatgtacggctcaacgatagcaaactgatgaagcacgctgaagtgagcttcttggaatgatttgtgatcatgggtgacgaatctcttctttcctatcgttcccctgccactcaacctgccctcgtgtcggggcacaggtactccaattgcatattcatctttgaggtaatcgatacagcactcgacaacctcttcagtactataaccctcaaccattgatccctctggatttgcacgatttcagacgtaactcttcagaaccgccatgtaacgctcgtatgaccacatttgatggaggtacaatgggccaagcgcaaccatctgcggcactatgtgaacaatgaggtgctccatcatatcaaaaaatgacggagggaaacacatctcaagttggcaccgtgtctcatgtgcgaatgtacgtagatttcctaactcttcgagactaatgaccttctgtgacactgtgttgaaaaagtagcacaaccttgtgatagcaacctttaaatgctccggttttatggcccttattgcaattgcaagaaacacggtgagcaagacatggcagtcgtgtgaattataaccagataccgacaaatctttcattgaaactagtcgactgatgtttgatgagaaacctatgggcactctgacatcacggagtgagttgcaaaatgacttcttctcctcaggtgtcagtgtgaaacatgctggtggaagatatactttgccattcttttctccttcttgagggtgtaactcttccctgattctcatctcgactaggtccatccttgattgcagaccatatttagtcttcttcggcatgtccaacaatgttccaactatgttgtcaaacacattcttctctagatgcatgacgtctatggcatgccgaaccaccagatctttccagtacgggaggtacttaaaaaatatggaatgcttcttgaatgggggagggagtttatcatctggcttcgaactatcatcttgcttcttactatcccctcccttcgtattcttctcgggtttcttgcgctttgtcccctttgatggtttcttagtcatttttccaaactcgcaaacaattttctctgtcattgcacacaccttttctcccgatgtagggtttggtgcaagatcagtctcttcagtaccatcgaactccgccttcatcttgcggtacttgtgatttgtgcgtaggaaccaccggtgccgcatgtacacaagcttgttggaacccgggagatacctatagtacgttccattcaagcagatcacacatcctattttacctttaatttgacctgaaactgaaaacattgctggataatcgttaatggtcacgaagatgatggccttcactgtgaagtattcccttaagtactcgtcccacactttcaatccctctttccataaatcagccatatcttccaacaatggttcaagaattatgtcaatatcaataccaggctaacggggtccctgtatgaggatacatagtagtacgtattttcgcttttgacaaagccaggtaggaagattatacatggtgaaaagcactggccaagtactatgtgagctgctcatgtctcaaaaaggattaactccatcagtactcagggcaaatctaatgttccgtgggtctttagcaaactttctatactgagcatcaaagtttatccacttacgagcatttgccgggtgtcgaatcatcccatccttcttgcgcccttcttcatgccagcacattagttccgcatctcgcgggtttgagtatatccgtttaatgcagtctttgacaggaaggtaccacatcacaagctgcgggatttttctctgtcgtccctcagttgcttcaaagggttctaggccagtattgctattcgacttgtaccggcttgcaccgcatgttggacattcatctaaagaagcgtaatctttcctgtacagtatgcagtgatttacgcacgcatgaatcttttccacaccaagtgaaagggggcatatgagtttctttgcttgatatgtgctggatggtagagagttaggcctcgggagcattttctgcagaagttctaacagactgtcgaaactggtatcagaccatccatgtctcgcctttaacctcataagttcaagaactgaccggagtgttgtgatctcactgtcacagcccttcgactcatcgtacaaaacttcctttgctgccttctgtaaagcttcaaagttatttaaccctctagccgaccccatcagcacctcgggttctgcatgacgtaacatttcctctaggtcgattttgtcctcaacagaaccatcgtcatgcaccatgtcttcaacttgtgtcggaactacattttcaggcccgtccacttgttcttcgccatgacgtgtccatatttcgtacttgtccataaatctacgagttactaagtgctccttcactttaaaagcatcgtcaaagtcccaggctatttcattcttacagtcagcacatggaccaattatcttcctcatattgttcttctcagcgtgtgccttggcaataccaataaatttagacacttcgtttctatatggagacaaaaatctcggccaatgatacatccattcccgactttccgtatctctaaaagaatacacgtaaaatatttgcacaattaataccaaatttgtagggtttattgaaaaaacttatcgctattcaaaactaattaactaaaagttaagtgtaaattaataaaaaatcaaagtttatttcaattttttttacacagacatgccaaattagtacattaggaaaatctaacaaaatcatatcatcgccatattacaaaatactataactattttttgatttcaccgaataaatagacatttaaaattttattctctctctatatatgacaagatctagatctagatctagaactaggaggtggatgtgatagcaaaaataaaaaaaattgagaatttatgttaccacattaaaccactacaacaagaggcatcaagtattgtacatacatctaacatcaacatatcaaaagaaataaaattaaaaaacatggagctcttccttcacaattttgcatgcataaatccatcacaaattaaggtataaaagcttaaaaaattgcatacctagtgtgaaaatgagtagatctaagtaccgtagaaaaatcccccgaagaattgaagttcaaaacctcccccctatatttaggtcactttaggagagagaaacttcggggagaatgaacagggctcggggaggaagaagactatataggggcatcttttcaggcaggccatataagcggcgcctgcgaagattgatcttccaggcggaccatataagcgtcgcctgcgaagattgatcttccaggcggaccatataagcg

SEQ ID NO: 40886 - DNA, 13350 bp, Oryza sativa
  unsure (1)..(13350): unsure at all n locations
ccgactcagcgccaaccaccttggcgctaacaccctgccagcgtggcggctgagccgttcccccccggtgacaatgttcctaggatctatacctatcaacatcatcataaatcagtatgaatccccaaaatattcacaatacaacggcactatacatccctccaagttcacccttagcaaaatagtgtataacttgcaaaaacaatatgtatcctctatacgaacatcaatatacaactacaacattgcattcttacccatattccctaattcacaccacaacccgagccacattcaataacgtacggtttcaaccaaaatactctacaaaaatgatgaaaacattggggaaattagggtttttggagggaatttaccttacaaatcaatctccaacgcaatgcgtacaaaatagccttcgatttgagggatatttgaggagatattcggaggggagcagagagggcgacgtggatgaaccctagccgcgaggataaaaagaagggagtgccgggcctgggcggctcggccgcgatctataggctgcaggctcaacgcaaatgcgtttggcgaggttagccgtctcagtgccaaccgccttggcgctgagaaccctgccacgtcgaaggggattggctcggccgccacgttagcaggggttcagcgccaacacgtgtggcacggtcatgtaggaactcggtgccaacttctctggcgctgagccgatggcttatttttggttgaagttttttgttgggactactttcgaaataagtttttgaaaaggacaaatttatcaaaaaaaaagggttatgatatagcaggccaagacatcatcatgaacttgagctttggatatgggctcaatagtggaagaggaatccatttcatcgttaacaaccgctggaaagaagcgttttaccgtacaacaatcgtaaaaaagaatcgtatgtatagcagcgccgtaaaaataccacatactattttgtatatatgtgtaatgcattgagaattggatggcgtagagatatatattggttatatgattatttttgtttgttgttttttgtaaactctaaaacttgggatttagaattaagaatgcgttaagacttaaattgtttttaaaaaatacttgaacaaatggttccagttaggattacaggaagatattcttctctcgtgggttgtgcacttatatttacacgggcaaatgaaatctttcttcttttctataggaagacgagagttctagcaaatcaattaacaaagggggatggagaaagatactcctaagtgttttactccctccgtcttataaaatatcaacttctgaggatggacataaataggcatttgtctatattcatcaatagaagattttttttttacaaaaggtgtacagagtaagagccaaagcactgaactagtacaactaataaaaacagatgtagcagctttttacattacaactaataaagcactgaactaggagatcggacagatggaatcttcaagtgcaaagtagagtttttcttatttgaagacagaaaaagacagtgggctgaagtattagataaacagaacgttgatcaaaagacgtatgagtcatgtgaaggcttattggaatttgggaaggagcatctctctctctctcttgagtcctgaactagaggggactatagtcaagacttaacatctcagcttctgtatcgtgctcactttccagtttccacccaccgcatagtctccctgcagtactgtcgatcgctcaatcagatcacaagtctaggccaagatccagagggagcaaggactgctgcgcgcggcagttatggagatgctgcaaagcgtgatcaacatccgcgaagcggtctcaaccatgatcaactttggggaagcgagcaagctggagaaggatctatctgcctcccggtctctttggacaaggctcgcgctgtcatctatcggggcgagtggggcaggttcaagaacaaggatctggcggcacttctctggcatctcaaggacgccacctatgacgcggaggatcttctccgcgagtccaatgatcaggtgctatggcagaagatggaggatgctgaccggagcttggcaggtcaatttttctcttcctctctaaatgttgtacaaactttgatcggtggtagcaagacaaggataaaggaggtccaagataagctcaacaaggctgtggctgatttagagggagagcttaattcagtgggtcttaattttgagatagttcaacacatgccagtgacaagttcagtcattggcgtgcctcaagtgtttggtcatgatgaagaacgagatctagtgattgagaagctaggtgtgatgattggacgtgacaatgaacgagatttagtgattgagaagatgggtgtgccactcaccaggtttgttgcagcacgagctaaaggaaagagagcagcagggggcactgtcgccaaatcagcatccacaccgaagcgactgaaaggagagagtagcagggctggacccagaatttctcaatccaaatgcatcggcaatgtttctatcttgcctatatttggtattggtggggtggggaagactaccttggctcagtacatctataatgacgagagggtgagatctcactttcgcatgaggacatgggtctgtgtttcagacctctttgacaagaaaaggataatagaagagatcttcaagtccatcaccaagaaagactcatcacaacatagttcaaatgatcttcaggaggaattgaagaagaagctaaagagtcaaaagttccttttggtgttggatgatatttggtccattactaatcgtgaatgggaagaacttaatgcactcttgaaggacggacttaaaggcagtatgatcttagtaactacaagattacaaaatgttgctaatcttgtttgcaccaacaactttgaaccttttgaactcaaaggattggatgaagataaattttggaatttcttcaaggactgtgcatttgggcagaagcgcccagctgattcggaatgtaataatttgcataaaattggtcagagcattgcttctcggttatgcggatctcctttggctgccaaaactctcggacgcttgttgaatatggagctaaccgtgcgacattgggagactattcagaaaagtgaattgtgggagctgccacatcaagagaatgagatattgccggcccttcaactgagctacttatatctcccacgagaacttaagagatgctttgcattctgctccatgtttccaaaagattatagctttgaatgagatgagatcgttgacatttgggtggcagagagccttgtgaaacttgtatccggagagaggacgcgtcctgaagatattgggattaggtatttggatgatttgaggagcaggtttcttttgcaaatcgatcccaagtacccggatgaaagtagatatgtcatgcatgacttgatccatgatatggcgcagtctgtttctgtgaacgaatgcctcttgctgcaagatttgagctctcggaacgagggcagaaagctacatgcagttcgccatatgtcggttcaggttgcagatgaatccttgaagagtgaactaagagacattcagtatttgaataaacttcattcacttaggttagggatcaacctcaaggtcgagattacctggtttaatcagctctccaacatcctatttatgagcctacagggttgcaaacttgtcaagctacctgagagcataggtgagttgcacagcctccgttatctcgatatatctcatagctgtgtaaaggaattgccggagaaattctggcgcctttacagcttacaagtggttgatgcaaggcgttcgagtttgagagcaattagtccggatgtcacaaagctaatcaacttgcgtcgtttagcactgccaacaaattgcgctctgaaattatcagtattgactaggcttggaaatctctctcgtctacgaaacttaaaatattttacagttgcaccaaggaatgggcggaaaattggtgagctgaaggacatggataagctcagtggaacgctaactatcaaatctatttgtaatgttaagagcaaggaagaggcttctgaggctagacttgttgacaagcaatatctcaagacactagatctatggtggcgagatagtgacggatacaatgtgatgagcagtgagaatggagtgctcgaaggcttgtgtcctccacgaagaattgaatgccttaaagtcgaaaactttaggggtgacagcttttgttctagttagtttaaaccagaaagcctaccgactataaggtccctggagcttgtcaggtgtcactgcttgaaaagtctatcgattccgtcattaccttctctggaacatctattactggcacgagtaccgattgaagaactaacagtttttgctgacgatacgccatctggttcaactgattgtgacaggatgcagcatccaagcagcagtaatggcattgtatgctttagaggcctcactagtgtacgccttatcaactgtaacgggctgcggaatcttgatcagttcttgtctccggattatctaccatccatcaagttcattgcgatcgggcgatgccttcgtctagtattacctagtttcgtgggatttgatcgcctacaagacctgagaatctcgtattgcaacgaggtgtgcccacaagaaatggttttgccatcctcactccaatgactttctattgtgaattgcggtgagcttgataggtcatttccaacctgcctacgggctctaacatctctcaccgccctgcatttggttggatgtaataacatggagtccattccgatcggcacaaactttcaggtccaatacctgcatctcaagaaatgtttgaagctatcatccatcggaggagcgcacgctctttcatcgtttcgttacgtgagcatatcggagtgcccggagcttcttcaccaagtacaacagccctttgaaagggacctgctgacaaaggaggagaaagaactccataattttcttcgactgaggctgattgattattaactcgtaaatacttccgatggattctcttctttgggcgagtaactttccgatggattttcttcatcatgcggcggcagcatccacaggccacagcactccttccagtatttcatctattttgtggttaattacccttttactggaacaaccaagtgaggtgtcttccgatgtgcttcttcctatgtagagccaattacggttgtttcctgttctgcaatttctcatgctcttttatcttcatgtatcgagccgttcttcgtgtaagctgatcatgcctgctatgtgtactagttccatgtccaatactataataataatgttgccaatactacaatgcagcatcatgagttgctgcaatctgtagttgccacttgctttacaagtttatatatgtatgggattttgcaatatttgcaatctgtaatttgtcaaatgatcgatgcattgcggaatcgagttgcttaaatatatatatgttggtacctgtgggcttggagcctttggataaaatactacatttgaccgtgctttgtttatatcattacatctttgctaggcaaataaaaaaaaatgaccacaactattgtttacaacagcagttcagatttaagtgtcaggtttagcatggtaattttattttcccgctattattcacaacttacagcatggattccgcatgaaaagaaaactagctactaaagttactcccttgcagatagcaccatgagaaggatatggttctttttcgctgatttaatggtaaccgtatgatccatctgtgaatatttggaaaaacataagcatgtgcttccaatagctacatatttgatgagaattgagtgtgtgcagtaatgcatactgttggacgaaatatagctgcagtaatcacatatgttatattacaaaacattctctgaccttctgtagctcatattttgttgtctttgctcacctgaaaccgataccaaattattttattgaagcacacaattttctgccttgcatatatacaaagttattttagcaatacccgctgcaatatgcggggtatcaactagtttaagaacataagccccggcaagtgagtgaacaacctgacacgaaacaggaatgccactggatgaactgcagaaaaccaacccttcatttcgagcagaaaaatggacgacctactgtgttgtgcaagtgtatagcaccactcctaaaactacgaacttacagaaatttaagagcggatgaacttggtgattatagaaaacgtagaaatccctggtttgagcctgatccagcacgatctcgatgaacagaaattctgcaaaatcacaacaggtgcagcaaaagaatgatacaaaaaaagggtatgtgtaaaccctctctatctacatttacatattatatcagatgcaaccaacatgaccaatcggttcaagcagtttaaaacatgtaaataaacacaacactcgtacttttgaaataaatggcaccataacatagaacatatgcaaataattgcagtacattggtttattggatacggaatggtctaaagaaccaacatgatgacacatttgatgatctgttcttttcaacaaaatatctcgtgttcaccataataattaaattaattttagtaaagtatgtcgcagaaatctcgacatacaacaattgacagttaaagctaggattatactaggatggaaagaactcaacaaattagttcacacgctcattattcttcttgagaaaaacagctttcctaccaggtgtccaggttaccagtaaaaacaactagataaggcttttatacatagcacagataaaggttgaaaatcgcaagttacaaccatgaccagtgtaagattgcaggtagtaatcatctgagttcagcatctagaatctccacatatggcagctagtaataatattaactacttcagtacagcaattagcaaggtcagttcgattcatcgactattccgtgttcaagcatcagagctatgtaattatgtttcagatcacagaattagtctttcaattcatcctataatttacaggcgtatccattttcatgcaaatagacaaatagaaattgtaaatgcatattgcataactccactggaaccaaggttaggaagaacacacctttattttgtaagagagagaattacagcagataagaaaaggttatgtgctaatggtttctagcttctgtacatcgctaggaagaatgcacttgagcaattcttagtcagcaaaatcttcagaaacgtgcagggctgaatgctcataaaccagatcatcagattgccattgtccgcttcaccaagcatcaagctcgctcccagtgtcaaccaacccctcggccacagctttcttcacccaaaactcctccaacgcatccaattcagcatcagcatcgtcatcgctcccctcaccaagatcacccacctcctcccagtcctcgccaatgccaccatcctctaacaagtcccaagattcaccatcgacctgtaccgaatcctgttcttccccatcctcctcttcatcatcttcatcactgtcatccgcaagagcaagaaggcccttcttcttagcccgcctcatccgcttcccctcgcggacaagctcctcaagccgatccctcgcaacaagcatatcatcctccacaagtagcctaccgtcatcgtcgaacgcctcgacaaggaacaccgagtgccgcaaccccttgacactaacatagaacaactctgggtgccgaactagcattgcgcgcagccggttcggtagcccgaaatcacgcctgaaatgtgtgagatgatccaccagtgttctcttctccacagtcatggccaggacctcccggacaaccgcgcacgcccgtcgctccatcatctccaagcttgcgccctcatcgagtggctcgaatggcgacacctcgggcaggctatggaaccgcaagaggtaatcccggtgcgcgcggcggaggttgagccctcgccggagcttgaggtgggggaaccttcgtggccggtcaatgaggcggtcggatggcgccgcggggcggaaaggcgggagcggcggaggcggtggcggcgggggatcgactagctggagtgcgtggccgtgggaggtgttcacgaaggtgaagaggtcggggtgctgcgggcagagcgtggcgcggaagtccatggcgaggccgagatcgggtgcgaggtgagcaatcttggacacgaggaggctccgcccgggtgccagaaggaggaggcggtgcatcttggcggcgaggcgtggcgcgagctcggaggagccacggagcgcggcgaggtcggcggcgagcgcctccgcggcgggggtgagcgcgacggcgagggtggagaggttgggcgagagcgggtgcgacgtgggcgcctggaagaggcggaacagcgccgggtaccggagcacgaacgggaccagcgggcggcggcggcggtgcggcgggaggccgaggtagcggtggcagcggcggagcacgcggagcgggaggaagcggcgcggcttggagaggagcaggacgaggagcttgcgggcgaagcggaggcggttggcgcgcgccgcctggcggtccagcgccgggcaccgcaccagcttcggcggcgggattgacctcgcggacgccgcagacgccgccgacggcgccgccgcgggcgcgggcgtgcagcgtacggccgtcggagtgggcggcgcggcggtggagggcgggggattggggaggcggacgcggcgggggtggatgggttgcggcgagaggaaggagagggaggaggaggaggaggcggtggtcgccatggcgagcggattgtggggaatgtgtggggtttgagatgagagacaggataggaggaaaaaggggttttgggctttttctttttttcgtgggaaattttattttcagtgttccattcttggcttttgtttcatggaaattcacaaagctgcgttaaacgaagcaatgaattaacacatgttaattattaataagtattaactaaaaagtttaaaatattaacatgaatgttaaaagcaacttttctatatttttttaaagaaaaatatattgtttaacaatttagaaaatgtgcctatagaaaacgagttataggagttagaaaagtgatcaaaagaacacacatccgtaaatctctctctatcaataaaattaagatattgtaagacagtaccagcagtaactacatattacattagtatcatatttgaacgtgtcttacctatactatcaataaaaaaagggcatttacaaatttaccactgtttttttttaattttgtaaggatgctactcgaatgatagttccagtggtatttttgcaattttttagtggtagtttcgcaataacgattcaaaaccgtggtaaatttacaattgccaaaaaaaaaaaagatgctagtggaccatcactacccaactatcatgttgaaatcataaaaaaggataaaactttgtttacaacaaaattagcagcatggtaatataagggtgctttagggcgggcttttgaacccatttttgcttttacaaaagcaaaaaccaaccaaaaagctcaaaagccatagctgcttctacccaaaaactgcttttgctctagtacaaattgaaagcacctctatctcctgctttgagctgcttttgggtagctcctccaacacacgcggctgtggcctcactaggcgaggcgagctcccggcaaggcggcgagttcctcccccaccgccgccacccacggggagaggatcttcccagcctgctgctatcgccgcgtttcccccctctaatttgccaccgccgtcaccggccgatgccccctcctctcccgctgacgctacccatggggagaggatcccgccgaggccacgcgtagcgagacgatctcaccgaggccgctcgtcggtctgccgccactgccgcgtttccccctccaatccgccaccgccatctccggctgatgccctcctctcccggtgccgccgccccttcgcccgtcggccgtggaggtgggagacgagagaggtgaggtggtcaacggcggtggcaacaccactgcctccttctcccggggccaccgcccccttcgcccgtcaggcatggtggccgccgctgctccagccgcaccgactccaccgcgcacgtctgcctccccgctgctgccgccgaggccaacggcgatggcgatggccatctccatctcttcctcttctcgtttttttcaacgtgtgtatgacatgtgaggcccgtttgtcagcaggactagttatttcaaaagctacagttgttaaaccaaacgagctttttcaaaaggcagggaccatattccaccgttgcttttataaagccacaggcccacaactcatagctacttttccaaaagccacatctcaaacaaacaaaccctaagtagataacatatttttaagactttaataaaattatatataatgggctatttttaatttaaaaaatccgttgtaacgtatgtgcattatgctagtagagaaaatatatctgatgatattaatatcataataagaacaaatatatcaaactagcttgtctttaattacgcaagtactataatcatagggttgtatccaagaattttagtcaccgagctaaaggcacaaggacaccgtacattttggagaatgtcgataaaaaaataattttgcttcattacataactgaatcatacgatttttcatcgtactaagaagtatattaggcattcatgattaaagactaagatattagtcagataacactagtatatatgttaggagtaccatacattaggtgagttggcagccacccgatcaaaaaaatagtgcgacagagtgttaatggttctgtatctacagtaaattaacattgttcattgcgttggtctactgtaatactcacatggatagtgaacctctgcactaatatgcagaggatcgggctttcgggtctgctctctgcaacagttcattttgaacaattcatctgatctctaattctatagtagaccctatttatatgggactaaaacttttataaatattaaacgtagactataataaaatctattcataattttggactaattcgcgagatgaatctagtgagcctaattaatccataattagcctatgtgatgttacagtaaactaattaggcttaaaaagtttgtctcgtaaattagctttcatttatataattagttttgtaaatagtttatatttaatacttttaaattagtggacacctgtatccaaacaccaccttacactgtttttccaccaccaacttcaatacgtgtcgcgcttcgtcgctgtaatctcaaaaccatagaactaacagccacgtacacataaaccgccacagtttcttctcagtacacgtctcagctatgtcacctagtacacatgctcaggaccaagaacggcatttccctcaatatctgatagttctaatccttctgcctcccaagcccaaaaagccccatacaccatccacgcaggtaaaattgagaaagggaatcaactatgcataatttatcacttcaggctagggaagcggaagagccatcggattttatagtcaagctatttacaccttgccaactacatcacattttggccacgagtagtgtgcagtcattcaccacatgaatacgcaggtggcagtcgttactgtcagtgacgtggctcagtttatcacacatcggactaaatattcttctccatcacatcaacccatacgactccaagaacttacacaatggtccgaggggtggaaacgcgggaccgtgccagtccgtagctccactctaaaacgcgggatcgtcgtggtcccacggctccagaacgcagcactgacgtagctagcgattttttactgtgttggtactgttcaccactatttgggtcactgttttggcactgttcgacactatccacgattcgttccgcacaatggaacagcgggaccgatgcgtgaacaatgtcaaacagtactaaaaacaatgtaaaattgctcactatcacggtcctgtattttggagctacgggactatcgcggagccacgcgactgtcccgcgggactgtcggtcccgtattttggagctgcgggaccatcgcgggacaggtaaatttttgcaattcccttcctatgcatgtatataaacgtaaattattgaaaaaataagtatattcgtaatttttttctaagtatagttagcatattatgacactgctaagcatgttatgataccaatgaactttttttttatacgccgcttattgaatcatgcgatttttcattgtactaagaattatattaggcattcatggttaaagactaagatattagtgagataacatttacttctactcatccttttggtattccctaaaatgacttgtacaacaatatcatcatatttaatcttcaaaacatacttatttctcttagccaaatggttctgtatctacagtaccgttcattgcattgatcaactgtgacgcagaggatccggattttgggtctgctctctgcaacggttcattttgaaccattcattccatatctacttctctagttatactgtttttcaccacaaacttcaatacgtttcatgctttgccgctgtaatctcaaaaccatagagctaacacccacctacacataaatcgcctcaatttctttgtacgtgtctcagctatgtcacctagtacacatgctcaggagcaagacagcagtgtttcccgaatttttttgagaattaatattatttttatggaaaatcgcaaaagtagtggccaacgggggaaaatcgcgaaagtaggtccctgtcgaacgggtgcaattcgatagggcacctatcgaacgacgggcagtcgacaaaaccctgtcgaacggctggcgttcgacacgctcacctgtcgaacggagggagttcgacagggcccaccacccggcgccgcgaggcctgtcgaaccgggggcgttcgacatggccctccaccgaccctgtcgaacaatgggcgttcgacaggccggtttaaagccccgtccacccaggccgcgagttcgatttgtttgaggaccacatcgccagccgccgccgagagtcgccacatcgtccncccgtaagccccgaaggaaccaagggaagggaaaaccggccggaaaagaagcccaagaaggcccggccgcgaagaaaagggt

SEQ ID NO: 40887 - DNA, 1532 bp, Oryza sativa
agagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaacaacgttggaaggtggacaagctgaaaatgtttggcggactgagcaaggtcgaggggaagaagtagtagagggtaatacacaaggagaggtcattgttcgtggtactaatcgtgaggccaacgactcggatgatgaagaaccggattcgcctatgcgtgttgatgcaacggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagagttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcatccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttaatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcataatcaacaaagaaagtttgatgccatatgggatcaactggatcgtttgaccactacacacat

SEQ ID NO: 40888 - DNA, 6752 bp, Oryza sativa
attcctgcagccctggatagatggaggcctgagacccacactttccacctcacagttggagagatggtgcccactctgcaggatgtgtcttatttgttggggctgctgataactgggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtattttttgttaaattcgtttatgttatcattatgaatactagttcacaaactttccttatatgactaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcagatctttgcacgcgagatatgcaactctggatgacgacttgtcacctcgtggtggacgtgcacgtcgagccacacaatgtctacagggttctcaaacagttgggcatgtatctggacttccctccgagagatggtcgtcctttggctgatagtcttcataggttagttcacatcacagttgtttaatcctacatttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcattggtatcgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgtaactggttaaataattttaattgccttgattatttgtggaacaggcggaatttgttgagcatgttcacgtggagtccgacaccctactgcaaagactagaggcaagacctccagtcgtcaggcttgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcatggatcggagtggtccatcctcttcacgtcgcgggtacgaagcggcccacacatctcacggtcatccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacaacattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaatttcttcagataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaaataacttattacaaataaatggagaacgcgaccctgtcgaactgcgccagttcgacggacatcctgtcgaacaggggcagttcgacagccctgcctgtcgaacggggctgttcgacaggtcctgtcgaacggcagccttccgatctcctcgccagtcgcgctctggccgttcgataggcgccctatcgaactgcacccgttcgacagggacctactttcgcgattttccccggttgaccactacttttgcaattttccataaaaataatattaattctcaaaaaaattcgtgtttccctcaccggctgatagttctaaaccttgtgcctcccaagcccaaaaagcccgaaacacatccacgcagctaagaccctgtttagatgggactaaaactttaagtccctatcacatcgaatgttttgacactaattataaatactagtaatatgcctgtactaacgttacggtgatgtttcataagacaacagtgacaaacagaaaatgcactgtttcattaggcaacggtgataaacagaaatgaaattcctgctgagaatgaaaacaactttacagtgtaaatgaaaatgatgctgaccaataagtttactttcacaggtgtaaaggccgggtttaatataaatccattatcttaaaaaataagtatacttgttcctcgcaacatactgtttacacataaaacttactaacaaataaaactcattgcatgatcagcttcacttaagctttcagaaaggttctctaaaagataatagcaacacatacaacaggagtggagaccaaacataatttacagggtcattcacatgtacaagtgcaatagacatgctttctccttttctcgcctctagaagtaggaatattgattcaaaagaatggtatgctaatagttcacaatcctactctcccaagttactctaggaatgttgactttgaagatcatctgatttccaaacaacatcatttaaggtgttggagagattcttgcaaaacttacacattaaaattacgtgattcagtacaagacatttaatcaaaggctaaaaattaaacgataaattataaataagtgaaacccaatttactaagcttggagaagaataggctaggacgaaatcttatcagattaatgactcaaattttccaatgaaagcccatgaacataaggtcttaattcacatgatcgccacgtaaaatatctacctcgtggaattccaggttgcaccctctcttcatttggttgataataatgcacaataacagttagattgaagattgaaaaagtttttacacaaagcagattgcaatatagcatttttttatattgcctcattagcaacattgggatttccttttctccttgtttttaccttttccagaaactattcaatcatcaactaaaaagttcaacacgcagcaaatatctatttcaatttgctataaattatgcctagaaggctagaacctatttttttcaagggaaatttatgcaaatagttgttggacaaggggagcagaccttgtaaatttttctgcacatggaatacaacagttaatctgcatgagaagctgagagagtaaaaaaaaatctgaaggctcataaaaatctgaatttatgcaccatacagaggatatatataatactattatgaactgtaagtctgcagtatataagaacatttgtaagaggtggcacggcgtattcgaatactcaacgactctgcagcgtctgcccagctttacccacacgatacccacagctggccgggctgaaaagtaacaaggtgtaatattgctccatatatctctcccttctgcctagtaagttaaaggatgctcgggatgttgctcggagtgatccggtccaaggtgtgtaccaacctacctctgcatccacttaccattgttcgttattcgatgggcagcccagaacttcatggacccatagggtagttctgaactctcagggcccatcgagcccacatatataaatcatataaacatgaaccatttcactttgcttcacacacttgaaagctaatggccagtacaccgaaaggccttcagaagtttaatcaattggagcaatatacgaccaggttctacaaatcgatcgtgtggatgggcgaaactatgtcattcttattgacacaagggggttgattattatatcaattttaaataagaaataaccatagatatatccatatatccatcacaaccataaaaaggtccataaaaccaaacacatgaactctatcatgtgtaccatccgctcacaagcggtgttaacaattcttagcatatagctataaatagttccataagcatgttttcatatgcaatgataatatccatactaaatcgatagcatgctaaataattaatagtttgtttaagtgtttctcaaattttatcctaaatttgttagactctaaggctcattaaggtgtttataataacaacagaaaatataatgcaataatagtaatataattaatttaaaaggattcatgcagtctatcgtactccaaaggacaagtacgctaccaaaataactctctaactactgggattagattgttcaagggagggtgcatatcttgcaaccttcgggcttgatgtagtcgtacaaaccgtctcctcctatcgcggagatttcactcgctccgactaccggaccagcgtcagcgttttctatttacgcaacaatcatcaccacaataaataacagaaaaacaaagataaccaaaagaaaatagtatcacaaagtgcaacaatgggtgaaaaggatttaaagaaataatttttggaatttcggtgaacggcgaaccctagggctaaaattagggtcgcgacaacgggtgcttgaattgcaacgaaactgacacgcatggattcggaataattctaggagtttagaataggtctcagattttgattttgaggtcaaacggatggtcaacttgataggaagataaaaaggatttttctgattaatttttcaacagaaaaatcggatttttcttttcttctctcgctctgcacaggaacggctgacaactccatggcgccagtggtggagatggccggttttgggcaaaggggcgccggttttgtgatctacagggtgcagcgactctgttcccgtggttggcggcggtgcaggcggcggcggcctggagcaggaggcggcagcggccatggtcgcggtggttccagcgaacttcggtgagggtgatggctatggtgagcatcagtagagcaaggggagcgcggtggtggcggcagctcggcctggggcggcctggagctgtggccgaacagagcggcgacaccgggaggcggcgccggcggcactccggcgtcggattagatgggggaagagaggggaaagggagtactcggcatagagaatccgtttttaccttcaatttcagaggatttgcgatgtatgcgacaaattttggagctcaatcaatggcgccgatattagggtttcggggaattttccagcgggggtaggggcggatttgaggaggtgaaagaggtttaaattgcgcttcttttgcctccggtattgagtcttctagttaaggaacgaaggagatacggaggcgggaagctggaggtgtcacggcggcattcgttcgtcgttcgtcctcgtgcgagcgtgtgcgggcgtgtggcgcgcgcggggcggcacgagctcggcgcgagcgtgcgcgggattggtgcaaggcaacacggcgctggctcggtccggaaatgcgggctgcaggaat

SEQ ID NO: 40889 - DNA, 2468 bp, Oryza sativa
  unsure (1)..(2468): unsure at all n locations
nnnnnnnnnnnnnnnnnnnnnnnnnnnnnnnnnnnnnnnnnnnntatattttactctttttagtatgctggccaaacttgtgatgccttcaacttaatttgttctattacagatggaaatggtttcaagacaagtacaatgagacttggtgctgatgttttagttttctcccgtagtggtggaaaaggtggcaaaaggttaagttacacttcatcttgacaaacatttaaaaaaaatcattttagaagatgctgctaacatgatatgtttacaattccctaacaaccaaaatttctttggacagatgagctaccagaaagcctgtgtagttcatcaaacttgaaagcaccaaatgatatttgttcaatttagttagcaggtcaaattaatttccctggtgtaatgcatggtcaagaatttgatttaaatctatattgcatgaccattgtgttctgaaaagcaaatccttttacactgtagggaatgtataatcatgaactctctgcgtttccagataaatcctttttagttagtgtatagtttatatttttctcccatatgaccaacacttagatattaagttaaccagatttgctatatggaaatgacaccattagttcaatcatcaaaagtgctattatgcattatactgaatttatagttttatcaacacaatgtgataagaattgataattggtgatcaaaattttagtaaaatactttagtttcttaacagttgaaacttgttcctttaccattgcacaactacatgtggcatttctttcattatttgttgtgtagttttgtagtacgtgcatacaattttagttattttcctttatcaagaaattgagacctttacttttcctttatcaagaaattgagacatttacttttgtttggcatgaaggcttacccaaagtgttggcatgctatcctacacctttctgaggagcaccaacaaagaggatattgttgttccaatggtaggattccttctttggtgcttttcattagtttcaaatttttaattttctctagacctttttttgccctcatataaatttttttaccacccacctgaagcatccatcctcattttttttgaatatttatgggaggatactaaagatatttcctgtcatacctttctcaattttgtcaactcatatcattatgcaagttaaaataaacactatagtactgaatggaggggatactcttggaaaaatatttatctggaaattagttatgtcgtgtgtaatgtctttaccttctgaattttcctatgtttatgtgacaaattcagattgattatgaaaatcaacaaggttggaaaagaaagccacggactacatttgctgattggaacacaagcttacagactattattacatggtcgccatattcaactgaagcagaactacttgagcaggtataatttatgcaagatcactaaacaaatatgtatttctactgtaattatcaacatgattattggttcagttgcttgaagtttctttgtcatgacctttcctttcaaaagaaaagggcatctgtgcatactcgacaatggaagatgtttcctggagctgtctatattttagtttcccatttttagaaacaaaaacatattattgcgaacctcagcacgttccaaatggctgtttattttgcagtttagttctataaaggaacaagggactcgtattatcatttacaatctttgggaggacgatgaaggacatttggagcttgattttgatgaggacatacacgtatgttctactactaagtattaataacactgtgccaccatgcgcaccatatattttagttaagcagctagtaaggtttttaatgattgtggaatgacaggatattcaactcagatgtggcaatcgtgatgagaaaaatatcctgatggctaagcagtttccgaactccaagcatttcctgacttataagcattcattaaaggtaactttatagtaccttttgaattgaatatgcttgatgtgttctgatggtgctgaattttgttagtattaggctattagcatgcaatgttgcctccatttgtgatttatgtggatttcatttatgcagagcacattattctatttgtgccatgcgataattgtttgctggcccagtcagtcatgccagttcaaaatgacttgagtatcctttctgtgcaaagctatgcatccattttatatctccgagttccaagttttttccaaatgattttacgtggaaaagagattgagcaccataatattgtgactgacatgatgttgaagaaagaggtgaaatacaagccggttgcacctaatggtgttccaaaggattcaaatgttaagacctgtaacctcataactctttcctgaatactgaggatgtattgatagctcattactgatcaaaattttcttctgtatctcagatggtagccgatgtaacaa

SEQ ID NO: 40890 - DNA, 1446 bp, Oryza sativa
atgtattatttgttgaaatatgtgaactttgtttcttttagcctttctggagagtgtggactgccgctggaagtggtgggcgtggtgtcataggtaagtgactatgtggtttggtttcttctattctatttattcatccacttttggttctaggaatgactgacttactctgcacaggtgtactggaagctaattttatagagccagctcatgataagcaggactttgagagaacaactcttctagcaagacttgaagcacgattaattcaaatgcagaaagactattggtctgttttcttgtcatttttcttggtttacttttgtggtcacatgtcacattatcaattctattgtaggccacattttggcttatctattagttagagatttgattctagttttcacatgcccccgtctctacttctcacaggtcaggaaatgctcatcgaattggatattctgggacacgtgctggcagatccaatgaaacagaaggtaaatgagccatatgattgttcgacattgctatggctttatagtatagatatgcaacttagtttctttaatattttgatattttgttattacttaccttgagtaacaaaagttaatagagtatcaaagttaacatcttaaaaagtttgtaatgttgcttcatttgttgggtaattgggttttcaaagtgctgcgttccttttttgactctctcaagttctgtcaggtagtttgtcacattatgtcaattggacataccaaaatggataatagtatgcagaggatgttggatcgaaatgatttcactatgagtgtccaatccatttgtgcaaattagatacgtttcccattgaatctctttttcttatgctcaaacaaagcattctgtttctttactaacagaaatgatgaaaatatacaaaaataagcatgacacattgtgtgcagtgcctgtcagtggaacttagatgacacagtatccttggtgtaccccctgataacatttcacttactaaatagaaaaaaatgatatcggaaaaactcgatggggaacatgataactttagagtttatacatgcggttgattagataattgacaatagtttttagtagagtcatctgtgtaaagacaaggaataatagccctatttcaccttatcattcttcttgtgctggtaataaggaggccatatattggcaaacatatatgatttctgaatggtgttcatagatatgaaacatcatcataaatgcaatttcattgtgcactccatcctgagcacctgtgtttttaacaagtattctatagatatgaattggtgtgcacatccctctgctaaggcttgcttatccccgttacgaatatgtgatgatcgaacttatttatttgccttcgatcactaatattaaaaaatgttgtgtaattttggcattaggggctgcaggaat

SEQ ID NO: 40891 - DNA, 2208 bp, Oryza sativa
attcctgcagcccaacgtgataagaacaaatcgttaacagagagggtatgcacctatatataagtccttccccctgtagattgttgatatctaaactgtaattctttgggcctgaaatatattatgttggtgccattttggttcttaaattttgagtgacaaactatttgaacaatgtgatatattagtaaaaacaatagcaatgacaaaatatgatgctttgaagtctaaattcgcaatttgttccatggaatagcaaactaagtgtttatctcagtacttgttgagtgcttcacatttcctcatgcaggtcagaattcacaggaattatcttgacatgtgatctcgtttgcttgaaagtagattcaaatgctgttttgttattttctttcttatcaagctttcacaatttcatgcttccacatttttacaggcgtttggaaactgttgtgttgcaatttggtgttcttaattttgtcggtttaagggtacttagcatcgtttctgcctgtagttttttttagtacttgatggacaatgatattttccatcttttcaccacaagaatacgctgcaatcttcatgtaatgtatattgctgatcccttacacaacctttttgttttccagttagaggatgcacagaggcaactagaaacttcaaacaaggaacaagaagcattgattgacatcttctcagaagaaagaggtcgacgagacctagaagaggaaaatctgcgagggaagctaaaggtgagtgcgagagaccgagcaagtatatctttgtactaaatcgcagtatcactgctacttcactttgataagcaattcgactctttgccaggatgcttcttctaccatacaagatttgctggagcaattaaacgctgcccgaaaaggtcgcaagttttgagaaaaaatagctattttgctaccaaaaattcactaaccggaagacctctagttttcagttacactgacgtgaaggattccagccattctagcttgtgtagggagaggctgtaggctattcccctatgtttagtgttgataggtagttccatcatctcacttccagatcacttccagcattgtgtacaggcaaggaatgccaataaaggctactgttagtgatcggtatgtgagtttgtaggtaaaaacactcgctaggccttttaatacttaattagtcatttcgttcgttgtgttcaatgttacacgtggttgtgtcaaatcagtctcgattttttgtgcctgggcttttcatcctctttatctcgagtctgacagtgaaacagtgttaatcaacggccgtatgggaggtaaaaggcatggcttgagccttgaggtaacggactccagctcactactcaactggtgtgaacacagctatgtgccatttgatagggtagtagattgtcattttattttcttttggaagtgaagcataagtttgccatttgggaggtgccttgtagcttcttttaagtaaagctagacaagctatcccagtaaggacctcaatcacattgcttattgtagtgtcaagaaagttcgttgcagattagtgtctagataacggattgtgtgtctgtagtatattagtgtctggattgcggatagccgacgctaagtttcaatagtggaattaagaaaaataaccataaaattaggttgtgtatcaatattaatatcaagtttcacttaaaattaaaatttagaatgcatgcttaatttctctggcatttcataacataaaaattatgaaataacatataaatatataagataaagaagatacacaatgctaaattattctatccatatgttgaaagaacatcgcttacacattgtagcgatgcgataaagtcaacaacggtcgtgaagcactgtaacaggctcctatagcgtcgtgaagctatagcagtcgctaagttccaatacgctaaatgtagtccgctatcttgtagcggtatcggtatagcggccgctattgcggtcactacaaacgtgctaaatatagtccgctatcttgtagcggtatcggtatagcggccgctattgcggtcactacaaacgtcgagaaccaatcttctagggctccttaagaacatagttttttttttcttttaatatgaatgcacatgcaaaagcagaaagtcgaaacacagggtaggaaagattcaacgaaatttcacatgaaaacttg

SEQ ID NO: 40892 - DNA, 10624 bp, Oryza sativa
tgacaaattgattgagagctaactaccgaggatatatggaaagatggtcggcgagatcaacaccaacgcttggtttgtcctcttcacgggtggcgttgcaaagaagatatatttccctatatatagcgtcttgcagagcgaagtaatatggctgattgtacgtagtggagtggagtagccgcaacagcttcctaatcgtgcacgcgcgcacgaagcacgggttgccggcctgcctataacgatcatacatgagtgtgtatcccccaggtgagagcctccaggactccaggtgtggatgaaggtctctaatgatgactaatcagttcgatatatagatgtatcaactggatgtatatatggatgattggtcgcacggaaagcagaccgttttgcttcgtcgtcatgacacggttggctagctactttttttttaagatggatatttttttactcggcctttacatccaaccggatatatacaatctttttaaattaggaacttagcctgtcaaacagggaacttagccctcgaataacccaatctgaaatttgctcctataaaaattaaaactcaggactttgatttgttacttaggtcactgcaaccactaggctatatgccctttcacgttggctagctacttggcttggcatggctggtggcaggggtgaaaacggtacggaaacggacggaaacaacttttatcgttttcgttttcatatttttttcggaatcggaaaccccggaaacgaaaacggaaacgaatattatcgaaaccgaaaacggagcgaaaacgaaccggcgcggatacggtaacgaaaatttattggaatacaaaaacccctcaaactgagcttcaaacttttgtcaagtccaattctcaactctagtcaacaattcataataaaacataattacatgaaatcgtctcaacagcaaaatatatccctctatgacttcatatagattacataacaagtattctaaacaaagtacagcagacaaccatggtacaaggtgtacaatatacactattatgcatgctatactgctaatctggtatgaactatcactccatcatcagtacataagttcatgaatcatcattcatcagtcatcacagaacacagcaacacacatcagtccatcagtacagtacttagttcaatcacaaaactacttgcatttgatgattcgatccatcgtaaatctgcagcacaaagaaatcaaatcggtttaggctcgtcggctcgtcgctaggctgctggctgctgccgctgggctgctggctgctgcgactgctgaggcgaggcgtcgtcggctcgtcggtgtggctgtagcgtcgtcgtcagtggtggtagcggcggcgagacagcgggatgacgccgcggctgcgagacggggccgcgaaacggcgggacagcgccgcaagatagcggcggtacgagacggcgaagacggtgggggcgaggtcgcgaggagcagaggacggcagagaagcggtggcgcgggcgccgggcggtgggcgctggcggtgcgcggagcgcgatgctccgccgctggctcgcggtctcgcgaagtcgtgtgcctgtctctctcctctctagggttagccactatttgtgttgggctggaaatttagggatgagttatagactattgattctatgggcctttttaactttggaaattccgaccgattccgagttccgatggaaactgctattatcatattcaattccgtttccgagaaaatatttccgttttcgattccgtttccgagaaattccgaaaaaattccgactggctgattccgtttccgaaaacaggcccggaatccagaaagtttccgtaccgttttcacccctagctggtggtggcgcgtatggccctcctccccctcacacacacacactaacgacacaaccgctggtagagatatactccatccattaaaaaaaaccaagctatgcatggatgaaacataatgcatgacagcgattctgaatatgaacatgtctagattcattttcctaggttatgtcttatccatacataggttagcttttttgggacggaagaagtagagtgttgtggaaaccatcggataaaagcaatctgaattgcagataggaattgaacacaaataataagttcagggttccgtaatgagcaaaccggcgatctaactgatcacgggattatacggcaaagtagcaaagctaaactttaatctaaacaaaacccaagaaactctgaaggggtacctaactatttataatggtgtgagaacgaccaagtggattctagggtcgtgctccacctggttggggcgcaccccacatgggccccacttgggccagggtcccaaacgaagttacaagcccaaaggcccatgacaggtaacacagcaccttgtttttgtgtttgcggccaaacgatatggagtttggtgatgaggctggatccgttagaaagaggactctgagagctttccatcaagtactcatgggctgaaaacggaggtcgtatgcagattcggtagccgtttgaagtcagcagggtagcaggtagccgaatcggattgcagaacttggacggcttgatcttgatgtgaacgacggttgtatctatagtagccatggtcacatcatatacttatgtgtttgagatagattaagatgaggagcttaagattaagaaattcgctagtgaaaatcaattttcacagccaacacttttgactcaaccgccagccaagagatatttttagccaaaaaagaaaataaaatccattttcatgacaaaaacacatcaacttttcaataaaaacatatttaaatcactccagtgacattcaaacaccaatagattagcatcaatagattatatatggacaaacaaaaacacaaaccactaaagaaacctagataggtgccggttgtgaaccctataggtgccggttgtgaaccttgtcgacgtttgatgtcgcgattccggtatttgcatagtatggagatcgttggtactaggatatatgcgagattgaggtaaaagagatggggacgaggattttttatacaggttcgggtccctaaattgtcaggtaataaccctactcctgttggtcgaagccggtcgttgctcttattgaccataatcacaccagtacaatatttggggtagcctatctatctgttatcgacatagcggactgaagtatcatcgcgtagtcgacaacagagtactctttctccttgaatccgtgcttggcgagatcaaagacatcgctagattcctctctttggttcccgtaggtaccatatgaggttttccttggcttatctctgatgtcgatatctagcagcttgtcttgtcgtatgtaggcttgtggctttgtggcgtctatgttgtccttgtcccctctcctcctagggggccttgtatttatacccataggtgtccccttgtccaagtagaactagggaaacaaatatggatacaatccgagtagtccttgtcgtttccatgtagaactctggttgtctttccttatccggaactccatctatatccgaggtcaatttccttataagacatggtatgtggtgggtcctgccgagatttagtcaactactattaggtatgtggtccataaccctgacaaacccggaataggtgccggatttcccatccgacacttagaaggcggcagagatgagagaaatcaaaggtgccggtttggaaccggcacttttgtggtcccaagaatccaaaaataaaaatggcttgatgcatagcttccaatcacccaagaacacaatcgtacaatcatgaataaaagaaacatccacaaaaatcatgaacaaaatcgctgccaccaccggatggaggagtcgatgctgccgctgaggagaatggagccaccactgaagagagaggatccactattgccaccagggagaatggagtctccgccactggggcttctccttcttctccacccttgccacaagctcccctctcgctgggccgctgccgcctcccctcccgttagatctggcggaggggagggtaccgccaccgtcattggaccgctcggctgccgccgcctcccctatcgttagatatgacaaaggggagggcactgccactggcgccgggtcgccgtctagtggcccacacctcaaatcctgccagatggagagatagagagctgagagagagggaggatataacggtgggtgcaatgaggagataaggaggagagagtgagcagtggatgggtgcggtgggttggctcgtcttgattttacgggtgtagtttgtttttttttaaaaaaaaacgacatataatatactataagtgtcggttttaatatataatatattatagatgccagtttttttcaaaaaccagcacctatagtattggtgttagtttttctataaactggcacctataatcgttcaaaggtgcccttttttgtattttcagctcgcgaaggtgggaaatggtctatcaataccagttttagcacttccggcacctatagtgccaacctctatgtgtctttttgtaatagtgacatcatcgtcgtctcatatagcgtcacgacgttcgctgtatcatcgagctccatcgggggaggtgcacgccgatctagccttcctgatgacgaatccaaaccacgatgagtcgccaccctccccttcgtgctaacttgaatagaatatcggaattaactgagaaaggtctagtcacgccgatacaagcgaagttgacataacttacttccttactaaagatcgaaacgatcttgtcctgctcgaaactaagaactcatcgaaataaatggtgacgatgcgccgaaagtaattatattgattcatgaagatatagtctacaaagactttgggtgtacatatttataccctcatattgatacaagttcttatcgggcataggatatgactcttacaagaaaagaaaaataactaatcttccctatttaagagatatattaaaaatatgaaatttcctctttgaattcagcttgatctggataaacttccatctaccaaacaatttttttcgtaaccaaatccactagagaccgtaccaaattttggtgttaatgtcaagcgaaagcaattattttagaaggaagaggaaaacctagggggcttacgtcctcatttcactctttttgctcctacgagacacaactcaactacattacattttagacgatcaaatcactaaatgatctctctctacggcacttttcacttcttttaggaacacgaggagccttaactacgactgttgcacttcactcagccgccaacactagatctagcggccatcgaggtctgtctcagctagatcttgtagtttcgaagttggctgtaatccctatccaaagaccggtcctctgttgctgttgtcgttcggaggccggcctgtcgtcgccatcccattgctgcctacttggtgagagagaggagagggaggagtgaagaggagatggatgcatgagaatgagcagagaggaatatgagaagagagacagaacgaggagactgcctgatattttataaggtccgtgtcgaaacatgatttcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatctagttgtttcatcatgcccctagaggggctccctgccctccttatataggttggggggcagggttacaagatagaaaccttaaccaatacggcatcggtttcctaaatctactttacaatcttatcaaaccaggactttaggccgttccataatatacagggaaacgtaatacccaagtcatgatctgttacatattccatagacataagttatcccctatagccagtcggataactatgccatgtaggtatggggtacccataatctccacagtccgacggttctgtataaggttcatttttacaaatggctctcttaaaattgtcgtctgtctgaaaatcaagcttttggtacattttcggtacatttttcttgtgttttgtttgtccaccgtcattaagaaaaaaggagtgcgctaggaaaaaacattttttataatgctctacacgatatcttaactgattaaatttccatataataaataataaacgaaggcaaacattcctcaaagttgccttgtttctacgcatctgacggtgggattaaaaaacaaacttctccgggagaacaccacaaaatacaatacccacatgtccttaacttaagagctttccaattaaatcccccaacaatatatgaacagccggatcaatgaatatccattatccaaatgacataatgttgataattagagatggcacaacactagatcaatgtgaatccactgtagccacttcaaatacttgtaacatacccaaattctagaccttaaaaatttcctatcaaaatagttggaagctaacttttccgattttgagagctaaaaatttccatttttaacctaggtgtggtcaatctaacttgaacctaagtaaaatttgagaacaaattaaaaatttttcatttataacctaggacataaatgcaaacacgagtaaaagcatgcatacttgcataaaacatgttttgacttgagtccttcatgtgcatttgaatctttgatttgcatttcataatagatctcatgaatattaactaagatctagataaacaactaaaccattagggcctagtgctagctagaggaagttaaaatagaaaccatacaccttaaaatatatcaacatagctaatgtcaagcctcacaaaactaatttggatatccatctgaagacatgtcatgaacatgaaagtgaacaaataaattatatcatatagggtatattctatcttaatcatctctataagcattctcttaatttaatactgaagtaaacttatgcataaataggtaaggagcttatgacatgtgtaaggtaaactgtaattctaacatatcaatatcacctcaggttaatgagagtccaaatataacttttataaacatttacatgcatttaggaaagggaaacacatataagacataagtcttgagaattatctaaaataattcgtgcaagataaaatcatgggaaaattcatgtaggctctactcaacacatacaactcactgtaattttggtataatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttatcatgaataaaaataaattttccagaatttatcttctctgtttaggtctcctaaaaattcgaactagtttccaaagaacccatattcctctaatttctgtgagtattctatccataaattttgagtgcaaccaaagaaaatagaatctaggtatcttcatctaccttcagaaaaatccacaccaaattattctacccacaagttaaataattgaattactaaattgggagagagaaataatcctgaaaatcattcaaaccttttgttcacccacgtttctgcgcaaccctcttaccctagcttagtttgccacgacctggacccacttggcagccactctggctcatcctcaccctgtgcaaatcttccagccgaccagagacagccgagagagagagagagattggcgctggctgtgtacgacgcgtggccacaacgtgtcgacgccatcaaactcctattctagccttctcctcccagctgcatctccacacatcattctccacctctaagccaaagaaaccgagggaagaggctctcaacttctccgtcgccctcatccttgccgccggccgcgaagaagacgactatcgtactcgtcaataagccagggtaatccccatctctttcgcgttccatactctcatcaccatgccgaggatttatcctttgaatttcatcctctatcgtgcagcggatcgacgggaacgccgtcgtgcccacgtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccagtccacaggcaaaccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagcagttgaaagcagtaaaacggttgtagtaattaatccatattaaccaatcactgtccaacgttacaccacgttgcaacaggcccaaaccacctcttgaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaaatgccatgggtgcgactagcaagaccatgcacccacagcccaccatgaagtatattttaattaaccaacaccattgcggtggcactaaatcaaagctatgccaataatcaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacggccgaaatctacgcgacaaacaaagcacacaagcaaaacatgctataagactactgaaacagagaacaaaaccatttttaatggattctacacatttttatgaatttactgagacttgaatggacttaatcggagctcggatgaattagttatgatttttagaagattctctgtgtttttactataaaagaaaagccctaatcaatttattgcgcaatattgccccagggctgacgtcagcaaggggtggggcggcgccgacatgcgggccccactggtcagcgacactaaaagagagagagggggcggctggcaggtgggcccactgggcagtggcacaaggcgggaggggcgcggctggcaagcggggcccaccgggcggcggctcacggggaaaggaggaaggcggcctggctcggctcggcttcaagccggccggccggttagggcgagggcggcggcggcaagcggcctccgacggcggcggccggcgagaagacgacggcggccggcgacgcgggcgacggtgcatcgcggcgatgcgcatgcggggagcggcggcgcgcgcgggaggaagagagagggagttctcaccggggttcggccggcgcgggaggaaacgacggcaaacggcgacggtgagcgaccgaagggcgacggcgaacggcgaccgagctccgggacaccctaagagaggaagtgtgaggggttagagggagagagggtgcccacgacaagcgagagccatggccgacggcggcggctatggtggtactcaccggcgcgcggagagaagcgggccctgatggcgggattggatggggatgcggcggccggggtagctttggcggcggcgaagctaatggcggcggcagattggctcggcggcggctccagcggtggcgagcggcgaccggaggagtggaaaaggcggcggcgacgggtgtagcggtgcgggagtgatggagggcacggcagggctcggccgagaaaggaaaaagagagaggaaggtgcgggcgtgcttaaataggagggggggcgg

SEQ ID NO: 40893 - DNA, 22868 bp, Oryza sativa
ccgacaggtgggccccacctgttggcgcccgggaggaaaagggaggtgggatggacttcgggaaggggagggggaagcgggctggcgcgggaagaaatgggccgggccgacggcccaagaagagaggaaaaaggaggaaagaaaaagaaaaagaagaaaggatttttcccagggatttaatattgcactttgctcattttaattggttaaaattatttccaaggctctgaaaattccactaaaaatcctgttagcgtattttgacatgtagaatccaagaaaaattccacatgtcgattccgattattatttgcatttattaatttagggtttctctcttgcctttaaacaaataatttcttccaaccatttattaaatgaatttttgctagggaaaagaacttctgggcgcgacaccacggcactccggagcacgctccaagcgccgccgcagccgacatcgtcgtcgttccgaccaccgtagaccaaaccaagccgagccgtcgcgccaacgtcttctctgttagcagtaatcttgtgtgccacggttagttagttgattagttatctgcatgtttccattttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcatgcgttgtgttcgtctggtttcctgctagcgatcgctggggaaattcctaacaattggtatcagagcacggtttaggaagtggactcgtgaccgcgcattggaaggcgtcttcatgccgcgtcgtcgctcgtcgtcaccgatcgtgcgcactcctcatgactccggcggccgcgccacgggcagcggcgggggtgaccgcgggctggtgatccaccgcgtggtgaaagaaggaggcggctcggtgaactacccgctgctgaccaagaccaactacaacgactgggcgctactgatgaagatcaagctgcaggctcgctgcctgtgggcggcgatcgagcccgacggcgtggacgtccctctgcatgaggaccggatggctcttgacgctatctgcagtgccgtgccgccggagatgattggcaccctggcgaccaaagcgtcggcccgggaagcctgggaatgcatcaagacaatgcgagtcggcaacgaccggattcgcaaggcgagtgcacagaaagtgcgcgctgagtatgaatcgcttgcgttccgcggtgacgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactcttctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggattgcgagccccgagagcacgaactctggttcggcgcgcaagggagacaaatgccgaaattgcggcaaacttgggcactgggcgaaggactgcaggagcaagtccaagcgcgaagaacaggctcacgtcgcccaggaggatgaagaagagcacaccttgatgttgctcaccggcggctgcgttgacacggtcgacgcggcggcgccggagggcgacacgcccacaccgccccaccaagccgtggtggaactcgtggagatgaaagtatttgcagcgctcgacgacgcggctgaccatgatcccgggcgctggattatggattccggcgcgtcaaaccatatgacgggcagcaggatggcgttcgccgacctcgacacgaacatcaccgggaacgtgcgactcggcgatggatccgtggtccggatcgcaggacggggcacaattctctttgcctgcaagaatggtgagcaccgcactctgtcgaacacctattatcttccccgtcttgctgccaatattatcagcattgggcaattggatgagaccggcttcaaagtgctggcggaggatggcatcatgcgggtctgggatgagcagcggcgtctgcttgcccggatccctcgcaccccagggcgactgtacatgcttgacatcaacctggcgcgcccggtctgtttggcggcacacgccgacgaagacgcgtggcgctggcatgctcgcctcgggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgtgccgctggcgctgctacatggagatctctgtggaccgatcacgccggcgacacccagtggcaaccgctatttccttctactcgtcgacgactacagccggtacatgtgggtcgccctcctctccaccaaagatgcggcgccggctgccatcaagcgtactcaggcggcggcagaaaggaagagtggacgcaagctccgcgcgttgcggacggatcgcgggggagaattcacgtctacacagttcgccgagtactgcgccgagctgggaatgcggcgcgagctcacggcgccctactctccgcaacagaacggcgttgtcgagcggcgaaaccaatccgtggtgggcacggcgcggagtatgctcaaggcgaaggggctgccaggtatgttttggggagaggcgataaatactgccgtgtatctgctcaacaggtcgtcgtccaagggtatcggcggcaagaccccgtacgcgctgtggaacggcgttccgccggccgtgcaccatctgcgcacgtttgggtgtgtggcacacgtgaagacgaccaccccgaacctgaagaaactggatgacaggagtcgtccaatgatctttgtcggctacgagccggggtccaaggcgtatcgcgcctatgatccggctactcggcgtgttcacatctcccgtgacatcgtcttcgacgaagcggcccagtgggactgggatgctgaggcggccgctgatctcgacaccgacttcgtcgttgagtacaccacggtgtaccatcctggctcgctgtcaggaacacgccaagacgcttgggagccgcctgctcgatcttcatcatcgccgcgaacgccatcagactcaccgacagccggccgaacaccttcggtgcatggcgatgcgccggcagttgaatttgtgtcgccaccaactggagcagctgctaatcttgatgcagaccacgacgacgcaccactccgtttccgcacgatggacaatgtgctggggccggccatgctgccaggtctcgctaatcgtgaggtccaggaagagctgatgatggtgagcggagaagaaccggcaacgttcgctcaagctgaacgcgacgaggattggcgtcgggcaatgctcgatgaaatctcttcgatagaggagaacaagacctggaggctcgtcgatctgccttcgggacatcggccaattgggctgaaatgggtgtataaactgaagaaagatgctcagggcgtcgtcgtcaaacacaaggcgagattggtggcaaagggctacgtgcagaggcctggaattgactttgatgaggtattcgctcctgttgctcgtcttgattctgttcgtatgttgctcgctctcgctgcgcaggaaggttggatggtgcatcatatggacgttaaatcagcgttcctcaatggggaactgattgaggaggtgtatgttgttcagccaccggggtttgagatcgatggacaggagaacaaggtttacaggcttgataaggcgctgtatggtcttcgccaagcacccagagcttggaacaccaagctagactgcacactgaagaaacttggcttcaagcagagcccgttggagcatgggctgtacgcgcgtggcgatggcagtgggcgactgctcgtcggtgtgtatgtggatgatctggtaattgtcgggggtgacagtggcatgatcaagggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccacgtctaaagctgagcaaggaaagtgcaggatcgctagttgatgcgacagaatacagaagtctagtgggaagcttgcactatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaggaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaatttcatttcattcgtgaagccgtggagaatggggaaatcacaccgagttacatcggcacagaagggcaacttgcagatatcctgacgaagccgctttctcgaatcaagtttcaggagctgcgggaacaaattggtatgtttcctgtataatcggcacatcaagcttagggagagttttgttagcagtaatcttgtgtgccacggttagttagttgattagttatctgcatgtttccgttttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgcgttgtgttcgtctggtttcctgctagcgatcgctggggaaattcctaacattctccttgaagtcttcctcaaaaaccctaaaaaatcctaggcaatggcgcagcaagtgcggagatcggctaccgtcgtcttcacctccggtcgccgtcgccattgtcgattccgcctcctccggtgagccattgtccgattattcgcgtatacacatccctgggacctcaataaccccatgaaaacacatgcatgtcaattcgatgagtggatcgagccgttgccgtcttcccggagctctacaccgtcgccggaccatcttcttcaccgctgccgctgtccagactttcccgcgcctcgttcaaggttcggtgagcacccttgagcccataggattgcattcatgcatttcattcacatagaatcgagcaccaactcaacatgcagtagcagcctaagcacagccgccgctcggactcgccgccggcgttactccgatgtccactgaccgagaaaagtagaggaatggaatcgcaatagcatgatcttcattttgtcttttgttcgcaccctcaaacgagccaccgtttgccgctggcaagcttgagatcgagctcagccatggcttgatctgcttcagctcgaaccagggacctcctcacaagaatttaggttaatatagggtcctttctgtaaaagctcaagacacacagaacagtcataggactgcggtttgatttcctgaaaccctaggggcctttttgcatattggcctgagaccgacaggtggaccccatgagtttaaaatctaaaaatgtaaaagataatactaaaagcctttactttttaacagcaaaacacctaaacttgtaaaatccatgtaaaatcaaatataacttattttgagatgattcaaatttctataggttcacaaaactatgaactttaatgtggtaacattaagcttggcaccctcagcacaaaccttgtctctaaaatgggcctaagataaatcatacataaagcatacacaaacttataaaatgcatataaagtacatctcaactcattttaaatgcctctaaaactattacctttaaatgactagttttagataagctgaattttagaagttcatataaaattcatcttagatcctttttgagtaaacccaagttctgtaaaatcatcaaaacatatacttccaagttataaaataaaattatatacttactgtatgataaaagcctctttatgtaagtaataaccaacatagagcaaccttaaattgtaaaaattgtagaaaattcatctttagtctaaatgaagtgaaccaaatatctatagaaccagcaaacagtgggcttcaacatagtaaaataaaatatggaaccttctgtacaggttatagctctaaactttaaatttatagtataggtgctaatcacatagtatcgattaagcaatatgtatatatataaatttatatagaaatacactctagctataatgaaacccaaataaaacttgttagaccagtgaatgcatagttccatccccatccaccaaaacttaaggcacttagctcatataataatttataggttgatataataaattgctagcatggactatagctcccctagtttataaaatatgaaccatgataataaagaccataagcctatgaactaaggttagattagttaactaaaatactcattttatacatcactagctagatgaggcaagttctggacctaaacttctaaagccatgaacctatagaacactatacacctataacacgttataacttgtaaaatatataaagaattcatattaagtccaaaaattgtgaaaccaaatgtgttagtcttagaaaacactcctctacacctctgtgaagtcaaaactaataaacatcactttatagaaatattttataacactacctaggtgatactaccttatactgaggaaacttctaaaattcataactcccaaataaaaagagttaaaatagaaattatttcacctaaattcatattataccagtacatattcactgtgcacaaatcatcattttagagcattttggatttttcgcatatttcggtgtttaattgcataacgtgtactttgtatagatgattgcttaaatggtgaagaagtgatttaggtgctgacattttcctgattcaaggcaagtcccacctccctctctttgatcactttgaacctatgttttggaggttattgaaaatgtttgtaaatcttgcatgtcgattgtacactaataaattaaaatttttgttaaacttgttagacaaactcctattgtttgcattcaccttgaccccacatatatccatatccctcattcctaaccttaggaacaatatgactataccactttatatatgagttttggagtcactaggttactataatgcttagccatgcttagaatggtattccttgtcattatgggctcattacaaacatgaagattgatttttaaataatctggacagaactttaatacttgtgattttgataaataaaatgatggaaaacatgaattttaggtttgggcctcaagtggtgcacatatggtgattagttgtgtaccgatagggggagagtgtgcccaaaccggcctaaggacttcactcaatgtcagttcatttcatatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacgtgtatggcttagaatggagtaacacgtatcgtactagtgtaaggctaaatcatgaattttggaaaagctttgttgcgggtaataaatcgggtacttatgtatcgcgtgccatgctcttgcatgattattatttcgcatcatgtaggtaaagtgtataaactctgcagagttaaaactaatcgattagccgtgctcgcggtcatgagtggcgtgtggatatgtattgagtatagacttgtgtttattcttctaaatgttgaaatttatcttcaaattgtgatgagatttgagaatgatctccttctgccatggaaggcaatgaggtgcatatttatacatgattaatgcctaccttgatgcccaatatgtcaagtactagcttgctgaaatttatttgaaagtaaacctgatttagaaatgttttatgcaaataaaacttactttatgctaaaaagaaccatattatgccttccttgattattgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttggggaaaatcaacatatgcccctagaggcgcccggaccccccttatatatgggaaggagtccgggttacaaaagataatctatatccctaacggaatacacagatacagatcaaatacagtcgtgaccgactaaatcttagggtgtttccttgacgtacaagttaggaaacaaacccaggatacacataagatattctatctatattcggtatcctatattcagtccaaatatcttcgccgtgtagatatgggatatccataatctccacagtagcccccgagacctttgcagtcaaccatcatagccttctcaaagataataatccgagtgcttcaaacttttcgtgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaagtaatagcataattgtgcatcatatgacaaaagcatacgcggcgcctaaagaggcattccagccgactgctttttagccataataaaaggaatccgagtggttaacactctaaaaggttcatgaatgaacacaactgacaggcatgcgagtataatactctaaagattacccaccaaatattataaaaattatggtaaatagtcatagcctaggctattagacttattcattaccataatgaaaacaggtatataacataccaaggaaatgactatgataaaaacaggtcattccaagttaacccagacagcttttgtagcctaaaaaagcttacaaaaacagtataacacctttctgtcgggcaccttttaatttgcatagcaataattccaaagaattatatgaccgcataaaaaggattttatcagcattgggcaacactattgtgcgcataaattgccaaagcaaaaaatgcctaagtccctaaggaacacaatgggccacgctgttaaaaatattgggctgaggtactgttcaggcctaggcccatttgcacctccgatacccttaacaagaaaacccgagatccaagcgacgcttcgtcttccccgccggaactctcgccattttccccactccttgctacagtaaagagctgcgccggcaaactagggttcaccattccactcaaatccgccttcgaaaagttcatcaaaatccttcccgcgatccaccgcctcaattcctcccctctcccaagccatccctcgaatcaaatcagcgcattcgggtagaatcaatggcggaagagaaagaaagctttgaaggccaatggacgccgtccgacataacagaagagcacctgaaggagatggtggcgcacggcgttctccctgtcaaggagatcatcgggtggcggccagcgtgcggtgagatttttccgacccccgatacacacgagattgtggtcttctctcatttcttctatggcggcttcgcttttccgacctcgaaatttttccgcggaatattaagtttctatggaatcaacttgcatcacctaaacccaaattccatagtccatatcgccaatttcgtccatgtttgtgaagccttcttgggaattaaaccccacttcgctctgttccgccgaatctttttcctcaagccccaaccaaacaaaagtaagccatgtgtagtcggaggggcaggatttcagttgaggggaactctgagccaaaaatatttctctatgcccttcaagaccttaaacaaagggtggcatgcgaactggttttatgttcagaatcctgagcctgctcttcccgagtactcttgtcttcctccaacgtaccaagatacttggaactctcttccgatcggagatgaagctgctcaagccttggaattgatggaccgcatgctaaaactcaaagaacaaggcttgcaaggagagcagattactcggcatttcatcaaatgccggctggcaccaattaaagaaagatcccgtacagcatttgagtttgacggcaaacatgatccaaaccgtgaagacccagattctctggattttaagatcatgaaggagaggatgtacaagatattctcgaacgctattgtcgtcagctactcacatcagctgccagttgtgccatataatgcattcaatccgcctccgcaggtatgcatctgaaatcttcaatctatgaccaaaacatcatctttgtcttcatgctgagttaactaactgtggagacatctcattcaggagtatgcattgatgaaatctgatcccccaatcactcagcgccggtcgcctcgtcagcacaccgttcagggaggtggagggccaaaaatcagaccagatccgcaacctcaaacctccaatccaactggacagacaggttctcgcaagagaaaactggtgctcgacaatgatgaaggcgacgacgataaatctggggacaaggactcgcctaataaactcccaaagcgtagcatgcccaagaaaaaactggctggccgtcaaatgccaaagattagaacatcttccaggtataaaccccttggtaccattttatttcggcatgcttctctcatgaaaataatattgaaggttaaaagaacacttcgcaggaaaccgtccgatatagatccaactgggaaagatccggatccggctgcgacagagccaaatttatccaaagatgctgagccaactgccgaaaaccagccgactgccgaaagccagccgactgccgaaagccggccgactggcgcccatgcttcagatgacaaggccaatccgagtgaccagccgccgactggaaaccagtcggcagctactgaaactgcaacaacccaagagcccccgactggaaaccagtcggatgcagatctaaatcaagagattcctgaagctgaagtgcagacaacttctcaaggaccagaatttggtaatgactcggtgattgggtctccggataaagagcaagaaacacctcacgctcagctaggcacatcctcaggtaactcatcttctcaagtgatgccgttctgaataactccagcttgttcgtctaatgtcttgggaatacatcaggtccactaggcggcgacgaagaagaaattctccgcataaaggcagctgacgactctcgtcctcctatcttactcaaatggtgggacgagaactctcaagtttccggcattgtcataaatcgccaaaaagaagatgaggaagtgtgccggctgaagaaagtacttggagaagctactcgcattgtgaatgtaagtcttctaggtgactgcctttgatgactttgttttcttgttagcaaaactaatccatgaaccaccgtgcagagaatccatcttcgcaatgaggccaagaccgcaaccttagaaaagctggttcctcatttgggaactcttgaagccgttaggggccagctacacgaggccaaggagcatgccaagaaaacggagaaagagttaagggaccgaatcgctcaactccaggattcaaactacgagctgagtggttcatcaaaaggtaatctctagatctgtcccatttatgctgtcataactatatcctcaaccatttggatttcaaacagcgcaagccaccagaatggctcaaatggagaaacagattgaagccttgaaaaaagacaaagcagaactaactgcagaaagggactcggccttgaaggaggtcgaaggtactgccagttgtcaatctgaacttccctctttttaatgcagcagattcttattataaatatgttttgtagaccgtaaaatcaaatctcaagctcagtttgacgtcctggttggtaagatcaagaggcttgaaggagctagagatgaagtcgccaatgtcgctacaccacttgtccaagctatgttccttaataacagtggtccgagtacacttgacgcaaccgaaatctttgacaggctgagagttgcaccagatgtatatttcaagaacatcaagaaagctggaagtatgggagctagcatggcattggcgatgaccaaatccttgtacccgagaattgaaatcgacaccattgatggatttgcagacgggacaagcgaagaagctgctcttgatcttatcagcaatgctcaaaatgcggctgacaaaattgcaagtgacgttgtagagcaattccgcaacaacgaccttcagccgaacaacaacaactctgatgatgaaaggactgactctgactgagtatgaatgtaacaaatggaggctcaatttgtacaatactggtgtatttatgctgtgcttgatagttctagccaaatctttgatttcttaaaagcttttatcaagctttgttgagcctaaaacccaaagaagctattaaaaactttcagtcctcgcagactaagtagaaaaatcgaacaaggcaatgataaaccaagtaagcaaattgaattgataaaaaatcacaccccaatattatgataatagcccccgactgacaacttcaagaagaaaacttgacgttgacagtcaagatagggaagtacaatgataaacttaagcgtagaaacgacgaagatgttcaatgttccaagagttgtcgacgagagtaccgtcttcgcgcttgagtcgataagagcctggccgggtgacttcagagatgataaatggcccctcccataaaggagataacttgtgccgatcccgtgtagtttgaattttccgcaaaaccaggtcgccgactaaaaaggcacgggatcgaacattgcgattatgataacgccgcaacccttgtaagtatcgagccgagcgaatcaaagctgcttcgcggacttcttccaatcgatgcaagtcatccactcggtcctcttcgtaacgttcttcacggaaatttcgaaagcgcaaagattcgaattcaacttcactcggcaacattgcttctgccccatagacaaggaaaaaaggtgattggcctgtggcccgactgggtgtagttcgcaaagaccaaagcaccgatggcagctgttgcacccatttgccagcatagggttttagccggtcaaagacacgcgctttaatcccttgaagtatcatgccattggctcgctccacctgtccattgctcatggggtgtgctactgaagcatagcaaatcttaattccaaagtcctcgcaaaagtctttaaaaactccgccagtgaattgtgtgccattatcagtgatgatccgattgggcactccaaatctgtgcacaatgttgatgaagaagtctcgagcgttatccgccgtgattgtgacaaccggtttagcttcaatccacttggagaatttgtcaatggccacaaagagatgcgtgtaaccgccgactgcctttttaaacgggccaaccatgtcgagcccccaaaccgcaaacggccaagacagcggaatagtttgcaactcttgagctggtaaatgaatttgtctggcaaaaaattggcaaccttcgcacgtgcgcacaattttgtcggcgtcggacactgcagtaggccagaaaaaaccctgccggtaagctttgccgacaatggtgcgtgcagcagcgtggtttccgcatatcccagaatgtatgtctttcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggctctcgccagtcggcttcaaccatagccacgtcatgagtgcccgcaacttgagtagtatctttgtgaggtactgtcggcgcataaaggtgttcgacgaaaacatcagagggcgccatctcgcgcttggatccaaaattggcaagtctgtcggcggcttcattgttgtgtcgaagaacgtgactgagctcgagtccatcgaacttgtcttccaatttgcgtacctcttgtcgatatgccatcatattgtcgtcaaggcaggaccactctttcataacctggttgacaaccagctgtgaatcgccacgaactattagacgctttatccctagggaaattgcaatccgcagtccatgaaggagggcctcatactcggcgacgttgtgggacgccgaaaaatgtatccaaagcacatagcttaatctttctccagttggagaaatcaaaaccactcctgctccagtgcctgaaagtcgctttgatccgtcaaaatgcatggtccagtgctccatcttctctgcgggggtatcctcctggcactcggtccattcagcgacaaaatcagctaacgcttgggacttgattgaaattcggggcttgaatgatatgtccaaagacatcaactccaaagcccacttagcaatccgtccatttgcttcgcgattgtgcagtatatcaccgagtggaaacgatgtgaccaccgtcaccgagtgaccttgaaagtagtgagatagcttcctggtagtaattagaataccatacaacagcttctgaacctgagggtacctcgttttggagtcggctaggacctcgctgacaaagtaaattggtcgctggactttctggacatggccttcttcctcgcgctcaacgaccaaaactgtgctcacaacctgggaggtggctgatacatacaacaacaacggctcctgcgggtgtggtcaggctaagactggtggctcggtgaggaatttcttgaaatcttcgaaggccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttaaggatagcggtaactttctccgggttggcttggatgcccctatgagacaccataaaaccaagcagcttccctgacggtactccgaaggtgcacttttcagggtttaatttcatcctgaaagcacggatgctcgcgaaggtttcttctagatccgagatcaaatcatccttttgcttggtcttgacgactacatcatccacataggcttcaacgttgcggccaatctgtgttgagaagcatctctggatcatgcgttgataagttgctcctgcgtttttcagtccgaacggcatggtgacgtagcagtatgccccaaagggcgtgatgaatgaagtcttcaagcagtcggattctttcagtcggatctgatgataccccgagtagcaatccaaaaaactgagaagctcacagccggcggtcgagtcgactacctggtcaatgcgaggcaacccaaaaggatctttagggcaggatttgttgaggtcggtataatcaacacacatgcgccattgccctgttttcttccgaactagaactgggtttgccagccagtcgggatgaaggacttctttgatgaagcctgctgctaacagcttggttaattcctccttgatcgcgtctttcctgtcttgtgcaaatcggcggagtcgttgtttgataggcttggcatcttctttgacatgtaaggaatgctcaatcacctctctaggaataccgggcatatcagatggtttccacgcaaagatatctttattgttctgaagaaaggtgatgagcgcgctttcctatttacaatctaactcggcgcctattacagcagttttagtaggatcagaggaatctaggtgaatcttcttagtcttggcttcgctttctccactttttgaagtcttggtagcaggtatttctccttcgctcgccgtggctgcagccagtcggatatcctctcgggcagacgccatctcgcggatttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcagcgacttcaaagctgatgttctctgtgcggaaattttcccgagtgccaaaagtgaccgggagggtgatctggccgagtggagttgcggataatcctggaattactccgtgaaaaggcgcattgcttggttttagctcggagcgaggaatctgcatatcatccagggtcttggcgaagaggatgttgagtgcactgccaccgtcgatgagggttctgcgaagcttgacattacggaccactgggtctagtaccagggggtaccgccccgggtggaccactcggtcaggatgatccaagcggtcaaacttgattgcgatctctgaccatcgaagatattggggcgtgtcgggctgaacagcattgatctcccgttcggtcaacttttgcttccttttagactcataagccagagggccgccgaagatatggttgagctccgtgcggtggtcttgaaatcctgccggggcgtcgccgtcgtctttcttcttcgacgtgctttgttcttcgtcggagttcttccgtgtagtcttggtgtattgatccgcaaattgcttgtagatgaaacaatctttggccacgtggttggagttaggatggtgcgggcattgggagttcatgatcttgtcgaacgtgttgacgcgcgaacgctgtcgagaagagtgactggcggttgcaacaagttctgcaggcttacgcttgcggtccttatgattgttacttccacctcctcccgtagccggcgtatccttttttggcttccaactgggaccagactgctttgatgcgatgacggcgtcttcagctttggcgtactcgttggctttttcaaacatgagcttgactgtcctgggaggcttacgcccgaacttgccgaccaattcttcgtggcgaatccctttggtgaatgcggcgatgatgacgtcgtcggtgatgtcggagatcttgttacgttgttcagaaaatcgccggatgtaatctcgaagggattccccggacttctgaatgacgttgtagaggtcgtattgtgtgccgggacgctcgaaggtgccttggaagttggcgatgaagtggtcgcgtaactcggcccaagatccaatcgtaccacggggcaatccatggagccaagatcgggcggaatcctctaaagccactggtaaatagttcgccatagccttactgtctcctcctactgcgcggattgcgagaccatagacggtaagccacgattctgggttagtggtaccatcgtacttctctattccagtcggcttgaagccggctggccaatccactcgacgcaggtcgtcggtgaaggctgctactccatcaaggtcgtcgtcgtggcggtccggcgagtgatgatagcctcgagctgctcggcgctgtatgattgtgtcgcgaagatcgaaggggtggcgacgaggtggtgagcggggccgttccactcggcgctccctatgatgatcgggaggtgagtgaacggaccgctcgtcgtgtcccctgctcctgcgattggatcctgtgccggtgatgctgaggcttggatgacggtagtcatgagatcggaagtgggggactcggctgccagtcggcgtgtggacgctctcggagttaactgggaccgaagctgcaatcatggtcttcgtctggttcaagatgttgacgacgtgatcagattgattgagctcgttttccctgagtagggtgtcgaggagggtgatcgcggcaaccgcattctgttgaggggtgcgaaaaaccggcgtcccttcaacatcttgctggccgatgagatcacgcgcccggcgccctgcttccaaagctcgctgccgtcggtcctcagcctccttcgcggtccgctcactctcctgctgctcacgccgtaaccgttcttgttcttgtgcttgatgctcctcctccagtcggcggcgctcttcggtctcccgggcttggcgttgctcctccgtctcgttattggccatgaagacgccaaagtagagaggggtgtaattgtcatctaggcttccgtcgaagtcgtcgagatccgcgtagttgtagcgagagctaaactcgtcgtactccacgatgtcagtgggacgcgagtcgacggtggaagagctgttgtagtcatccagctgatccgtcgaaaccgagccgagtggttggaggatgacgccaacttctctgaagctaggcgaaatcggtgttgaagccgacttccgcctaggcctacgggaaggagacgctgtcgtgatggagacggccgccaaatcgtcggggagtttcatcagtatcggtgggtaagccccatcatcttgatctggtgatgttggagaagatgcgatctcagccgagtggtttgaagccgactcgattgagatggtcttgaagtagctttcagccgcgtttgggaatccaaacgggactgagatccggttctctcccgactggtccgattccgagtcaaggagagaaatcttgccgaagttgttggtgacgaagtcgaggctgccgaaccgaaacgcctgcccgggtgggaagacggggtcgtcgatgccggagacgggacccattgcactaatcggcgaaaagcttgacgcaacccctacctggcgcgccaactgtcaaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttggggaaaatcaacatatgcccctagaggcgcccggaccccccttatatatgggaaggagtccgggttacaaaagataatctatatccctaacagaatacacagatacagatcaaatacagtcgtgaccgactaaatcttagggtgtttccttgacgtacaagttaggaaacaaacccaggatacacataagatattctatctatattcggtatcctatattcagtccaaatatcttcgccgtgtagatatgggatatccataatctccacaattatatgccttgcaaatagggtgttaggcttgtcttggtgcttgccatgtattgactcttgctattgaattaatcttttgcttgcaggttttagacttagtctttgagtgatgcgggtaatcaactgcttcttctaggacttgaacttaatggggtaaacccctagtctgtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgatgtagatctttagccatttttgtcaagtctcctgaatgtgtaacacatgtggtcaccgccttcgagtggtttgacgggcacatctcaggctgaagttgactggcaggctaaaggcctagcaatgtctccaatattcttctctcgaggcgttggatgtttcattatgtttgtttgatgacttgaattattcacttcatccctcaaatataatataatgtaaggtctagaaagcctacgacaatactgccatttgagaccatctatgattatgattttttataattgatctacgttttcatatactatcacataccaacttaaattgggtcaacgtgccacatggtcactgctcaaaaagcctttttaacgtctatttgaacagtcacgtgcaaattttaggaacctgacgtgcaagtctcagctccacggttctaaccacctaatgctatacgtacactcacaaaatttgagacgtatttcctctctcctaaaaatactcaattgaggtggtgtttaaaattcatatagataaagataaaaattaagtgttttacgtaaaatgaggtgatattaatgtataattaattgagttttaataattacaaacttgaaaattatatttatttgatatttgatagtttgaaaagcatactatgaatatctaaattttcattcaactttttgttggagaaaagaatctgaacggtcatatttccttttacgttgagttttttctggacggaggaagtaactaaatggtgacattaatcatgagcaccacaaaatgttccttttttttttatgattgaaacacaggaaactctctaagaataatttcgtttctacaggaaactaaagctatctagatgacacgtcttaacatatataaaatctagaaaaatattaccgtcgcttctttaggtgagctgtgaattttttcttcattagtatgtcacgcatacacagtcggaaacaaccgtgacacggtgatggatagggtgttaataaatacttcgtcctaatatataacaacctagtataggatagttgctatatattgggaccgagggagtatgacgttaaccgcttgattattgttattataatcgagcccgtacaaattaagaaaccactcgataaaccggctatatagaaaaatcaaactgaaatttattttttttcataaaattgtccaaatttaattgtttgttgggcaactgagcggtaatcataattatcgacaaaaccgctagagagcagagtgactcggactgaacaatttttctcgagcgcgcaaaaaggattgcacgtcaatatattaggagaatagaatatttgttaaatgacgcaatcagtcagactcggaatgaacaattgtaaactagacaccattaacagggaaatttaccttttctattttaaaaaaactgtccaaatttaattggttttaaccgaacaaaaatcatgattatggacaaaaccactcgggagcaaggtgacttcctctttaacgattttgtaaaccttgtacactattgacagtttgacactgatgtgacgctccgtaaaaatggtttactacttttaaaacgatttttacatggctattttcaaagtaggactaaatgttttttttttaaaaaaaatggagaaaacacaatgagatgactgaattcacactgctaccgatcactgtcatcgtcgccgtggacatccctgtcagtttgtcactgcactcatcatacttaatcgccattacccccaagcaattccaacctaatcacaaagcaaccaaaccaatcatctcatctcatgatctcatatgcactataaataatcgctcaattcaacggagccaaacccacacaagaaatctcacccaaaaaaaaaaaaccaaccaatcaaaaaccaaaccatggcgcgccaccgccaccgcctcgccgccgccgcggcgctcctcctcctcctcctctcctccgccgccgcgctgtcgtcatcggcggcggagggggaggaggacccgctcatcgagcaggtggtcggcggcgggga

SEQ ID NO: 40894 - DNA, 5844 bp, Oryza sativa
aggcccccatcctccccaccgacggcctccccgacgacttcgactggcgcgagcacggcgccgtcggccccgtcaaggaccaggttaggatcggatcacaccatcggattaatttgggatggattgaaaatttgaaatcgttggagttgtttgatgatgattggttggtggatttggggggtgggggtgtagggttcgtgcggatcgtgctggtcgttcagcacgtcgggggcgctggagggggcgcacttcctcgccacggggaagctggaggtgctcagcgagcagcagatggtcgactgcgaccacgaggtatgtccctctccttcgtcttcgtcttcctcctcgcatatcatcatcaagctcttaagtttcttcttcttcttctcgaattgctagctctcgttgactatgagttaatggaactcggtttgattttaattttgattcgagtagatagaatagaaggaatgacgcagagggatattcccgtgggttgctttgttgtgaccagggttaaacctaacggtttagccgatttgatcggtgcccactgaaatgctgaaatttttcggtccgaaattttcgaaattttgaacaaaatttaattgaatttgaacaaatattattaaaattcatgaaaatatttgaaaatttcgaccgaaataatatcgtatcggagggggtccgaaatgaccgaaatttccaaccctggttatgacttactagctgttgtgttgtccttatcttggtttattctgtcctggttggtgagcgacagaaactgtagagtgaaagcaagttggagactcagttctttctcacttgaagcaagttttttggtgctttggatgagaagtaattattttatttaaccaaatttatcccaaataaattcgattgcgtcttacacattttgtagtagacttcacattttaaggttgtattcttacctcttaggttcccaacctccactctctcatttaccgcacgcatgcttcctgaattattaaacatttttgcaaaaattcctatagaaaaattgttgtaaaaaaaccatattaatttattttcaagttttttagctaatacttaattaattatatactaataagcaatcctgttttccttgcccaaaggagagtcccatcatctccttccgaacacagccttatccacatgttatctttaccatttttaatttcatcaaaaggtgcagctaatatatatgctatgctcttgtaaaatttgcagtgtgatgcatcagaatcgcgcgcatgcgactcaggatgcaacggtggcttgatgaccacagccttcagctacctcatgaaatccggtggcctacagagcgagaaagattacccgtacgctggacgagaaaacacctgcaagttcgacaagtccaaaatcgttgcccaagtaaagaacttcagtgtgatctccgtcaacgaagatcaaattgctgccaacctcgtcaaacatggccctcttgcaagtaaaggattcaaacatttgcaaaaatttgaacaaattgctgtcatccgtttgtctattgctgatgtttttgttttttgcagttgcaatcaatgcggcctacatgcagacatacatcggcggcgtgtcgtgccccttcatctgtgggaggcaccttgaccatggtgtcctccttgttggctacggatcggcaggatacgcaccgatccgcttcaaggagaagccgtactggatcatcaagaactcgtggggcgagaactggggggagaaggggtactacaagatctgcaggggacctcatgacaagaacaagtgcggtgttgattccatggtctcctcagtgactgccatccatacctccaaaaaggaggagtaggataggattagtctcctctttgtctttgcataccacacactttgtaatttgctcttttgtggttgaaactgttagtggttaggaccattctgtggtgttgctcgattgctatttatgatcagcaaaaactgtgaaaacttcctttacttgatgtaatagtacatatttgttcggatcattacatagtgtttggacacatggaaatggctgtaactgtgacaatgcatattagtatatataatctggtgaagcattcaacatttgctgagaagtatggtattgatcaactatgtgttcttctgccaagtaccctattttcttctgccaagtcttcagaatagtttctactgctactgaaagtaaaaataggatctagttttcctgttacaaaggaggaactcaattctagtggatgcagaattacgaagttaaccctacatccccagatgtcgtttaaaaacgtgtaattcgtttaaagcagataggattgcaaacaacaaacaaatctaccttttatgtacatgtacatcaataacaaaccaaaattatgtaaccaaaagaacaaacaaaccttaaccatgccacgaaatcaacagaccaaaaatcaaaacaaacatgtacaccatcaaccgtgtcaccgttgatgccaaaatatgcctgtcctgcaaaaatatagcacaagtcaagtacagaatcttgcaaatttggaatttcatgcgtgaacttcgaaagaccacaagtggaagaacagaaagtagctctggtggcttcacactgtgtgggggcaatgaacttgttatattgcttacaaacatttctttaaccaaactatatcatgcttaagatctgtaccacccaaactgaacatgttttatcctatctaaagctacccatgaccttttgttcataggttatttttttttagtttgttcagtaagaattttgtcttattgtatttggactccatagacacgtctgcccagaataaactcgaggacaaagcttaagtaattcaagagcagatttgcatccagacattcccaggccacaattgctgtttttggtttagacaaatggagcttactgatggggctcaagcgtttttctgataagtaatgctttaattcaacaaaattgatttgtttcaggtgcttcaatacatgagtatgtacaaagaacacaaaaaagaaatgataaggaagtacagatgaattagggcagtaggaggctgttgaaaacccatgcagcttggcctaattaggcacgtattatatggaattgtacaagaaactgttgtgtatagtaccaagggagacatcactaaatagtttgtgctttttgtgtaaattgaacccagtgtaaactggcctctttggtccagtgtgagtgaatactaatcgtcaaaataaatctgagctatgagaatccttattgtcggctgagcgaatgtagatttattcaaatagctcctggggattgtctaaccttattcaaagagtttatatttcattttacaaatctattgcttttggtactacagttttgcatccgcatacattttaagtctattttattcttatagttattttttgcgacctttttccatcacatacagttagagaaatatctataaaactctattctcattgttttatgtttagacagcacattctcattcaattaaatataatatttcttaaaacataaacatatgcccatatccgatgcactacactcaagggactatatatacacacagatgtgtgcaagtgctaattcttattttctttctttcacggtacacaactatctaatagttaacacattgtgtggaaaaatgggtaccaaaaaggaacgatttcacaaggcaatttgttccagcagttgtttatgtggttaaatttcattctccaattttatcattaattttcagacatcatttatttattggaagatggaaggcatgcatgtctcttaattcattgtccaccaaattaagatctaatgtggaaatgagcaagcatgcatgagtgatgggttactactatttgcaacacaccaatattatcttaccaaacactacatgcaagggactatactaattactctcttatcccagacatgaatgcatacgtccatgcatgagtgagttatgtttgtgttgggctcaccaagatatgaaatgtgattacacattccactcacattaattccttgctcggattagcctttgatagaatgcatgttccacaaaatcaaagcatgaagattttccttttaaacaatccaagctatttgttacatcttttaggtagattggatgctcacgatgttttccttttcattgattaacatgggaatttccatatattttattttctgattaatgtgcaaatttatagtttttaaacctcctaagagttaagctggggggacttataatgtaggccccatgatcctgtgcttctttggcaatatgtcattttaaatctgaagtaagatacatctgttacaaaagaggaaaaaaaatcgaagtacgtaacaggaaaactataattagcactgacctagcttttcttcaaatttctaggggaagcacaatgcagctgtcgccctgcttctgcagcaaccttgatttcctgaagttggttagctatgtcctctaagagttgcagctgtaatgattgctttctttcacttgctgcatgctttatcttgtcttgtgcacctttaatggcattcagacttttcccaaggagatcatctgcagcaactctgttttgtaacttctctgcttgcattgttgcatctgagaaacttcggcaaatcaggcctttaactgtatacaaaggactggtttcagtgctagtgaccaggtggcatggtaaataaagtaccgaatttctcatcaaataacaggaaacatttatccaaactaagcaaagaaaggtttaaataaacctatcatgtaccaatagtaattcgtaaatactgcatgccatctatgaagagtgaagacatcccaaaaatgaatttaacaggtttacgattccacaagccatatacttgatataagaatcaaccaattgagatttatttatccacaatctcataccttcagttgggaagcatatatcatcaaccacatgcacatcatagatattcgcatcattctcacttcccgtagaatcaccaccaatcttgtctacacctccacactcctcctgaaactcatgaggcagttgctctggagcttttgtatcaactgcagcaacaacttcaccataaccaacctgatctaagcttcgagcagatagtggaaggatttcaatcgtctccacgcgatcatccttggagctatcaacctctggtttcaatccaaccatgggaattttctcagatggcccagcagacagcttatcctcattgatccctttgatatgacccactttaataggtgacagtagttcttggggcgaaaacggcgtcttcaagctgaacccatagtcattccccaattgcggcatcgcgccatttctactatccttatacacagatctggacgtgcttggctcgccctccaccatggtgctaggaggcgtcatcatatcatcctcatcgtcgtcgtcgtcgccgtcctcggcggcgaggccgaggaggcggcggtaggcgtccacctccttctgcagcgcgcgggactcgcgctcccgcacgagcacgatgtcccggagctcctccacctcgtcctcgtagaaggcgcagcgctcgtcggcggtgcggcgctgctggcgcgcctcgatctcgagcgccgacttctccttctgcaggcgcaggatcatggccatcgcctcctcggccgccgacgccgcggcgctccgctccttctccagctcccgctgcagcgcggcgcgcgcgtcccgctcctcctccaccaccaccgcctcccgcctcacctcgccgtcgtcggccgg

SEQ ID NO: 40895 - DNA, 2164 bp, Oryza sativa
acacggacacctcgctatatctaaagtagtactccctccatttataaatgatcggcatatatggtttatggctttatggttgatatcaatatactctcacatgccacttaaatttacattgattaacatgcaacaccgtttcttatttcttgcatacttcctctgtcctaaaataaatcaacctagaaggagatgtgactcctcctaggataatgtatgtggatataggggtgtccacatacatcaatttaggaggggtcacattattcttctcgagacagagggagtaagcatcaagggcaattggcaccaatgatctagggagtaagcatcaagggcaattggcaccaatgatcttgtttatatgcatgcacgcaccacaaattacaagtagttgaatagtacattgaacaatgaatgcaaatgaccatttaataacgcacctaaaaacgaaaagtcatatataggagtatcaaatatgctaatcattttttaataacattgaaaaagttatatgatgaccatttgtgaatggagggagtactacatatagcataatattttcatttcatattgtaaaacggtttgatttttcttcttatcaaatttatcaagttcttaaaggaatataacaatattttcaacacaaaataaccatactatcaaaatatattcaatattaaatttaaataaactgattttgtgttgtagatgttactaatattttctataaatttaaccaaacttaattaagttacttatataaaaaagttaaacggatggatcatcattttttgttttacgttgaaaatatagtaccttagtactttctcaatgaaccgttcaattctcttcctctgaacaatttcgctacttctaaatccaattacgtacttaagttcttcatggttatgctatcgaagaggtatacaagacagtatcacacaatgttttgaattcgtgccaatgtcctactaattctctgctagcttaaatagtaaattcgatggtttggtttgaatcaaaatagttggtaatccctcattcttcattaattacaatctcttcattgtaatataaagcttggcttcccattagtaacaaaggaaacatggacaacataactctagcaaaagaattggtagggtagaaagccaaaacagccctttctatttcagtactatactccatacatgttcccatcacaaaagataaatctaaaaagatagaaatgctatgtttctcagatacaccaaaatttccaaggataaacaaagatgtgtgaacgtgaattcttccttgcaagcttgtctgccctggagcaactccactccaaattgctgtgttttgttcttcatggctgtatctgttgcgttgtttccttatccctcttgtgtttcttcaaattctgccgtcccgttcaaaaaccatcatactttgcaaattccttaccgtgtgtaactttatttcctccaggctctcatggccctaccttatgtgttttcttagtataaacgcatgcaccaactcttttaaaaagaatgacccttttttaatggttagtgacaactaaaactatgccggaaaggtccataactgtgtgctcgattaaaaaaacatttcttaaacataaaggatgtacttagaatctgcactcaatattttcccaaagagtaaagagatttgtttgggaagctttagattccacaaagcagtcatgcactccttcagctcctgctgcagcaccacacacacgcatcccgctcctcccccacctcccaccacaactcgccatcgtcgatgggatcactataaaaaaagcacatatagattggtgttataggtgtcggaatagttaaaaccggcacctatattatttttcccaccttcacatgttgaaaaaaaaatcaacacctttaaatgattgtatgtgttgtttctcgaggaaaatagatacctatactataggtacctttttgaaaaaaaaacaacatatttactatattataggtgtcggttaattaaaaacccggttttatattgagcgaagtgatcgggctcgctagttgaaacagacccctgtctttcttccaaactctttcttgggctgagctggctgtgctggctaagctggagccattagcgggcatggagctaagctgcg

SEQ ID NO: 40896 - DNA, 995 bp, Oryza sativa
aaattagcctaatctccaagatcagctggttggtcggttcatcatcaagtccagatagaaacttctcctgcctctcggcattgctgtgcacgttctgcagggcgtagagcgcgaggcggatgaagtttctgtctttgtgttcaccatttgtaggggataggcaaaaaaggatggaaaacaaggaaaacaaactgctcagaaactaagctttattttattataattaaagtgcaattgttctgatctaaattaaaacaactgaaaaaacaagcaacatccttattaaggcagccataccaacacatgatatagaatgccaactagcccacaagcgacaagcctaaacacggaaactaacaaggaaacaaactaagcaaagcggtaaaaagtaaaggtggcggccctaatgctcagaacagctcctggagtcactcaagtaggtgtcataactgtcaggctcgaagctagagctaccgctgctattgctggacgtggcgaacagccaaccaccgctaccattagacactgaagctgacactggagcgaaggttagtgctggagttggagagggagctggagctggcgttggtgaaggtagaggtggagttggaggtgagggtggcacaaagcggggaagcggctctagagctggaggtggtggagacgggttcctgtgcaccaactggatgcacatgggtgttgtggtagacttcctaggcatgctgcggatcctgagcccacctggtgctagacgcttccgcagaatggcgttcttcttcttgaggcgagccacctcatcctgcaagctggctatcttcgcaagcttattgtcgttgagagccttggatgccttgtgaagatcggagtgcatcttatccaagccctttgacggagcgcggtgctcctcaccgggagaccgcacaggcccccctttgccggttcggccgggggctcagggtgagatctcaagctctccgtgtatgtgggaagatcgc

SEQ ID NO: 40897 - DNA, 12093 bp, Oryza sativa
  unsure (1)..(12093): unsure at all n locations
tttgtgtgacatgtgggagaggggtttactttttaagtacttgttgcgcaaaaggtcttgccataggccatcaccattaagaagcttgaatagccatttgctcaacaaacatctattcatgatatcaagatttaggacacccagtccaccttgatcttttggccggcatatataatcccattttgttaacctatatttcttttactggctatcactgctccagaaaaagctcgatcggcagtaatccagtctctgaagtacacctcgaggtattgcacgatgttaatgaacatcaagtttttgtcctgaagcaccgtaagcttcctaaatcaacatcttattctcacctcttctgaattagctacatgggaccctgcctaattatgcatgaatgcattcatatgcttcattaggagtttaggactatacattggtctatgtatatgtcgatgtgtccatttcgtcaaaagaaaagagatcccaatacattgatcatgatgtttggaaagctggagctaattaagcaatgcatgtgacactagaattccccatactttccatgcctaaactcaaaccaaaatcaacatgaatttatcgaactttcaatacatataggaagttaagcgattaatccaataaaaacttcacactctcttgttatatatactagaactttaggcgcgcttcgcggcgccctacccgtttgttattggtaaaaagtatcacaagtcaggatatgtatgcacttatattggtaaatgttgagtacgaaaggacttcattctagcacaggctgtgatataacttgaattccgatgttacatgatgatttgaaatagaccctgaatactgtcagataaaaaatacctaataagttcagaaaccacaattatttataatacccaaaagagcaagaaaaggtataataatgtattgaaaaacagtttaatcattcatcctcttttaaaagaggttaattcagttccattacggggcatgaatcacaactaagttgtaatgtaaaggactatgtttgcaatcacttaagaaaataaatattcttcaatcgcacatggagactcagaatttgtatgcaccaggtttctggttttcattgcccgtaaaattaagttcctagcaatcctggaaggtgagtagacactttactggtgtgcacgcgcgcatgtttaatgtgacatggagattattacaggcagcacactgtggaaatggcagagttaggtataatggtaaatcactttttaccccttttcactggaaataatggtgttcactcatgagggagaggcaccctcaaatttccttactaaacagttataggtgtaaagaatgttcctacttcctgtcctgctaccaaatagatagcccagttctttcgtgaactctgaaaagacaatgaaatgcttttgcacttgcacatagtggaaaaattggtaaacaaaaaaaagactgccagccctggtttcttcctcttatcccttatattaatttaaaaggaaaagattgacatcatgttcacaaatttccaaagatttgggtataaaatgatacatcttaaactgcaatgcaactgcttagcatagtataacatgagaaagcacagccacaaggttgcttgatagttaaaaatctacttcacatattaggaagaaacatgcccctacagttttgacataccttagcatcatatatggtggcaactaatcctttttacatgaataagaaaaaggagtcatcggatttgacatttataataggattgcacttattactctctaaaaaggtctgacttatctgcgtgcataacaatacctttcgaaaaaatacatcatatcagatgaagagctatagaaatacaatgcacaattaagctgaaaggagcatatagaacaaaaacacattaacaatgtacagcacctactaaacctatttgattacatcaatccactgaattatcagctaaaatccacttctagatgctccctcaatcataccagcttacaaagaacatttttcggactaatctctgcttcaatatctggtatttggtacataggcccaagaaaaaaaaaatcagagagaattttccatgttctgatttgtgattctaacttatgcagttattaaacataatccaaacaaaaagagaatattttctatgttctataatttgagtcttaattcagattagattgacctgaaatctaaagatgtcatgaatcttcagattttgcatttgattctgtgacattatatcaaacagctagatgacaccttaaaaaacacaatgaagcaaaaccatcaaccatccaaaccctgtcctgactcctgaccatctccttaaaatatgtaatggagcagagcgaaccacagtggtttcatgaaaataatcagttgacactttcagcatgctgtcagctggttataacacacctactgggagcagttatgccagagctgttgcctcggctgaaaaccattggagtgaacatctaagctttggttgttggaactatatacaaacacaaccaaagaaaaagatatgcagtacaaatcagaaatactgtagcattcctgattaaaaaaaaaggtagactatcatttgtaagggaataatggtgtatgaaaaagcaaagctagcgagggaactggaggcaggaaatggaagatacatgccaagcatacataagtgagtgtagaaaggaacgggttgtggcttaactcaccaaaagtgaccatgagaagcaaactacaaatggaccctgggcaaggcgacaacacatggttccaatatcaccagatctggaatcgttaaacagtggtggtgccgcacggccgacagagcatcaagctaaccagcacccacagtattgacaaacttgagcaccttctatggcagcaaccaatcctttttatacagataagacaaaatcaattatcatatttgatattcatatttataattagattgcattttttctcttttttgaaaaaagattccacttatctattgaccaacacttcaaagtatcacctagagtagaaggcaaactgaagagaaaaacatagattttaacaatctttcaccttcttgtacatagaaacacaactgtaatgtacattaatctgctttttcattagccgatgaggacggtaattttaacagagctaggaagatgcaaaataaatggctcagcaaaaaagagtaagttgtgtctcctaggcaagaagttttttggatttaaatcaacagcaactatgaaattgtaagtcccttaaatataattgcatgaaagcacataaaccatttcttgcatacttaattaaactcctactcttaaacccaatccagtctagagcatacattttcatttaataaagttttcccgaataagtaacttgagttatgtcacaaataatgttttcactattttcaagtcagggttatgtttgccaggcaaagtcaatagggacccccaacatccaaagcaacattataccagctcggaaaaaaatctgagcatgtcaggttttattggctgatgtgcactgagtaacataagaaaacttaattcaccatcatttcacataataaacatctactgaatatgccagtattttacacggcaaatataagaatgctagaaaaagaaaaataatttgattcaccatgcaactttctccgcttgaacttttacagccatggttactcaagctgtcgatccacccccaagaagggtcatcatgctggaacaaaagtagtccatgcataacaataacttttcagagaataaatcatttcataggatgaaccatagaaacacaaagcacattcaacctaaaaagagcaggtgtgtaggtgctcgacggcatggcacacaatgacgcaacctcaaactggcctaaattataaagtggttatgaacattcagattttgcatttgattctgtagagaactacaacaaatagatagatggcacctaaaaatcggatttaaatatgcaaatataaccagcttattcactacttagaatcccatgttatagctgaatctaatagttacagaggttcgcaggcagtgatcaagaaatatatgggggtatcaattttaattaaaaaacatttgcagttctacaggaaaagatttgccatctatatatgtaccaagatttcaagttctaccaagaaaaatgcagagtccctaagcagcgcatgtaggtgtatgaatcttggtagatatttgcacgggccataccattaatctctgacctccaaccattatatatatatagatatatagatggcaagcggctaagattgtggcaataagtcaaaagcagctcatgaccatggacaagcaagaatagaggaaaggtttgcactcatctgagaaaaaacatggctggcaggtggtagacacagaacgggaagcagatcagtcatgcatagatccaacatgaaggggatttcttcttctttttttcccttgcacacatcagaacgacttccccaatgggtcaaggggtgaggcaacagattgacctccttactatcgaactccatcaccgtgccgcggatctagtgccacgccgtccgctccctctgcttgctgggaggagagcggtgggggagtgccaggagatgggggagaacaggggagagctcgagggggaggctgtcgtcggcgaaactccatcaccgcacccaaatccaatcctgcaccatcgagtcccccagtccccttgctccactgggaggagagtgatggagggagcaccaggagaaggggaggataggggagagcgcgaggagcaagttgtcgttggcgaggagaagccggggagggaaggcaaggcggcggcggcgcaagagcggggaaaggaagagaaggggtgggtgaacagtggtggctagggtttgaggggaatggaggggatagggatgttctgttttgcagaaaacacccttactttccttttttcagagcgcggtcctatatttggaatttcgtctccttcacgtaggatataccaagacattgagggcttttacaaaagaatacaaaatacagaaacatacagtgagggacttaagaatgattatcaagttaatcaaggacttttttgcaagattgccagctccagcgcccagcgtggacatcacgggaagcgaacacgccagccgaaaaaccgcagaatcgctgtggtgcgagcattctatggtcctctttaatatctccgatatactgcactcttgtatattcccactggaaagagctgaaatttatatggctaatatttatgagaaattttcttctattctgctgtttctatatgtacaaaagtactatgattttattatattaattaagtattttagcacaaacagcgtcttggagtgcagatccatatcaatttatgcgattatattgtaaactgacataacatttcttattaaaaagacacaacctcataacatcaccatactgtttaagacttgagtctaaaagcatgtaacttcacttaattgcatcaaccggttttcccaggggttggagagctgctccccatgctcgaaatatatttgcatgctagcaatttacagaatatgaaataagatatgaccaggtcagaaatcaacctaagcaagcacaagacgccactagcacataggggtgaaaacggtacggaaactttccggattccggacttatttccaaaacggaatctgttggttggaattttttcggaaatggaaacgaattcggaaatattttctcagaaacagaatcgaaaatgataagggcagttttgtcggaacgtggaatcagtcggaaactttctggaaattttctcggaataccctggattttttttagcactgaatagtgaataccatggtgtttggcttttttatttaaaaaaaaatatttgttatgcaaatctaccacggtgtttggcttttatttttttaaaaaaaatatttgttatgcaaatttgaagttacataagaatatattttttctgcattgggatttatcaacaacattactctcttaaatatagataatttattccatagatttgtgttttgtgatgtactgttgagacttaacaattggacttatatgattgtgttttataataaattgttgaccgttgagacttgagaattgaatttatcagtttgatgggtttttgtattctaataaattttcgttaccgtattcgcgccggttcgttttcactctgttttcggtttcgataatattcgattccgtttttgtatccagcgtttccgattccgaaaaaaaattgaaacgaaaacgataaagatggtttccgtaccgttttcacccctactagcacacatgttgcacaatggaaccaactcctaaatccaataaagcggcggttgggttcctaatatacttgagggcaacaccttggtctccatgtgcaggaaactttttttcatgaaatggttttcccaatccgatgttataaaactgtaagagcgaataaatagtaatatattgccgccttgatatagtttctatccttgaagcccaaacatatatatcattggtagcactatgcttttgtagggttgcatttcatggtatcctctgaaagaaataaatgagacaactataattgagtagttaatacaaatatatgtatgcagttatttcatattgctactatctatagagcataacggagtaataataatttacgttaatcaatttaagctaatgcacaacaagaaaaaaaaagtttccaattgtacagcattcactattttacggggtgtacgacattgcatcctgttgagcctaatgttcaactcacaaagactagggtgacaaggtatcatgggtaatcaaaagttatcaaggtaggatataatgaaaattaggttacgctacccatcattagttcgtaaataaaataatgcatgtattcaaaacaaaacaattgataaaaatgggatcaatatgttcaaagagtgcacttgcgttgatcccagtcttgcacgacatcttctgaaacaaactgctcttctgctccaatgtctatacgatcgcaaacgaaaaacaaataaacaaaagaaaaatctaactaaagaacataaaatgaaacaacaaattaaaccaggacgtagagctcgattttagaggacttaaggtggaagaatggattgaatcagagttcgaatggaaaatttatagccttcagaagtttgaattcagagaaaatctgagggtaaaagaaaaaagtaatattccgggaatattctttggatacttaatttcggggattgaattttttctgacaagaaaatatgtgtggggcccactgacagtgttatggagtatggtggactcggtgtatgtggactcagctgatgcgtatggacatgaggtgatacagggcaatgatgtggcgctgacagggatggatctagggttaaatagatccaatggttgagattgaatcaagggtttggatggctgtgattatttggggattttttgtcgcgggacccacagatcagctacacaacggaggaggaagagcagccatggctccatgggcacgctccggcacaacggcattgacaacatcgttctgtggcgacggcgcaccgaggcactggctagctgcggtgtcggtaggaggaggcagaggcgaagtcggtggcacggcgacagtggaaatagcaggaaaaaaggggaggaaaaggggcgacgaccggcggtatctatagagggagaggttagtgttagggcgatgcataacaccaatttaaggaaggacgacaccggttctccttgcgcggcttgtggaagttcagcggcggctatgcctcagcgtagggcgtgggctgagtcggtccccatcgacggcagcgtgggccagcgacgcggatgaaaggagaggccaggctgagggtgactcgtgggctccgggattggcttcctgggcctgtgtaacgccctgaaaatcgctctaagtttaaattgtgctttaatgcatttctagaaatttaaaaagcctaaaagagcctccaacaattaaaattcaccaagatttatgtcaagttggctagtgggtatttttaataagttccccatgcttcaaaatgtgtaaccaatttttacttgaattttcagagcatcctaaataattttaaggcaacaaaaacaattaaaggaattttataaaaaggaaaagctaaaagaaaaccccttcctcctcttgggctgcttccagcccatctctccctctcttggcccagcccaaggtgaacttattcccccctccccctccctctccttgggccagcccagctcattccttctccctcggactaagtccatcattcctccttcgcgcgcccagtcagagacaggtgtgctccctctcgatgacaggtgggtcccacccgtcatccctaacctccagccatcctctctctctccggccgaattcctaccgacggcaacctcagattcgcctcctccactcgccgtttcatcaaattaattgaggggaattaatttccacctcatcctgtccaattcccccataatttcacactcgatcccgcattatttgcggtggattttgatggtgttcatcaatggtgagctccaccatggccggcgtcgatctccctccccggcacccttatccctcccctctggcctataaaagggaccctcgactccctcctccctccccacacaccgccgctctgtccctcctctcttcgcggccgccgcgccgctctcttcttgtgccgccgccgtcacagctccggtcgcccctcgccggtggtccggacctcgtcggagcccggcgtcgccaccatccgcttcttcgcttcctcctcttccccgtccacccctccgtcgagcacgaggaccgcgggaacgacgacgacgccgacaacccgaagttcctcgtcgtttctccctcgccgccagcaacaccgtcgacctctcgccgccgtgtctgctcggtgagaaccgtcacctcctcctcttttcgtttttccctttcctgtagtccgtcgcaccgccgccgcgccgttggccgtcgccggcgagccgcctggctcggttgctgtcgtgcctgtgcgtcggtgtgccgtgagccgccctcggtgtgctcggctcacggtggatcgagcggctggcaagtgggacccgctcgtggaccggtccgcgtgcgctctctctcaataattcaagttttcctttagaaaaataattcacaaaattgtaaatttccatttaaataacaactaaacttcaaatggccatatcttgaccgtttgaactcagaatcgacccgttcaaatctctagtttccccttaaaaatgagtagaacccatttatgtgctttgtcgcttctgttcatgtggtttttattagcctttttatatttcttcgtgttggtcgtgtagatcccgctgttccggaagatcagctcttcatcgccgttgacgccgaagactttgtgagcgaaggcaagtcatatctaccttgaacatgttgaatcccatattgtgaaaattatgtggttttacttatattgcattgctttatagattataccgttcattattaatattgttttattagttattcctatgctctttgttatggccatgatgttgatttgatatccatgatcattgtgaaccctagtaaaattataacttgactagtctagtatcctacatgatggactaactagttgttttaggtaaatgcttagtcatgcttagttccaacctactccctccgtttcacaatgtatgtctttctagcattgcccacatacatatagatgttaatgaatctacacacatacatatgtctaaattcattaacatctaaataaacgtgggcaatgctagaaagtcttacattgtgaaacggaggaagtagaacttttggataaactagactatggtggttaacaactaaaactggattagttatggactattgactggtttgtcaatagatgggtgataaaatgctttgtacaactaaaacatatttttgggctgggcttggggtgcaagcaggttattttggtagtcacaccccggctaatataaggaccggtcttcgggcctctgttgcaaggcatcttcgtgcaaccacaagtctagtgggtaaggcctgactagaagtttagatcttctcaaaacaaagaccattggttggaagcgtgtggggcctggattaaggccaattttcactcggtgcaaggggggacctgtctcgtcctgggggatccggcatcctttaccttgtcggggaccggcgggcggcgaaacctcagcgggttctcctgttttgggtagacctagatggatagtcttgtcacgacctctattcgagtactgtgatagtacccggtgcgtggtaacgtgtgttgaggttgtgtcttgtgggtaaagttgtacacctctgatcagagttaaaaattattcgaatagccgcgccctcggttatgggcaagctgagcaatgtacccaaagttagttttgttttataaaaccttgggagggtgaaatcatgatggtgtagtcatgtggagattagcctgggttaagacaggttcgcaggctcatgcgaccttgatgatatgaaaatattggcttagaacaggatcgtgttttagaatgagctttaacctgattaaaatgtttaaactatggctttatgcaaaataaaccctattaggccatttccttgtttaccctatgcatattgttgcatttccggtgtgacttgctgagtacggtggtggtactcagtcttgctcacaaaaataatccagaggatggacctgaggaagatgaaggcttggatctctagttcgctccgccatcaagtgcctgttctgtagtcttccgctgttttatttgtttatctttgagtgtgagggcctaagtcgcccatgtaataaagtacttgctttacatttccgcaagtgtggcttgtaataatcaacaatgtctatgtgtacctcgccttctgggacgaggattaatgcactgagcgtttggaaatggtgtatatttccgggcgtgacaagttggtatcagagccaccttgaccgtaggatgagcaagtggtctaagccttaggatgatattttttttttagaaaatagttctttaattgtggaaactttttttattctatcttcaccctctcttgctttgcaaaattgtttactaattctttgttctgtttttttgaaaaatagatgaccagccttggcccctacaatggcgtctcacttaaggggttagttctgcagcttcgccacttgatcgttgagctgggctacaccgaagaagtccagtttgttggtaccactgtgccagacgaaggagaaaaagagttggcatccccccgatggtcagtcaaggccaccttgctctccaccaaccctagcttggaatcattggagctaacgggagggactgacaccttcatcgacgcatgccaagaagtggtgcttctgggcattggcaggctgcttcaacgacactggacacgtctgcaacacactccattccgctatcatcctactcgcagtttggcggaggactatgccaccttcagggatgccgagcacgagaacgacaccacgatcgatcacctggccaagatggtgcaggcgtatgatgatgctcgtgtcgactactacaagatggcgaagagaggttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 40898 - DNA, 773 bp, Oryza sativa
tcgaggcctaggcggcggatgagcgagagaggaggcggtgggagaggagtcggagagaggaggctgtaggagagagtcagagagagagaggagggaggcggtgggagagagacgcgtgaaatttaatggcgagaggtgggccgtgggcggtggactttaaaagcagcggtactctgtaccatccgccagtaaaaatgtgattttcgttggcagtgtattgagtgggctgctagcaaaaatggctacatctttactggcggcccgcttagctcggctgccagcgaagatttgttttcgctggcaatccgtagccctccacccctcgttacatttttgctgacagttttcgtatttttccgccagtaaaaatcatagggcaacgccatgaaaaatcttttttctattagtgtgtgctcccgttaggtacccagtgccttctccgtcatttacgtttgctcgtatcaagatcgtaagcgaaagtcgtacgtgtagcattttccatagtacaatattaacgtgtgttttgcataattaagtcttggttttgtgaaacatgttgtctcaaaatcaagggctccttgaaccaaattagagatgcttgaatcatattctagctgaccctactagaaaactcattttcggcgtcgtaggggatcgattttcgcaggcgggcatgtaattcggagccaaaaccccgccggcaaaaaagtacccggggtggagggggcagtccacctgtgaagattgatctttgcaggcagaccatataagcg

SEQ ID NO: 40899 - DNA, 729 bp, Oryza sativa
aatatcttaaatattggaaggaaatccctgtactgtatgcttttgcatttattcttgatcctaggggtaaattacggggattggttaatatgttgaatattattggagagataatgaacatagattatactaactattattctgatgttaagactaaattatatgagacatttgccaagtatgagaataagtttcagggacttcgcctacaaagacccccaactgtctctgtcgctggtaagaagaaaatacaatggggacggatttggggtggtagttcctcttccactcctgctgggagttccgcttcaggaacaactggtacttttcaaggcacccaagaattgtcctcctacttagacagtgactgtaccagcactgaagatctcaacgtccttggatggtggaatgatcacaagacccaatatcccgtgctctcaaaactagcacgggatgtgttcacggtgcccgtttctaccgtatcctctgaatcggccttcagtacatgcggaagaattattgaggaccgacgaagaaatctaagcagcgatatggtggaaatgctgctcatcgtcaaagactgggagctagctgctgaacgtgctcaacactccgcagagaacttggaattggttgctcagttcgaagatctctacatcgatacagatgcacagattagctagttttttctaataattttcgacttataggctgtactcttttttcttt

SEQ ID NO: 40900 - DNA, 13536 bp, Oryza sativa
atatttttgcatgaaaaaatgatgcttgctatagtgattgggtgaagcatggacaatctgtatcttaccattaatgcataaactaaaagtcaggaagcatcttttgaccataaccataatagtaggttgttaatcagtagaattataggcaaatcaaatgcaaacgtcttcttttactttagtatttgatgcataatgcatttgtaaacatgatacaacgtcgattgaactaactatttttctggtatgttggcatgagtgcatgacagttactattgcctgagattcaaaatgcacgatcgaatatatacttctgtgtgaacaatctttttagattttaagcactaaatgtgtaaacaactaaacttgtatggattaactgcatataaacattgttgttgggtgtgtctagcaaaaaacttccacaatatatagctttgttactcttttgctagtatagtatgatgaaaactatatgtcgatgtatttattgtattggagaccatggagaaaaaaccatccacatggggatggaaagtatgtgattatattttggacgaagtctctcgcctgacaccttagaatactaccatcattttggtaacagagttgcaaggcatgttccattggcttaagaatcacagcaataataaccggttaacatgccatctctcctacataaaatgattgattcgattatctggaatagtggtctttatttactatttattgacatggagcaaatgatgcaaatggatcaagacttggatacgccttagcaagagcctggaagatttccaatcaggcgttcattattgataagtaaacaagttgctttacatcaacctctccctatttctatatgatatcagagaagagccgccaaattaatttttagctagtgtatgtgagtaccactaatggctggaaataaaattgtatttctttcgggagaaagaaactcaccaaactgacaccatgtttagatcccaattttttcttcaaactttcaactttttccatcacatcaaactttcctactcacatacacttcaaacttttctgtcacatcgtttcaatttcaaccaaacttctaattttggcgtgaactgttctatgaaactggtgctggtaatgtcctggtgtttgaattcgtgatgcctactgaatccactgttactttctccaggcaacgaatttctgcaccatctctgaatccatcttttgcatctttgtctacttgggggtactgagatacatccatccaaaagaagacataaccgtgcactcttgtactggtgtagttggagattattgtcatataggagtaggagtattagttttgtttgtccgagcttgtccaattcagaggtcatgtgcatctgaattatggcgcctttcacttgtcctgacctctgggattccgccggaccctctgtctgggtccctgtcgtcttcacgtaaactgaaccacttctactgaggacggcattactctgcctggtcggcatgtctgcccattgtcaaaaaaaaaaaagttactactagcatgtagttttgattgagtatttggtttacttttttaaaatggtttatatctccaatcctcgtcattaggcaggtcttgatactgaaataaaaggcacacgaggttaccacttgctaggtatcttcaatctgtcgttaggcacacatccggagtcctgactgatactgaaattttaaaaaaaaggtacatgaggttataacataaactttggtatcctttcgaatgataagttgataaccggttgaatcaacgctactgcatgttagcccttcatgggttttcagtttggaaattgctatgcattctacccaaatgtacaaccagcatacccctagtgtatgttaaggcacagctattgcttgtctggctcgcatggtaagaagcctgagcacggtgaatggtggatgtggcattgtcagatgtaagctgtatgatccagtcatattatagcacgattctttcagttatttgatggttttcatcaaatattattccaactagtaataagtcctttttttcaaacacagtataaatgcatgcgctcaaaatgcgcgtacactcatccatataaatgcatacaaacacaccctattcctatgagcatatccggaaaactggatcgatatattttaagattgacgaagtaaccacggacatctcgttatcgacggtacgtcacctatcactaaatgaataattagccgtaatgcagactagccttgactgcacgcacgtatgggttcgaagcatcccgtgcaaagggaggtgccgtcggtgcagccgtgcagggggagggcaaaggatcgttgcgaatgtgcaactgccgaccagtggcatgtgtgtgggggcggagtcgccggccgaaacgagcggaacttttttctggttcaacggcagttgattcattcatccctcctccagtccagtgtgttattttgggctaatagctgaatggcagaatgatccgaggtaagtaggaataaattattaaccattatatagcaaggtgagtatagcttaactgattatatttatttggtgaaatcagcccatctaatttaacacgaatgctcgcatttatggttatttatatatattttttggataggtgggatgtgcgtgtgcacccacattgtgagcgtcttagtttgcgctgtatatttttttaaaaaaataaatttcaaatagtgtttgagaaaattcatgtgtagaaagtttacaaaagttcacgcagtttgaagctcgggaaagcgcgtatatttttattccgttccggagaaaatgaacactcccggtcacatgtgtaggctctccgcgaaataaaaagtaacatgtctaggtgatgccgtgcacatgactaaggtagacgatcaacatgcacacacaacacatgggattcggatcaaatgcagtagtagtatggactgcaacttaaacagttgtagctgctacgttggatctaaatccaacggtaagtattaggtcggttactgtagcaaaagtaccaaaccataaaatattgttcagggtactgtagcacgagtactgtagcagttgatctgaactgtttatcacaaaaatgaatggctgaaaatgcatgcagtcctgagaattacgactgcacccgatctcaatcccaacacatgcgggggtccatcgttgtctgcacaagatgctaatctgcggtcaagggaaagctgataaacactgctccgtctctgacaccaaggttagattgatgatactcctacagattgttcgccatcatataatttcagatcaaaggcgttctctgtccacttcgcagcatccaaatcaaccacaaaatttccaacctgacaaagaaggaggttcattacaccactgattccttgccatttcggctaatgacaagtgaacagtgtggaatgtggttgccagcaatgccatgagatcggtgcatgaatcttcttggctttcttctgatcttcataagatcgatcaccggcgatcgattgatctggagcaaattgtttttaaattcgtcaggaacacgcttcaatttgggggcggtttcgctgccacatcaacgtcaaaagtaactgattaggagatgggcaacgcactttgctttaattctgcaacacatgccatagaatcattcatccagtagcttcgcaataactagccagatcatatcaccgactgtgcgcgccgactggttggcacatactaatcctatatcgttctaatatataagaacttatccaaatacgttgtacaattatgttcttgattcttatattttgaaacggaggtaataagtttgtgtgaaattgcaaaatacaagtagttcgaattatgtttgattcgactgcaaatctgtattaagatgacacattgcatcaatgtacaaatctgacgatgacagattattgtcgggcacagagcgtagtactagtaataagaaccatagtttaacaatactcaggcagagctcatattgaattcactaaattcaaaaacatttgatgctgcattgtacggagtactacacagtggcagccattgaatttgaaatcaagtccattattacctcctgtggctatttttaattacacgcatattactcctgtcggccaaaatagccatgattagcactaacccagtactgaaactacaaagaagaaatcgccatcaccatgatcatcatcatgcacatcaactatgtgcaggcctaccatcgctaaaaagcaagccaccaaactgcacaggacagtacaaccctttttgcatcattttgccaacccaaaccctaaaaccaatccaaatcaaaccaaccaccttcctgcgttgatgaccactgctgatcctggtgcaatggctatcactctctctctctctctctgtctgcctggcgtgcgtgtccccctcatcaatgacactgtttcgtttcacctttaattaaagattcctatcctctccaatgattctttgctctttttttttctctcattctgatcatgcaaaaatttccattgaattctctgtctccctgctttcagtgaaaactgaatactgaagaagagagataatgcatccatccatgtgtgtgtgtgctgtgttgtgttaagctttcctttacaaagaggaggaccacggtgctttgtcagtgtcactgcctcactgtttgtggtctcaccttttccctatcacgtcctcaacttacactagtctacatgccacctttatcactgtgcttgaaatccatggctattttagtggcctaatgcaagagtactcttcttgaccctggtggtgagtggtgactggtgagctgagctgagcttgcagttttggttcttggggtcttgaggagttgagctgtggtgcttaacacaggcatagctgcttgcttctttctttcacaaggtattctttgtcttcagatttgcttcattgcttggtcatgttgtatgtcttattatgtgttcctatgttcttggcttttcctgtcaatgtgtactagactactagtgctgttctgctctgcaatatctagtgttcttgctatttgtagaacagaatgtgaaaagaacagcacatttgtttaattttagagtttcagagcagtatgttcttcacctatgaaaaaaaaaactacaatctcctttcttggcagaaaagcagtggcaacaaattggttaattctattcttctgatctccattctgcatatggcctctccccttacagcttgcaaatgctttcatcctactagcagtgcaatagtgcaatccaaccacgagcaataaataattgtgtttttttcttattcttttctattaatgtagtcagctcacatggtgccatcttcttcttccactttggtgcagttgttggcattggctccatgtgatcgatgagctgagagagctcagctcagctcagctcactttcgccactgcagcatcggcgagctagagctgtagatcttgggaagatccagcaatggagaagccggcgtcgtgctgctgctacttcccgctgcggtgggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggtgaggcatctacttcttggccattgcttacttcactacttctgcaaaatgcaccatagtgaacttctgtttgtgccaatatgcatggatgacaaggtagatgcccatttcatcaggatgtttgggtgaaaatatttctaaactcgatatctttcaacgttatgaaaccaattttgccttttgatgcgctgcaggttcttacccggtaatcgatttcaacataaatattaaggaacaaattattttcattcgtcctatgtgatgattagtttgagcttggaaggatattgttcagctagaatgctgcgtgtaacccaaggagacattgagatatgtagatagttgtcattaaagaacattttttttatcttatataataagcataccacgcccagatgataaaggctcatttagttaatatcgtcatgctcaactctccagtgtattatgaaccaaagaataattataaagaccatactgatttggcctctttgacatggacttcaagttgtgcaattcatgaccagattttctttaggaattttagttagaagcaacaaaagctccaatcattgatctctctccaataattcgagttgaaaagtggatgtactccttgtcgatccagtttagatgggggtaaaatcacactttttagatatatacggttcctttctgtctcttgatgttgatattcagccaactttctttctgtttcttgatgctgatattcagccaatatttcttgccacaaatcattgtaatgttaggtgtgcaaagctccagttatatgcaaactagaatggaagtttccttctcccagtattatgcccttatgtatgtaaaacatacctcttgcaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactccactggcattggtgtaacagcagttgcgctcttcaacatctgacaagctcatcaggcagatagtttccgcaggaggggtgctgaattcgactgttctgcgaactcggtcagcgatcgtttcgcagataaagatgcagggagggattgcaagcagccccggtacaactttcaagatatcagatgcagagatcttcctctactccgggatcggaaccgcggagtcccgacgccctagctcatgctctagcaatggcaagtgtgaccatgcccatcatggagatgcaaaatgcggaaatgctgaaaaccatggatcttcagagaagaggctgagctctgccagccgtgccaaggaccgtctcaagctgatgctgaaatggcctcgtcagaagatgtccagaggacacaagaaatccgacgatggcgacgccatggattccatcaagaagctgagcgagcaggccgtcgagaccccggccccgctcaggcagacattcaccaagacgacggcgctgaacaacaagaggaccctcgcggtgaagacctcgactcccagctcggccaccaagaagaagctcaacagcaagctcatccacggcatcatggaggccatgccgcacctggcgtcctcgtctccggcgtccgccttcccgaggtcctccaccccgccgccgccgcagtccggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgcttttctttggttttctgactcgaattgagcttgcagttcaacggaacatatatggtttctgcatgttgaactcgtcgggcttgtgtggattttgttggctgctgcgtgtaaccgtatccttgcgtggcgtgcttggtttctggttgggcttgtgttaacgccttaacggcttacttcgatgcaaatatatttggtgaatgtatcagctagttgtggtgagttagtcgatcgttttgtttaatttaaacaaacaaacagcagttattcacgtttccggaagaatccctgcacaaaacggaatgaggaaagacaagaaatatcttgtgtattgagaatattgaacatccacaacaaacagtcgacaaacatctgacaggagacaacaaattgcgctaaaagacgcatgaattttctttttttttccctgtaaacaagaaaagcagaagctttttcctatttgcccatatgcccagcaaacaactatcgcttcctccactacatcaaaattcgaatttacagcaggaagcaattggacaaaccgaaaactagagaacgaacgaacgaaaaatctataagccgctgggcaacaccttttgccgctgggagctttagcacctggatcactaattcactatgtgcaaagaaccatttggtcctctcattgcttacccaccttgcggcctggccatggcacttcaaagatggctacatacatacacccgacaacagctcggagtaccgcaagtcgcggccattatggctgtgccgtcctccaagcacatatgatgatttgtagggcaggttaccgcgatactccaggcgcataatttacgacatccagcagcatcaaaattgagggccttgttcgagctagtttggaagcagaaggaaggagcgtctaccatatgcacagctaattcagcaactagcccacaagcactgggactagttgatctctccttcctctgcatctttagtgctggggacactgctaggatcttcttcctcttcctcctcatctgctttcatgaagagtcccagctgttccaatggattgcctgatccaggaagaaaactgggcatgccatcctgggaatgctcaggactagtctcatcaacagaactcacaatatgttctgtggttgccgttccaagcatttccaaatcctttagatggaggttgtcattgatttccaccgttctctccatctgcattaagttaaaccactcaaattttagcgggaaaaagaaagctcgacaccagtaaatgcagtttttttcactagcctcctgcagggcctggcgagctttctccctctcaaggtcccgtttacgcttggcttcagcttcagcttcagctcttcgagcttccatagctgcatttccttcagccaacagccttgctttctctgaatacatagataaggcacttctcagggaaaatgtaagaaccatcatttaagagtaaacttcaggtggatatgcctgttaccttccttctggagcttttccagctcctcctgtttgtctccaccctgagctcaccaaatgttcgttccatgtcagaagcagcgcaacaaaagtgaacaaacaaaaccactcgatgaaactaatcacaaacctggctgagaatcccctgtgccttaacaatcacatcagcataacgactcctaaggagggctgctcttaagagcttgtctggggagacttgcctgtcgggttttgaattctcccctaaagtttcatagggaaaggatcagatgatccaatcagcttaatgcactgagaccccttaatggcctcatatgtactgcttgcaaattcatgcttaccctctggggcaggctttgactcgttatcctgctcacggagctccacatcatcagcaggacctgtgattttgaaagttgtaagagcattaagccaaaagctcatccaactgccacatgaaactacaaacttgtgctgctgtgacgattaaggtgcattttgatttctaaaggtaatttttttgtagattttaacccaaaacttggtcaaactacaattacatttagtgcataaaacataccaatagatttatatttcaaagagttctcacactgatattatgcaggtgcttattgttgaatactttttcaaatcaaaataagccttaagaagacgtggggaggtagtagaacagaaagggcacaggaatcttacggatggcatcgactggacttataacatcactcttttcttgctccaccagttgttcagatctcttacttccctaaattatatagatgacaactatttcagtgcaataacacggaagaaaaggaaaagttgtttcgatgagaagaaaaaagcaaccttgacaaaatgattaagagggatagatatcacattcaaaattgagcctaaatttctcaaagtaccacagtaatagattatttaaacgaacatgtctgtttctgaccaaattagacaataagggtatattaaattaatatgagagtcagcttatacagtatgcaggggctgatgtctgattatagatgcatagcaatcaaccggccagaacaaaatattcacaatttttcatcaagcacccaatgacaaatagccaaaataccttcggctttcctgggctaccacctttttcttgttcgctttcactgtcactgcccgactcagaatctgcattattggagtaaatgtgattgaggacacctcaagacaaactcatgataaaggaaggcttatgacaagtgggactagcagaagtccaaacaggaacaattacgcaaacatttagccacacaaacaagatatgatgcatgtattgctattctgaagataagataagattgttgcaaattagcacaagggtaaattgcaggatggtatcctgcttgttcgtcagttaacgatatgaataacagtaaccccagttaaagtttctataatactgataatctagtcccccagaagatcaaagaaagagggaatattgttgaatgcatgagcatgcatactgactagtgggcatctaatggtacagatgcacctacagtgaagtataattgtgcgtacttcttgttcagtgcctcgttagctaaactcaactaaacatctactcaaaagtaattagcttcaagcttaaacgtcacagaagttaatataatgaaatacacaagtgtttgaagtaaccagatcattcttgcaaaaacatatttgtttacaaggacatatatcatactaaagagagtatgtaagcacagaggagcacagaccgctggaagaagatccagagtcactgctggaactacttgggctaccacacttgttaggattgttgtgtgcatctttttctatcaatataggggatgcattcccgcaaatatctacatcctcctcaactggatcaccacctgcagagaaaaagaagttgtaagagtactgtgatgttgcataaaactaagcattagcaaaggaccagggaaaaaaacctttgcagggatttgtagaggagtggctaaggccagatacattagcagcctcattctcagaaggctcagattttgcctgctggctctgctctctctcttgcaaatacttgtcaacatgtttcttcaactcgaatagtaggtcatcactgacagcatggatatcaatctctatctctccatcaccaagctgatctgtgttgttgtcaatgcattgctgcaacaaatcaatgatgtgtgaaggtacctccggatcctcagacaaagatgccaaacagttcccaaatgattctttctcctcgaatgtcatttttggctttacagactctgttggtctaacagactctgttggcctcacacactctgttgacacctcactgcagtccacagggggagtcttcctcctctttgagtcagccctgtcaacctcgacgtgcgcctctgtggcaatggaagccagcttcttttcaattgtcctccatcttgattcaaacatcttgtttagttgaatggcataatcatgcactacatgcccacgaggattgtaagtcatcgcatttgaaaaggtcagccgtacatcggctgcaaattcagatggactcgtgtaggaaccagagtcaagcttattcctgatagttccaagatccatcggtttcttgatgatttgaaaataatctggaatattcagcttaacagcatcaaccggggagtcgaatatgttactacatttctgagtcatcagctttttcagaatagcatcgcattgcttaaaaatcgcatcctcagtcaacaccgtggaagcctcaggtcggggctttgtaggcaagaaacgccccttggcaccacggaccacatggttaccacgctgtcccttcttacctcgaggggcagccgaggacgagagcgcgggagctctattgacagggacagggacagcaaactccggcttcttgaggagattccggaccgaatcaagctctgtgcggaacctcttccggagatgcctcctctcggaggaggacatcttggctgggacgaaaatctcccgcttgacatcgaagccgtcgctgtttaggctgatgcacttgcgcttgggggccgaagagtcctcggagtcaacacgaacggggctgcctgccgcgccctccgactcgccaacggtctccgcgtaaccccgtggcgccgctgacgccatgccccggaacgccatttcatcgtagccccgcttaatctgcctctgctgcccaaactccatgaggaccgtcggtgtcatgtgcccgggcgccagatctgttcaccattgacaaccataagagacccaagattcagtcacgcggaagggaaacttgaacttagcggaatcaaatgccaaatttgaacttcccgtacagcttgatgtaagagaacaacagaaacacaaaacgtattcaaaaagttccctccaaaa

SEQ ID NO: 40901 - DNA, 9535 bp, Oryza sativa
cgcacgaatccgacaccgcgacccccgaatcctccaattcgcgcccagaacctaacggcacgcgaaaccgaagaaaccccaagagaaaaacatccccgaaaattcgaaacggagacggggggtcgcgagaacctgaagaagccggatctgaagagggcgaaaccctaggccggggatccgcggcggacggcggcctcctcctcccgtgcggccgccggcgagccggatctgctccggagacgggcggatctgagggtcgcgaggtggccgccggctcgagacgcctccccgccttatcctcttttttttttctcttttttcttctcttttctttttcctcctctcgagtcgagccgtctcctgcttatccttttccttcgcgaagcgactcgacttgagccgagccgaggtggagggagccgagccgagccggggagagccgaagtggagatccgcgcgggggaagcgagagacccgaaactgggaagcgaagcgatgcgagactgtgacgcgcgaggggcggacgccctcgcgggcggtatttataggcgggggtgaggccgcgggtcggatccgggccgtcggcttcgcggggatcggacggaccaggggttagatctgggcgtgggccccacccgggccgacgtgacgtggagcggggcgcgctttgactttcttcgagaaggtccgcgcgcggacgcggattcctacccgaactgaggatgacgtgtggggcctactatagctcgggaccacctgtcagtgaccttgaggggtcgtgttggggtgggtggtgcggagatcggccgtcttttatcgagcacgcgggatctgggtacggtttgggcgcgccggggagcgaggtgacttggaggagaaggcttggtgccacgtggaaggaggtgcgtggctgggttattggagggaaggatgtaacgggtacgggttaggtaccgaaagagaaaaaacggaaggttagtcgttcgctccattttccatgcgattttcctttttaataaaagggccatattcggcccaagaaaataagggcctaaattgtaggccttttgtataagaataagtccaccttgactcccttaaaagtgaccgaatctaatccgtgtccctgaaccgcaaaaccagatatcatggccccctcaactgttaaaaccggtgcaacttacctcccttagcagttttggagaatggctttactgatgtggtgtctttgactcgatccaactagctaactcagcttgtgggacctacacgttagtgtcacaattttatctctctcctttctttctttattcctctctttttcccacgctgtctaacagcaaccgaggcggatgcggattggcaacgatagcgccgtcgcggccacacctcacggcgcggggtacggtggccacctcgctgacaccgccgcgggtggcgcttctttctcccgctccgcatggtcggcctcgacctccgcgacagccacctcgcggacacggccatttgctcggcgactggacgtctcgcggcggcggtggcatcgccctcgcctctattttcccccaagcgtgcgtgcgtgtacaccacgtccacggcgcacgtctgcgtcaagaacgtcgcgccagccggggcacccacgtcaacagatgggttcgcttctccgccgcgtcgagagggttcagctgaagaaaaaaacatcctccccctgcacgttttcagtgacccagataactcctctgctcatattgagtttcttcatctgggttatgtctgcctgaacacagttgctaccactggtttgttggctttgccaacactcatcttaagttcattaatcaattgttgaattttacgtgtcgtacaccaccaccgtcgccggcctcccttgctccgcctcttcccagaccagctcatccagtgccaccgacccgacctcctccaaccgctcgaagtatgggccacggtggccgcccaagctccgttgggccgctctcgtcacagccgtcggagaacaccgcgacgtgcaccaacgacgaaccaaggcagggcttggtcgagccaacgacgaaccgcgtcacggcgacggtgcaccggacgccgccatgaccgcgaagacgagcagcaacggcggcggcgctggtgggaggggaggccgacatagcgtcgcctcgaggccgcgagcgctgacggctccctctcgcacgccgccgccactccgcctccgtcgccgaagagggagagagagagggagaaggaagaagggatagacctacatgccgcacgcaccgacggctccctcgagctctggctcctctcccacggcgccgccggcgcctacgccctcccgcccaccgctgccactccacctccgccgccaccgctggccctcgctcgccgaagaggagaggggtaagggacagaggagagggaggaggaagaaaggatagacccagtgggccccacatttttttcccgaatgacgaagaggtcccacatgtacgtttttagttctaatgctacataagcaccacgtcaacggcacaccaggtcaacactgccacatagacgccacgtcactaaaaccactctcagaaaccgctgagggagtcaagttgcactggttttaatagttgagggagtcaagatatctggttttgtggttcagggttatagattagattcgggtcactattaaggaagttaaagtggacttattccttttgtataggacgtaagtatggttgctaaggccctaaaaagcgactcttttgtggtcgtagcagcccagtatagtttaatttgagacctatgtgttctacttctaagagcaccaataagagatttgctaaattctatcccaaaattctgaatttggaatcctaaacggaatgatgtaggaagaaaattctctccaagagattaagtaaaattaattccctaaaaccaaaagtgggccccatgccaaactactaacacgagacagtttatttaccttcctcacgcgtgattgtgagttccggatcacggttgtgcgctcacggtaataagatcatgtgtctcgatgtatgtcgccgttgttcgctcgttcccaaccctcgctgcccaccatccgttccctccctaaccctagcatgtcattgtctcctccctcccaattctagttgttgctcatttctcacgactttagtgtacgtcgccatgacactacgagccacaatcgcctggtgtgggcgccaagaactgaggggatcatttttgtgtgggcatgggaacaagatgacactggtgggagttagagattgggaagtgtgcgcgtgaaaaatgatggagcaaaatctaggagagagaaaaaaacacaccctaagtgtcagggttacagataaggcatacttcatatcctacgacttatgtagtacacggatatggtatactttcacgtatacgaatcgttcctatatacgctgttggaatctgttataaattatgggaattatctccacgagacaggtgatttccaaagtcctactcggaagggatcgagtttctgttataccgtgcaagatccgatgtctccgagtcttacttgggataaaaatgacccacgatataaaagggaccccaaggaggggtgcaaggcatcatatctcatcgccaacacacccactgtagtttacgaagtcagagtacgcgaagccaagtcgccgggagatcttgtcgaatacatcgactacgatctttctacttttgttgtaatacgtggttttccatcatcaatctcatataaaaactggactagggctattaacctgacaaggggcctgaaccagtataatccttatcttttgtttgcttgatgtcgtattgcgtagatcatcgttccaatgtaccctagtacccaaatcatctggtctacaagtatcactcgtcgatactaaggtgtcttatgatgggtgagtatcttttacaaaatggtactatcattacaatcactgacacgtaggttccacttttctattgtcatccacgtcaatggctttgtttggatcctccaggctattaaatagccctccggaatcttactatttatgagtattaaacgtagattactaacaaaacccattccataacccctgaactattttgcgagacgaatctaacgaggtatattaatccatgatcaaactattttgtgagacgaatctaacgagatatattaatccatgatttattttgcgagacgaatctaacgaggtatattaaatattaatatacctcgttaaattcgtctcacaaaatagaccaggggttatgacgctataccctccgttacaaaataagactttctaacaatcaaaatttatttatctgagagtatacctatttcttcacttactcatcttaaacaattgcaatgaatgctcatttcatttctccaactaatcacattcatctcattcatctcttgtttagtttcacgtataccaaccccgtgaaaggctttacgagtacttatactttgagagaaagaggatgctaatttccaagataaaaataataacaagatgataatgtcaatgtgtcggttagcttatgcttaccgaacgatgccaggtatacacacagtaatgcccagatttttctcaccagcacacatcagatctagtgacataccaaacgaacagtaaaaaagacatcaataaactgctgcatacagcagcggtttccactcagcgtgtacttgcgcactagcgcgctcattgggcctcacaagtactacatggaaacacgcggcgtgcgtgcgtccatgagtccatccacgcgcgacgagctgtgtttgtgcttgtgcccaaacattcgagcacagagcagccaatcccttcccttcgcatgcgtgcccaaaaaagttgcacttgtcacgtggggcgatggggtgtcgcgcgcctcgccgccttggattctagccacgcagcgggggaacaaaaccacatgctgggcttagcttagctcccatatgcgcacagcagcacagctcgtgctaaccgacgacggcacacagtagcctcacatgagtcgctcgcggcccaaaagcacacccccaacacaaccacacgcactacctacctgcacccgttcgtgcacgagaaacaggggcaggaaggatggccgttagatctctacttccagcggccaagaatctcctgtgacgccgcaaagaaaacgaatgaaacaaccgaaagtaacttgttcttaacgatttaaaaactaatattaaaaaaaataaaccacgctaaaaaattattgaaataaactttaatatgaagttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatacttcctccgtttcacaatgtaagtcattctagcatttctctcacatttatattgatgttaatgaatctggatagatatatatgtctatattcattaacatcaatataaatgtggaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaagggggccggcggctggcgatcgtggagcaacgtggaatgggagggcgcgcccgcggcgatggcgccggcgctgaaggccgcgcgcggcgacgagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgcagtcaacagtgcgcagcattttctttcgttagcattttcttttgtcggacagcaccacatcagtgctgaactgtcagctagaagcactgagacaatgacatcctctgaaagcctgaaaccaaaagcaagcagctaccaccactatacttgtctactcacgtttgcatcgtgtgccattgccattttcgctttgtcaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggccgcccgggaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttcccaaaagtttttcctaaaaacatcacatcaaatttttagacacatacatggagcattaaatatagattaaaagaaaaactaattgcacagttatggaggaaatcacgagacgaattttttgagtctaattaatccataattagccataagtgctacagtaacccacatatgctaatgacggattaattaggcttaaaagattcgtgtcgcggtttctagacgagttatgaaattagttttttcattcgtgtccgaaatcccttccaacatccgattaaacatccgatatgacacctaaaaatttttatttcacgaactaaacagtcccgaaatataatcttgttacacgaataaatcagattgttttattgtactattcggcatcaatcacggcatgttatggtccgtgccatttttcaattcaagcatgtggtatgtagttggactctttgaccaacctgtcaggtcggccactaccagtccatttccactctcggcgtcggggccccacctgtcatggacccgaatccccccgcgccgcgtacgcgaaggtcggtgggaaaccggcagagcaaaccgcacgataagaacgcggccgacgtggaccacgtggtgcgcggacgctctgcgtgcccgacttggctttctcctcctctctcctcccgcaacccgcgcacgattcggttccccctctcctcgcggccgcctcttcccccctcgaatcccgataagcagagcggaattctccaccgcggcagcaacatgcaacccccagttcgattcggctgcgaggtgaggtcgtccgattcccaattcggtcggaatcacgcccaattttttgtctctactagggtttggtttcggtctgaggatttctagtttggtggagaatcgaggtccgatcccccaaccgggtcggaatcacgcccaatttttgtctctatagggtttggtttcggtccgaggatttctagtttggtggagaattacctctgggattttgcggattcgacgtcggttgctagggtttgtgaggggagcgattcatggctgcggggagccacggggggtacaggggctacgaggtggcgagggagcgggagcacgacgtgggggtctctaggaggagcaaggagcactaccaccaccgccacccgagccgccaccgcgactcggaacgccgccgtgacggcgggcgcagcggtggccgggagctgtcgaatgggtacagccaccgccgggattcgccgcgtccaccaccgaggaggcgtccatcggaagggaggacggaggacagggagcccggcgaggtctcaggtgggagtggctcagagaggtccggtgagcgcccaatgaagaccggggagccgagggagaatggtgtcacgcgagtcagcaaggaggaggcgaagatgtccccgagtaagaagaggaagcaatctccagtaatttgggacaggaatggttcaaagcggcaggctcgagaccctgtgaggggcattagagaggtagatgctgtagttgctgagattattatgcatcagtcgcattccttgcctgtcatgagctcactgtctagcataggcgatggacactcgccaatgattttggatgtgtcagttgataaggtacaggagtatgagaagaacaggattgtggatgaggaggaagagggataccccacaatgagaaacattctgacctcaagatgggcagatgctggcgacgaggaggaaaat

SEQ ID NO: 40902 - DNA, 3171 bp, Oryza sativa
tggagtacatggaacatgatcttaagggtgttatggagacaatgaaacaaccgtatagtcaagtgaggtcaaatgcttgatgcttcagctattagaaggtgtgaagtatcttcatgacaattgggtacttcataggtaatgattgttaatcactaatttttcttctcctttacacattttctggaattggttttgatgttagattctaataattatgctgttccatagggatctcaagacatctaatcttctcttgaacaaccgcggtgagttgaaaatatgtgattttggactctctcgtcaatatggcagcccgttaaagccttacacccagttggttgtgactttgtggtacaggtaagtcattagacagtctatagtttcatacaatcagtctaactcaaaatttaacttatccatggtcttattacatgctccttatgactgcagggctccagaattacttttaggtgcaaaggattattctactgctattgatatgtggtcattgggttgcattatgggagaactcttatcaaaagggccactgttcaatgggaaaagcgagatagatcaacttgataaggtatatggttttgacttttgtctattccatatctttattttgattaaggaaatcttatgatgaagtgatttccattgcagatatttagaacacttggcacgcctgatgagaatatatggcctggttattctaagttgcctggtgccaccgtcaaatttggcaaacaaacgtaagtgccaactcatttcttgtttctgctggtttatttatttggatcatgcagtttctgtatcatataaagtcttaccactcattcctccctcaggcacaatagattaagggacaagttccgagctgtatcattcactggtgggccgatgttgtcagaagctggatttgatctgctaaatagattactgacatatgaccctgagaaggtaatacacttaatagagtgatccatctgattcttgtatcttcattttgtagctgactgaacatggttttttcatacagcgtatatcagcagaagatgccttgaatcatgaatggtttcgcgaactacctctgcctagatcaaaggatttcatgccaacatttcctgctctaaatgagcaagacaggtacgagtgattttgctttttacttctaatttatcatcctaattctgaaattggcgttttatgtggtttgtaatgttgtatttgcaaaacatgcaggcgcttcaagaaacatatgaagagccctgatcctctggaagaacaacggatgaaagaacaagggaacaatggagatcgtggcctttttggctaatcttgaaccatcactataggtctgctgtggatgctaattttcagcgtggaatcaatggaagtacatgtcttccaaggtgagatatccactggaatgaagtatctgtcttcttggtgcctgcgacaactgatggcgttctttagcaggcatatgaagggggataacatgtctccttatggtccatgctagctattatatcattgcagggttactgggttagctctttctcagacttctggtcacaatctaattcacctgcattataaggtgtgcagatctaacccacctgcatgatctggcctattaacttctatctggtgcaccagttttgcttctgaaatttctgactgtaaagtaccttagtttggtactttgtaaacaatgatcaacaggacctttttttttctgtgcaatgagcacattttcttttgatcttcgcattttgtttgcaagagatggatggagcaaaagagggagggtgcattatgctttttgacgaggaaactggtacatagtaatgcaaaatgtaaggtaatatgctgaggcttattgtgtccactgatgtggtgtataaaaatgaaatgtatctttaatcttttttactgtactttgcaagatcacttcagttgctccctgaagctgcttgaaaactagctaatttatgtaactggtcattataaaaatgatcctccactttctggaaggaaacaatacctgtcagatttttcaatatcacttgcgtgctacaatgatgtattactgactctatctacttctaatcttgtgtaatagaagaaccaatcaatttaatatcatttgcttgctacaatgatttatcagacaataactgactcttgtctacttctaatcttgtacagtataatagaagaaatcaataatctaaggacgtacgattgtattaatttatctttggaccatttgtcttgcatcatttttttgtaacaagtgacagccaggaagagttctttgtttttatttatttatttatattttcttctaatgatctacctttttaatgataggccgctagacttttatcaaccaaatcattattcatgataatggtgaaagatgtgaaatgtttttaactctgaggtgctggcttttccctcatgaaaaggcaatactcactgatctttgattcattttgctatcctgttgccgtatgttcagttcaaatcatttgcttgtgctttacagatgattatagtgaaatcagtgattcttatgatgtccattcttgcacttatcataataaatctacatgtcatattgacttatcactaaagttcttgccagaccagttaatgatgttcctttatgctagtttgaacttgctggagagttgattgggttcactgtaaacaactaagtgttctgtgacacatctgcagcttaagctgtggctataccgagacaggaagcttgatggacgtatctaattgacttatttgtggaaggcttcgagtcttcatctgtgatctgttactgttgtgaattctagtggtcagtctgctatcttatttctcaatatattggtgatcagtatgcttcttgctagtagcttcttttgtagctgtacacctgtttttttttttcaatgacagatatattcttgacatgttatattttcagtcctgcccatccacatatgtgggacatgattttagtacgagttaccagcctagatgtgtggatgaatcaggattttgggcaatccataatttcttgtatctccttgtgtccatgcctgcaagtacagctgtgtgttatcctgcagaacctttcgttcttttgttattctttttcaa

SEQ ID NO: 40903 - DNA, 2156 bp, Oryza sativa
tgcaactggaaactcattgtagattggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagtgtcatgggttacttgttttaaacttataagtaaatattctattgagtgaaaggcttgaaaattttgtcaccaagatgcgaacgaccattaaatactcagcacagttaaggcttggaaaataaggttacatgtttagcatgacagtgcgtgaagtagagaaaaaagcgctgtcagcaattatgctttcctgaagcaaatcgatgtttctggtattcgaacttttagggcatacaaaacagtctttatagcaggctcttgggggtaccacctaagctcagttaatatcaactctctgtagactcttagcgccagataatagggaattcctcgcatgaagctagataaaggaaagaagaataatgataaaaatattttggtggattcatggttagagcctctgttgtctcaattgttataagaggatagtctctaagatgatgtgtattaccaaggaacccatactaggctcaactgttgtacttgccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttaccaaccatgcttggttctaccagtatcaacactctattcttcttgtcgtgtcatggatctgcactgcatcttttctaatgtctttgcatttacttgttttaactgtccctttgtttgtgtcccctgcaaacctcgtgcaaagcgacaatgggccatactccgagttgcagaggcaacaagttctctacgtctcctatcgtatgtctgaccattttgtaggagcggagttcagggacctttgtcaaggcaggcggccggatttcttgtttccggtgctgcaatatgctcaggcgcgttccttttttcttttttttttggagaacttagccactaggtaaaggttgtaaaatgccgtagcatctgttctctgtaaatacgactgggtgaatacagtgaattggtatgtttcactttcgtcgatttgttggtttgaaccgtgtctgaagttcacaaatctgtacactatcatgctgcatcagtcgaatctctgggaaacggaatggtcatcagacgtcttttgagaatttgagatctccgagcactatgtataagatgtattagaacgtgtctttttttctgaacacgtacttgaattccaatcactatactttgtcatttcacaaacaaatatactagattgaaattgacgagaaacgcatccccagtttccctacggagaagtaccatccaaacaaccatgcgtatcgaggtctgaagatgcaaaacctgtggctttcagtttctactttcagtttccacagtccagtgctctctgcttaggtggccactggaggaggaggtattgcagcaaagcaggtagcaactggtgggccccacaccctgagtgtcctcctccagaactatagacaaccaaatgggccggaggcacgtgggccggcccgggcacggcggtactgtggcc

SEQ ID NO: 40904 - DNA, 1762 bp, Oryza sativa
gcgcccacgtggcgcgcgttggatggtggtggggttgaaattttgcaacggttaccccgcaacggctacttcaacggctaaaatttgaaaataaccgttggaggtcgaaaaaaattcaaaaatatatgaaaaaaaactcaaaaattaggaaattttttcgctataaatagggtagccaacccaaacattctggctcatccaaacattcaatcttgtgctctcttgtggtattttgtgtgttgtaggttacgactttacggtcttccgaatttttggcaaaatttctctaaatattgccaaaaataaaaataactaggggaagacatatattcctatttgtaagctgcaaacaaagagttgaagaaggtaagaaattattattattattattattagtgttattatttacgtatatgttaattttgaaatttcagcatggacgatccgaattacccaatatttgacatgagcgagtacgacccaaatttcggcatggagcaaggtggcagcatccctgcaccgatgccggaagaacctgcaaccacacaggtggcttcagaaggatcaggaactgtggccgcgagtgggtcaacggcctcgtcctctaaaagatcgagaacttccaccgtatggcaaaattttgatgagatcaaggagaccggccctgatggtaaagaggtaacgttggctagatgtaaaatatgcagaactaaattatctggaaaatcttcaagtggaacaggacatttaagtcggcatgcggcgtcgtgtgctaagaagcaaggcatccaactgcgacaacaacaactgatattgaatcctgatggtacggtacgttcgtgggagtacgatcctcaggttgcacgagaatctcttactcgattaattgctagacaagatttacccctaaattttggtgagtcaactgcatttgaaaaatatattcaaactgctcataaccctaggtttaaatctgttagttctcaaaccacgacccgtgatttaagaaagttctataaacaaggtcgtgatacactgaaagaattatttaacacttgcacattttctgttagtatcacatctgatatttggagtggtaaggccaaggaagactacataagtgtagttgctcactttgttgatgataattgggaaattcagaaaagaatcattgctttaaaattaatagatgttgcacatactgctgataatatcgcggaaagaatttccatggttgttcaagagtttgaccttacaaataaaattttcgctataacactagataatgcagctgctaactctagggccatggaaattctacaacctgtattctctgtctatggtcaatcatttcttttacatcaacgttgtgcatgtcatatcattaatctgatagttaaaactggttttaagagggtatctacacatattgattctgtgcgtgaggcaatctcatggttatttgcctcaaacccacgggttgcaaaatggaaaagattttgcgatgcatcgggtatgaagccccgtaagttccgcacggatacagatcatcgatggaataccacgtacctaatgttgaggcatgtgttgccttataaggatttactaaccgtttttttgcagtctaataatgctacgaacagtgatgggcaactaataatgtccgagccaacttggtatgtagtagaaaagtttgctgcatttcttgagatatttcacgatgccactgttgctttatctggagtttattatccaactgcta

SEQ ID NO: 40905 - DNA, 11970 bp, Oryza sativa
ggcccacctggctgtctatatccagaacagtcatcactattcactcctctcctttcccattctgtttctcttctgttggctcatcgttggtttcgcccatattcctcttcttgaaggggatcgctgatcagcaaggtactctctcttcgatccccttcccccccctctctctctctctctctctctctctctctccgcgcgcggcctgtcgcggctgttgggctctgcctcgcgtgccgctcgccgtgctccgtgattacttctgtgctcgtcaggcttccttcgccgtcgtcatcctcgcgctcgcgcgacagaatatctcatgatcgatccgtggtgacgttccgacacgcggtcggtgggtcgttcccccgtttccccaccgtggggtgtgcgttggcacggcttttgcgcttggggacttttagcgtttgtgcccggccatcgtagcgatgcgggggaagttgtcggcgatctgctgatgcggctctgatcactgcatatctgatcagttacgtgtccgatccgttccatccctggttggcggtgaaattggcgtgcgtattcgcgtaactacatatctacatgtgctgtttgatcaatctcacgtttcggttatgtgcggtgatgaactgatgatgtagcttatctgaattctcatagcaatgggctttgttcgctatcaagcaagcgttaattctcagtacagtgctttgctttagatgttcagttagtataaagctattgcaggttctgaggtgctcctgacctgcttccacaatgcaagctaaagaatccaaaaagtcaaggttagatccatctcgagctctcaaatgccaaatttattgtttgatttaaaataaccatttcttcatttaagttagtatactgttgtgtgcagggacaggggccgggaccgtgtgaaatggaatgaagaaaatttgaatgacattgagtcgaccaagccagtaagagaaaaaatcaccgagcctaagacgccatatcactcaatgattgatgaagatgatggtatgtgctttggagcttgcatatagaatcatgttttaatacagctaaagaaaaaattccggacaacatgcatctgatgcttgcatctggtccaagggactgtttctccaaaaagaactatagaagaatcaggggataagtccactcatgctgatgcgattaagactgctttgatggaagctgtttcaagtggaaaattatcagcaagagaacatttggaatcctgtagtaatgaagaagaagaagaagaagaagaagaagaagaagaagaagaagaagaagaagaagaagaagaagaacaagaagaagaagaagaagaagaagaagaagaagaagaagaagaagaagaagaagaggtggccatcaaacaaggcacaggttagtaatctgcagtcttttcttattgacaatgaaaaacgaaatatccttgtgagtggtatcttgactcttaaagtcttaattggcattttgtattttgatgcttgtgcaagtcgttatgatttcggtgctgtactgccatatagcatatcatgtctgatacatctcacataaagaagataaacacaggaaggaataatttcaggtatcctggtctcaggctatggggttgattaagtaacctgatcctgtgatctgtaaatctgatttgaattgtcacattttagaccgatttgtcttcctagctccagaaaatatctactgatagaaagttcaagactcccttttgtctgattactcctttatccacttcacttgtttttttttttaattcaaccctgctgttctattggcatcatggtatgccagaccaaaacttttgcttgatagcaaggtaagagctaatgcagtgtacaccagtaggttagctctagtcctggtttagtagctagttggaccatcaaaatttgtataattgtaaatagatataaatctcccgtgtgtgttttcccgaatcagttggatattttttgtgggatgatgaccattggggaagactggttgcaagctgtgttgctattttcctatctctagttcagattccggaagtcctcaaggcactggtggatacgcttcaatttttactatctatgtgttttgcaagagtaacctcaaatttcaccatcttgttttgtgtttttttttcaaagtaagaatgactgcttttacatgctttcatatagatttcgaagagcaacggaaggctcactatgatgaattccgcaagatgaaggaactgcgtcggaggggaacgccgtcacaagagggtgatgaatgatgactctggcaccgtcgcacaactcggaagcatatgatcagcgaatcctcggcatgttaaatattggcagtggcaggaatgttttacagatatcctactaaaccttaaaaagctcatgtgactatctgttctcttgcttaattattagtactggtcctaggacagtaccaggtaaaattttggctcttattatggaggtaagaaaatctgtatcgatcttgtactcaaaacttatgctcttgttcatgctgttgattacaaagttcgcaaatgtgacactctctgtggtaatctggtgtgtaatttgtgcaaattctaagcaaatgcaaattgctgggaatattatctatttattttcggcgcactttgctgggcatcgttcagaaatgccaacgtcccactctgtgtgcgaggtagcaaaatttgcattcagcacccgcagtttctgcatattgtcataacccccctatctggacacggtcacacgaaaattggagttattagaggggtttatctgcaaaaggaacaggataaacctggccactcccgttactctcgtcgtcgacctcctcccgctgctcccgttgcggcggtcgccgtcgccgccgacgatgacgagcttggaggcggccgcacgcccgagcagccgccgcgtggcaccgtgcgacccgcggggacgccctcggcttccgccatggcggctcatcctttccccctccccttcctcccgcaggtaaagcctctgcttccttcttcacgcgcttttaagtggaattggccttgctagattgatagctgagtggaaatggaagctgtgtgtggagtttcctcttggctcttgtgattccagactcgatttgttcacctgcgccattcacatggagctgcagttcaaacccttaggttttagcatctgtgtaatttggagagtaggtgctccagttctacttatagacgaaagattcatattatagtcctggtctcagatggggatgccaatgactgaggtcctgttagaattgtgaatttcaatgtcagaaccaattttgcctcctttctttgggatcaaaactggcagtcattcttttcaaaaagaaaagaaagagaaagagaaagagaaatggcagtcatttaatttgtttgtataaatgcaaaagggtctcaattttagttcatttgctacttttgttttggttggactagaaaaccatcaagctaaaacataaactttcaaaagtaaagtaacattgagtatttaacattgtccaataattgttcactcttattcttatcatgatatcatcatcccatacattcttaacgctgctatctgttctacaggctttgcactctaatttctagacaacttcccatttgcaatgcacaatcatgtgaggttacttatttatcccttcttaagatcttctccatgtatgtaagcaactaagcatgcaagttatcgttacagtgcacatcaattctctgtgatgcagatacggataatctgtggttagccagtggtaatgctcaaagctccgctgctgttcggtcaaggttgcttgctgcagaaagagaggaagcaaaagctgtgctatcactatttttaagacagaaaggtttgagaagtatactggctgcacgaattgccaataaggcagatggtttcattgaacacctagtttcaaagctccacattacttacagatcacgatatgctgaaggtttgctttcttgattgtgctttttgcatatctattggtttgaacttttaacaacacgtttatttttcaggaagggagctcagcacaccggagattagagatgctttgattccatatctggaagccctttctaaagaacatggagatggtttggttgaggtggtggagaatttccccgatccatttgctatggaacgggaagccttgtcttcttcaatggttcttacgcccacaagctcaaataaacacaaggcaatcgctcgggtaagcgcaccaacctcagggggagcccttcctgagctagttctctatctactggaccttggcatggatcatgaagagatcaagaatgtcgtgcggaaattcccagcatttgcatattacaatgtggatcgcaaaataaaacctctggtggcgctgctacttgagcttggtgtgccaaggtcaaacataccaggaatcatcaagaagagacctcagctatgtggaatcagcctgtcagataatctgaaacctatgatgacctatttggaaaacgtgggtatcaacaaagataagtggagcaaggtgctttcccggttccctgcacttctcacatatagcaggcagaaggtggagacaaccgtgagctttctcactgaactaggagttcctaaggaaaacattggcaagattctgacgcgatgtcctcatatcatgagctacagtgtcaatgacaatctcaggccaactgctgaatacttccagtcaatcggtgcggatgctgcgtctcttattcagaaaagcccacaggcttttggtctgaacattgaggcaaagctaaaaccgatcacagaatttttcctggagagagacttcaccatggaggaaatcggcactatggcgaatagatttgggattattcacactctcagcatggaagataatctgcttcccaaatatgaatatttcctgacaatgggatacccaaggaacgagctagtgaaatttccacaatacttcgggtacagtttagaacagcggataaagcctcggtatgctcggatgattgattgcggagtgaggttgattttgaaccagctgttgtcagtttcagatagcagatttgaagatattctacggaagaggatggatggaatatgagatggtcataatttcggataaccatggtttaggacaatctcatttgtaacaagacttgatcgctgccctggtatatagtttatcagaacaagtagtgtcctggaaatttgtacttagccatgcttggcagctgaccaattgttattgacagtttgatgtataacttggcggtttatgatgctagtttagctatttttgcatggagtactggcaaatgcattttgtacagctgttgtggcatgctaatgcccctttgccatcctgaagataatgcacttgtatttgatatcaggaaaagttgcagcaccagcacgtataacatggattctcttgcacatcatagaagccggaaaacagacgaagtacatattctccagtatacaactaaaattttagaagctaatcagctataaagagtaattagagagtacactaaaagcatgcagtgcactagaactctggtttacattacgaatatgtaagtgcttcgccatcactcaccactcatcaaggttagtgataaaatggataaaacacagggaagccctgctttttctttaacaacagatgtttgccagggctgcgttcatgaatgcgctgcaaaacgggctcctccttgttttcctgcgcttcagcgtcagcatcgcatgggtgttcgttgtacttcagtgctgaagtttcagatcatgaagattccaacaatagccaacctaataaaaaggaagcacatcaagaaatgctgcaaaatgatgtgatgcaaggactgtataacgtaatttaccaaatgcaactaagacattacactgatgaggaaatacacaaagcagagaagtcaatttgacagaatcagtaaggtaaaacatcagaatttttgcttcaaaattagcaaaaatacacagttgaaaatgcaacttggaagaaatattccaatgccatcaacactaactccaacctccacagcccaactcaaggagtcaaaaagaaagaacgttgacactaaatatcagctatttttaagctttaagtgttttaagtttttgactatttatgccatgaagggcaagtttttcctcaatgcgtgaaagcttctcaattgaatatgtgaaaaatccgcagtagcatgttagccaatttaaatccaaacatgcttttcatatcaaataaaaatatgacagcagaccttttatcactcaattggttgatatatatgaataagttattatggttcacggctaacatttcagcatatgaaagatctgcttgcatggagtttgataccacgtcccgccatgttcaaaaagatttattttatcatatgcagcataaacaaatgaatgatatgcacaacaatcaactaaccagttgcagtagaacaagtttgagtgtttcaattgttgaagacttgaagcagcgatttcaacctactttcaatgtttgcacacatgagcacatatatagtgcaactatgagatgaaaaattataagaggccaactattgacaaagtgcagctcttagcagaattaaggcaataatgaaaatgacaaaataacggactacaaacaaaaaccactatgctaaagcctcttgggtacatgactaaattactcccagtaaagaacactacatcagttgaataactcatcggaaccatgaaaagtaagaacacaccatctctcctagcggcgcacattgagcatctccttggcctcttcctgctcaacctgcagggcgtcgctggtgtacttgctcagcagctccttcttcttccgctccaacaccatccgctcaatctccttctcatcgggtagcggcacatgcgcgataaactccttcccagcctcctcgcccttctctctctccctcttctcctcctccagcctcctctcctcctcaacctcctcctccacctcctcgaacagcacctccctagcagcctccccgccgcgcccacctgccgaggccacctcgccgctcactacccccttcatggcctcccgccgcacccgctccacacggtgccactcagtgatgacctcattgcgcatgcgcttctcggcaacggcctcgagccgctctagcatgccgtcttcgtcgtcgtagtaaccgtagtaccctgcgttgatgcgcttgtggatctcatagcgggtccgccgcttacggacctcgggtggcttgtcgaagagctcacggacgccagggagcttcttggcggcgccgaagtagcggtacccggggccgcggccggaggggttgggtatggcgacgatgttgccgtcgaggtcggtcatgaggggcgcgttggagctgcgggagtggtcgcggccgccgagctcgacgatgcggcgctcccagtggccgcgctcgcggaggagcttgttgatctcgtcgttgaggtcgcggaggcggtgctccccgaggccctcgttctggatctcggcgaccttggcgccgatctcgcggaggatctcggagcgccaccgctcggcgtcggcgaggtcgcggcactcggaggcgaggtacggccgccgctcccgtggcttccgcttctcctcctgcttcatcgtgatgaagcggttcagcatggactgagccttctcctcgtttcgcgccatggcggccggtcgggaggcggcggtggccggtggccgaaggcggcggcggcggcggcgaggttcttggggctgggagagcgagggtttgggaggcggcgggttcgatttggggatttgcgggttgggtggggaagagggaggctgctcccccgattcaatcgtgatgccttttcgggtcggtttggcgtctgatgatgatccaacggtgcggattgaatttgggattcaagtactcatttttgctattgaaattgagttgaacttgcgaagatttacgcccagaatttgaattcgtttttagtcaattcaggcatttgttcaatattgtacggaccatcgatggtggagatttgagaaggaaagtgatgtgttttgagtgcatatggaaaatgatctctttggcctttcaggatctttgatatggttagaatctgtttgttgtaaagcttaatattcgtgttggataaacttatgctgaaaattctatccaaatccagtgtgagatgttcataaatcacaagtacatatgctcaaatctatgcgatgcaatgaattgaggaaatcctagctggttaggtaacttattgaaattaagttataaacttaacacatgtaattgtgtatacggctttcaaggtgctaaagtaaggcgtgcatgtgcatttataccttgtttcacaaaaaaaagaacgcaatgatgtgtttcgaaaaaagacatatgtatttgccatgtttacattctaacttttttcttcaaacttctaacttttccgtcacatcaaatgtttggacacatgtatggagcatcaaatgtggacgagaaaaaaaacaattgcacagtccgactgtaaattgcgagacgaatcttttgagactaattgcgccatgatttgacaatgtggtgctacagtaaacatttgctaatgacggattaattaggctcaaaagattcgtttcgtttacagacgaaatctgtaatttattttgttattagtctacatttaatacttcgaatgtgtgttcgtatgcttaaaaaaattttggcacgtgaactaaacacaagtttgaatgcgtgtaaactttgaaacttgatagtgtctcgaaaatcactgggaggacttgtcaaaatcctatggcccttttggattccacggcccaaaccagcggacggcctgcttaaaactagccgccgacttccggcggacggcggcgccggaaacccccaccacatctcccggcgattctctccaaagtccaaaccccccatggctcggaagaggaagcgggggcggacgcggcgcgccacgcaggcggaggcggaagtggagcaatccgagcgagaaatggtaggggatgaagccgtggaggaggaggaggacgacgacgtcacgaagatgaatccgccgccggcgacggccggtgagcgcgaggaggaggaggaggaggaaggaatcgaggggcttctggagccgttcaccaggaacgagctcctcgacctcctggtcgaggcctggctccggaaccccgccctgcgctcccgcctcgccgccaccgcggagtccgacgccgcccaccgccggctcttcgtgcacggcctcagccccggcgtcaccgccgccgcgatggccgccgccttcgcccccttcggcgcgctcgacgagtgccacgccgtcgccgaccgcgccaccggccgctgccgcggctacggattcgtcaccttccgccgccgctccgccgcgcgccgcgcgctcgccgccgacgcctcctctaggctcgccgtgggcggccgccccgtcgcgtgccagctcgcgtcgctcggccccacctcccccgaccgcaagctcttcgtggacaacgtgcccgcgcgcgccgcccacgacgagctgaggaggctcttctccaggttcggggagatcgaggcggggcctctcggcgccgaccgcgccaccggccagttccgcggctacgccatcttcttctacaagtaccccgaggggcttacgaaggctctcgaggagcgcaaggtggtgttcgacgggtgcgagctccattgccggcgcgctcacagagtgaacaaggagaagcatctcatgaccatgcctgcagatgcaggggcacagagcaatggcttcgagaacgctgcctcacccatcatccatgtccagccgaaggagcttgcattggcatccaccacgcagacgcctcttggatcaaatcggccagttgagatgatggcgaaggggcctagatcaggcacggttccctttcgtcagaacgctggagctggtctcttgggtgcatgccctgtggctacggtcacgtcctctacgccagatcagagcacaccggttagccattctggagcttcaatttccacaccccggactgctcagagattggctaaatcaggtttgatacagagttagtacctttagttatagttataaatactatgagctattgctagcccacaaatgcaatggaacataatcacacagttaagtgggtactaacaacataggcattttctttctcaaaataaggaataacatgtgtgttttacaacaataaatctcatggttaacaaactacagtagaaataaagatcaaagtgtggttttgtgaggtgttttaagtttctagagacaacttagaattggtgaccgaatgcatgtctattgtctaatatagcatcctggactcctggaggacaatttgggaactagagttaagttatggcgactgcttttaatgcatcctctggataatgatgagaaagaataacctgtaatggccacgcatttttgtaggaccttcttatcctcattttacttggggtatccattttttgtaggagcacaaggatgaagagaaatatgccttttctctctaaaacaaggatgaaaaaagaaatatcgaagatgactcctccaaattctgaagttgttttctttctatcaaatgagaggattacctgcaagataatctcctgctgatcgaattgtgcttcaactttgatgtaatctctgtttgtttataggcagagctcatatattgcaggtaacacctgtcccgcctttatagtggggactgcgagtagctaacatggaagaagattttggtttacatattcagttcttgatattatttctattttgtcatttcaccatgcatgtggtaaagtagtttcatagaaaattcgacgaaaagtggaaagtgatgaattcacatttccatattccttcattccttttgagttttgactgaccaagaaaagaagtggtggctctatgcatcgacaatgagtggtccttgtgactttcttgtggtctcacatatgcaaccaagcacagggggaaggcataactgagatagatttgacatgttgcaggaacatggcacatcaacatgaaaggttcagttacttttctttttggttcagacatgattccgtcctgttcaggcattataatcagagttgttttcagccaatggatcaatttgagttttgtttccctatgctgcacatcccattgccccgacaggtctctaagccctcttgttggccatgcagcgcagcttgtgaagcagggcattgtgatcgtgccatggacagcactttcacattggtataacaccaggatggtggttgtcgtgctggatgaggtgggacaaggaggatgtcagtagtgtaaccttgtgatctgatgtcctggttctcggtaatgtgtggcttgctgtggagtttatcacatcatgtcaaaagcagatgcgcttgagtgcttccttcagcgaatggctccagtttcttgggcataattctgttttcatataagcacctgatcccccgctgtgcctagagctgtcaactgaagacagatagaatgaaaagaaaacttgagtcaaggagactatggcattatattgtgtcactttggctctctgtatgaacttggaggcataatctgaccaagactgcactcacatgttgggacagatatggatttataactcgaatggccttctgcttctgcacaaaattagctttgctgctggtggtggaatctgaaagcacgattggtggatggtgggaggattctgaattttgattcatagtgaggtcatcagcatagatcgtattgaattggttttattacatgtgaggtgatggaaaaataactcatacgc

SEQ ID NO: 40906 - DNA, 9349 bp, Oryza sativa
ctgtggatcttacagttttcactgtagtttccttcttacacttctaatccacaattagatgttgctttgcatgaatctggtagagtcttaacaatcctggtagagtcttaacaatcacgagggattcttttacttgcattatactattatacattaaccttaggcttctgtatcaagaagctgagatggaccaattatggagaattatcacatgttaagtgaaggtcatttcttctggaacactgtagtcagtgtttgtacagatcacaaagtaattgagaattaagttgcattacagtccagcatttactacccatatatggtgtgcttggccttatgcaacattcaatcgaccctcctgtttgtagaggaggaatgtcattatccaacttatcatctaatgtatcgtctgccaccacaaccattctctctttggcagttgaagaacacggcagccaccggtggtcctaggttgtaaagtgccgagaaatcccttgtgttaaaattttgtcgccatccaggtgcataaatggtctgttggacagattgacggaaaagcacaaagacaaagcgatgtattcccgctgttggctttggactttcatagctgactatctcatttcctgaaatagtttgtcaggacttcttagaacagattggtgtaagtgaaaaacaaatcttactgccattgttacataagcatttgtgctggattaggagtagaatctcttttgttctttctggcttaagagtcacttcaaacctgttcagatcttattttttgacgcaacagatatattatatgttgcagagcgacagtcatattatgcaatttttaagccgccatcattcaaatatatttgtaatggatcaatgtggaaggtcattgtggcagtgtgcccatcctgttgttttgcgatgagtaatagttttaccttgtgcactttttcaacagcaatagttttcatcatattgtttgtaaaatcattttgtagattttattcttgatagagttcctatattatttttaatgccaaaacaagctagatgtgaatatcagcatggttgccaaagatagtttcatcttaaagaactctctagttcttttaaatgtgtactcagaaaaaggagatgtaaaagaatgggaagaccataccaaagctcgcatttgttgtttctggaatgtccgtcaccaacctgtgtaacattcgcacaactttaattttgcttttattttgagcataataagcaagtgatttcaattccattcattgcaaatgtctcaggtcttaccaatgaaggtattctcttttggttggattgcttggacttggtgagtcaggatccaccatcacctattggtaagtttgttctcactctttgttagaagcataaactggagttcttattttataaataaattaatcatgcgaaacttgtgcttaaacattagtattttgccacttgtattgcaaaatcttagtatgtagtaataccttcacataaccacttatatacataacatgtatttaacaaaaccacagtatataattctaactgggggaggttttcacccaatgacttagcagcatagtgttgaacaccataatatctacctctttggtcatgaaccaaaggaactcctgtttggtttctaggggacagatgggaaagcatatatacatgctcatttcctcagtgaaataaatgcccatttctgtggttttatgaaacaagtgacgagaacatagtgacatacttatgttaaccgtaatttcctcagttattattaaatcagagcaatagtggtgctgaattatttatgcatgattagtttttcttgtcttctattaaggcaaatatgctattccttgaaattgttgtcctgtgcaatttgattattaggatctgagctatttgattgttatgaatagcgcttgtattcattacagggctctaggcctgactatatagatgtacaggtgtaagcccaaattcaaggaaacccctcacataacgtgggagggggggggtggaggggggggggatacaacacatactacatatcttgaataattgttcgatattttttacacaaaatgtagtgctgccaggtctactcaaatgtttgttatgtaacatgaaacatcttattgagtctagcaaagaatatggaatattcacattttatggctcagattgctgaaagcaattgtgattttttttactcatatataggcagatgtcctaaatgtctaggccaatgtgtataaattttaagtttaatctcttcatgcaaaggtgatgttatatgttctgacactagcaaatgcaaggtggtcatctttacgtcatatattcgaaataaaatatggaagcgcacaaggcctttctgtatcaagaaaaaacagcttctaaatctgtgcaaagtcaagattcttggttttgagtaatctatggatactgaaaacaactttgaaatggatgtactctaaattgttgtcctgcttgatgttttatagaatgccagtgatctgacttgggccctactattgtagcttaaggccatttgcttagatcaaagaaagaaaactttcttttaaattatattgaattttgaaatgaggtggacaggttgttatgaactcaccaaagtgtaaagtgtcctcatgtcacgaccagcaatctcaatccttggctcgttcgctacttgtgaaggcttgagctcagatccattagtcagttccctattgctgtaaagcactctgagtgatgctgatttgataaatgggtccaagatatccccaaccacattgcctacaacaagtggatcccttgacatagttagctacaattggtattttttcaggaaatgagtagtattgttctggggaggctgagaggctaacttggccttaactgtgaagttgggtgaagtgaagggttcaggtttgtgctctatatatacttgcaatcccaaatgctgaaccatttgtggacaaggaaactagtagctctggacgacatggtatcttactttaaactgtaaacaataatatgggttcccatcaaatgaaatatttcgggctgtccaccctcttggcctacaccattggtaagcagcgctcactgcaattccacgtaggtgaataaaatctgatggatcatactcacgtatcccctatacatagggtctaataaatagttgtccgtagtgaaaaggggattgccttttgacttgccacatggactgatgcatcatgttctttgttttcagctattaaattcccctcctttttcacagtgaagggtttgtagcaaacacaagcttcattcacctaaggctctttatctctgtttacaacttgctgtttatgcatgatagaaactaattatgtgttgatggtattgcagggatgatcattttttctaagtaagatgaattgctaaaggtattttaattggtataagcttggtgggatgggaatactattctgcaatgataaaaggtggcaatgggttttcgtgacaattgtatcaattgttggctgtcttctcttaagataataattttcatgtccctggatcgcacttgtatcaattggatgcttgagatgctagtttgtggtacaagtgtatggtctatatcattgtatgtcatcatccagaattcagaataatgtccagttcatctatcaaagattataatcagaactgtttgttttcacataatgatgatgattggggcatcgacatatatcagtctcctctccaattaactatgctgcaaatttgccactgataccggcttttccatatttctgtcatcttagggaaagccagaaagagaactgtgcctatgtttgtggtcaggtatgggtggacaccaaagccatccaagttttagtcctcttcggtgttgatttggatgcatttctctttaataaaaaaggtaccgacatgtcctattctctctctctcagagtcaggaggggattatattagagttttttttatgccctaaacacttggaacatacttttaagatctattctgatctaccaacgtaagttgtggataaagtttcgattataatttagccttattctgtaattatgctctctctctctctctctctctcaaagaggtgtcattaaatataaagacatatactccgtcttcatttgcttttgcctccttgaattttctgactagcctatgttctatcagatattataatgttatcctagataaaacaaagcatctttgtagtgttccattcctttaataaaacaaagcatctttaattagtttcttattgatcaacaaccatatcttgctatgatcagctaatgcagtcgaagttaaaatcaccatatcatacttaaaagtttcacagtttcacttggagtaccggttctgttgtctaatgtgcatgtgttgccaatgcacccgcccaatcacaatttactcaactttaccttttctattataaattgatttgttcagatatgatgtttgaggcagtaacttcatgagttcttgtgaacacttgcagaaatttatttgttctttgacatatgtgccattccaattatgtgatcaaatatcattttcaaaagattcttgccaagttgctgccttttcttttaatacaaaaaactgccatggcaatttatatgtacttgagacaagagaggaggtaaaagcatgttagataaggtttacattgattttgactacttggggaccatagaatcttatttttgtatttatagttttatgtatactttattttttggatactgcatgctaccttaactagtgtattctgcatgttttctgctgtgcaagtttcggcacaataatcctgagactacttccacagtttgcagcaagttctgtatttgattagagaagtgccccacacgcttcaaatcaaaggtaactaacattatcgaacctaaatgttgaaacggtcatgccagcaagtaaagttgcaatgcatgatgatggattgatgatgaatactaaagctgatggaatctatggatgtcatttggttaggttatggctttacaatctttgatttttttgactgtggaataaagcagttccgtccttcacgtgggcatatcccattaatccagccactccaacagtgaatggaaacgtcccaaatgatggacaccatcacatgggtttccaaagacaacaaatggacgtttgacagagctcccagaatggaatttacatgaaggagacacaaaggcggaaagtttctttaggggtggaaaaaagaaaaattcctacaagggtgctgggcttattattgcaccggctacagcaaccacgaaaaggaaagctggcagaattttgacatatcactatctaccagtattagttaccacagaaagtgacacggcaaagctgtctactcccctgttgaagtgagaattctggcataccaggagcaaatactgttcaggtaatgctggtacatgctatatcttttggtggcacctacccatctttgtcactgtctgtagtgcaatgctagccactaactatctactatctgccttgatgaatggaggacgtaggctgccatgccatgaccgttgaaccgatcatatgattgcattccaggatctggaatccttccggaaacgactagctgtgtgtgtgcacttgaggtaagtcctatataccatctcttcttatgattggaagcattctgtctcttgctgccagagtagctgctagtagcaagtagatagcgtacgtgcggcattggtacatgtgttgcaagttgcactctgctctgctctctacctacctgcccatcaatggagccagtgtttttactcgagccgagtgccgcgcgccatggatggatatgaacatgatcacttgcccgtgctcacttcatccgatccagaattccagattccacagcgctcgcgtttgcatcaccatcttatcagtttcctgtagacccggagaaacgtcaatgacgtaaaggtaaggctgagaaggagagatcaaatgacaggtcggcattatgacactttgtgctcttctacatcaacgctcaaaaaggccattgcaatatatatatgtctgtgtttttggtttattgttacagttgtgacatgccacaattttttatttttggagcccaattataatatacttatgcttatgcctttttttcagaccttctattaggtaacgacttcgtgttgatcatggcttgacaaggtgtcacaatgttcagaaatgaacctgactatttcataaattggtcttattggctacatgccgaaagtgcctcctatttcccaaaagatgggctcatgatgatcgatagcgtcaactgcatggtaagctaatgtccaatctgtgttgcttttcttttgactggtactatttctggcgtcttactttttgttttttcttttggtttgcgtggttcgacttggatagttgggtttagtttctactctaccttaacttgcttgagacctgtttttgctgctgtccccaaattcctaacctagcagagaagctctataagactagagaaccagtcgatcgaagttttagagatcatggatacacatatgtaggctgcagacttatacttggcttgtttggcacaggttcaacgctcaattttttcggagctgatatttctagctcctaaaattcttaagagttgtagttaggatgaacgagcattattgagcgagatattctgtttggatgttggactagaattagcgtgtcgaaaaccactttattttattgtagaaactatattttctgaacctataagttagacctgtcaaacaccctacgtcaacaaatataagggattgctccatttatccacatatacaagggatgagttctacttttccttcaactgtctcatttaagcagttacaccaaaagatgttatttatcctaatcaagtactccctcaggacggagggagtaaagtttatgggacatcattgagtgaatagctaatttagtccctcaagtttcactgaaggctcaatttggtcttttaggtttcattttatccacataggtcctctaagtatttgttttggcttaaaattatccttgggcccacttaatatgccatatggttatttctagtcaacaattctgttagaaaatgtcccttccgctcttaatttgtatacaactatacactagaaaaaaaactaaaatgaataaacaacattgcatatgtacttcccattatttcaacatgtgcacatgaaacttgagcctaatggctatcgtatacacttgcaagtacttaatttattttgttttatataaattgctgtgcattatctataaaaagaattcattgcatgcaattttttctcttatatatgtgaatgaggggtataagtgttatttatcaagagagttgttggttatgttggtttaaggataagtttaaattaaaataaaaacttgaaggactaatatggataaattgaaatattaaagactaaattgattcttatatgaaacttgaaggaccgctttagccttaaactctactccctccattccataatataaggcatagcatgcatgcatgtaggcaattaactatgaccccttctctattaaattattacttttttaaatactttactctcatgttctctaattctattggatgcatgcattgtatttattaggatgatccaaactacaagatgataataattattttcttgatttttgggttaggggtgattatgccttatattttagaatggagggagtacaaaacagtctatcataaaatatattagtgacttaggattggatgggacacattcttataacttatagcgacttcttccgtcccatgaaatttgtcgttccaagttgtttagcatgtattaaggttagaagaaaaagactataatattccttaataaataatgtataatcgaatgtaggatggtggttaggggtagaatgggaagaaatttaaattgaaagtggttgatgtgacaagtactataaagcgacaattattttaggataattttttagtgctagaaagacaagtattgcgggacggaagaagtatatagaactggatgcgatacatcgttataacatggtaccatgatatatctatttagatatattttgggactgaggaagtagaatggatgtgagccgccgctccaactcaatattcccttggacggagcaacgaaagatcgcagtccgaacgcgttgccgcttgcatccaaccattttccatagcaatcacttcgtaacgtcggtgtcacagccaaattccgcagttctcgctcccatgcatggttcggtgtactaactggaaacaaccgatgatctccgccaatcagcagcaacttggcaaaggagaaaagaaagcataaagcccctcgtcgcggacgtcatgtgccagtgacatcaccgccaccaacttgtgtgagcgctttgatgacactctcgctgcgagaccgctgcagagcgaagcaacagcccgtggtatttaatccgagcttctgccctattagcatccagattcattccagcagcatcgtgtcctggactcctggcccttgctgccttgcattcctgatacgatctaatcctagatcaaccatcacttttctctctgctactccctccattttatataggggtgaaaacagagctgattcggactgatagtagtcataccatatcctaaaccatattttttaagtggattcgaagcggttgcggatagtgtgcggatacggatacagagcggattggttcggatgtcagaaatggagtggagtcggtgcggaatcggttcggaaacggattaaatttatcggatgttacgtgtatatgcaatcaatacaacatcgagttagcaatgcaatgaataataatacaataattaataaatgacctatcgtaataattatatgcttaaggctaaacaagtaaacaacatgaatacattatgtccataatataaaaaacagctacgtaagtataatatgagacggtgaaagtctcatattaagaaatctaggttaattgatgaattagaccattggatggaccaacttatattatatgtaatagatagagtggttacatgtgttaataatttcgtattatccggcaaacgttctatcggataatccgatagaaaagtcagataatccgcatccatcggatttcagaaataccatatccgcatccgcatccatatccgccggatttctaaaaactcctaccatatcctcgttacggacggattcggagcgga

SEQ ID NO: 40907 - DNA, 1247 bp, Oryza sativa
tttattaaatataatataatattgaatatattttgataatatgtttattttgtgttgaaaatgttactatgcttttttttataaatttggttaaactcaataaggttttgatatgaaaagttaaagcgacgatttataatataaaacgaagggaatattacataattaacgtgctgctgtattcttaatctagatcgagcatgattctggaaacgtcactctcagtctgagatatggttcggcctgtaaggaaattaagagatgattatgcactgttaggcacctgtaatttggctctctctagctccaagttgcagaaagctgggcgttcctattcgtaatgcagcattagttttttttttaaggaatgatgcagcattagtgagcagtagtactagattctattctagttaagcctgcatgcagtgatgcaggtcaggtcagttgaactaaagaattcaaagcagccgccctaagctagcttgaagcccgacactcgaataatgcacatatcattgacgagagtgagaggagtgtggtgctatatgcctttctttctttttctgttcctcgctttcagatcgccgggcgtgcattgcatcgaccggtttgcaggtcctttcccaaggtcgcatatcgcatcgatctctcaaaggtgagagatcaaatataatccaagcgtcatactactagtcaaagaacgcgtgcacattcttaaaaaggaagagatcttaagtggtgatgaacaagttgggggcagccagtgaccattggcttcctcgaaacggctaagggcccctttgaatcgtagggtagaaaaaacggaagaacggaaaaaacacaggattctgacaggaattgaagtgtaaaacagaggattgcaaaacacaggaaaaacacaggaatggttatttaattggagcacaggaaaaacgcaggaatcggatgagagagatagaatcaaaggaaatttttcaagagattggagctcttgctaaatttcctccaaaatccacatgcaatgtgccattccatagaaatttcataggatttgaaaagtttcaatcctttgaatcaaacgatttatgtaggaatttcatagggcataaatcctttgattcacagggcctaaatgggcattggctatgatatggcgcatggaaggaacattggccaggatccgtgtgcgcgtggacggcccaatcgcaatcggccgatcactcaggtcgttcggctgcatatgtaat

SEQ ID NO: 40908 - DNA, 3247 bp, Oryza sativa
atgtcacttgtcaattttcagggctaatttagattgctgtcaaaataaacctttctaaaatttgacaatactaaaattttgataagttggcaacattgccaaatttcgatagaatcgattaaatatgttattgccaaaattctttaggtattatatatgtttggtaataaactaaatgtatccatatgtttatcaattttactttaaaaaataatatgatttaaaataacatcaatctgaacgggctttcaatttaaatggaaagtataggatcaaatttcacccagatggagagtaatctcaattgttgttgttaagcttaaccattaaggcaaggtatcaaattgttctctataagaaaaaaaaaaagcaagccacggaattggtgatctggccgtctcactgccaagtgggccatcccacggatgcctttttttattactaattaacgccttcttttcctactaaacgctcccatccctcctcccgttccctcgatctctgcctcctccccccaccgccggagaaggtcgccgccggcgagcgagcgcgcccgccggagttgtagccgcctctctcccccccgcggcagcctgacgccttcacgcagcgtgatctccttccccccctaccgctggcggggatccgtgctctgtcggtcggtaagccctagcccccgcccctcctcgcagtcgcagctcgatccgttcccctccacctccggctagctccctgaacgagcgccgcgcccgggatttcgcggccgccgcggcgctgccgcttgccccgtgcctacgcgtggtggtggtggtcgtgtcggcaaaaaccctcgcgcagctctgtctcggccctcggggttctccctccgggtgtgaggtgtttgagcatggggaaccgtgggataaccgtggctaaaagcacttgaaatcatctagctcagcgttcacttccctgttaatgtagactttataggtgatgaggtgaatcaagtaaaatgtttgtagcatttcacccgttagagtgtattcctgttgaagagtaggagatccttgagattgttgatgtccaatcctttgtattttgtaacttgttcctgcgatacctattgccgagcaatatgttggtgttgggggtgtgttgggtaattggagcaatgcaagctggtctgccagatgtgcaactgtcttgttagactagcatggaaattagtttgtacttttgcacattagccagttaacacgaaacagatttaagtttggcatgctaggaaaatctgcgtcatagatagaggcttctataaccatggctagattttctgaaaatgtccgcatgcagtcggaagcttaaaatgttattgtgggaatccaacttttccctatttgttggacattattctactaatgctttgaatgaactggcaaatgttagagttaatctagcatccactcatgtgattttatcaggttgtactcactgaacatgcttcctgctggctcttactggccccaatgcgattacgcttgcaagctgataggttgccgcctgctcctattgccctgccccctgccccctgccccctgcttgcgttcatggataacagagtgtagactgagatgatactctgttttgtaccattccaaccagagcaatggcaaactggcaatgatagtcttagactcttagtcctagtcccctagacttctgaaacttttttataagaaatggaagaatgcccaagtacaactaacacttacactgggaatgtttgaagaatgatctagacatatgactaagttctttttctctacattgtctgacatccctttgggatttgcagagtgcagactgatcttctaatatttttcatagttctgctaaagttgaaatgtgacagactgacagtgccatggtgctaattttaatacttggacacattttcaagaaaaataatatgctggtatacctttttttaatatatgggtatctgaaactatgcaggttcagttggtggactggtgaactgaaacttattgcttggtgctagtgtgatggcgtacgagattagcgagatcaaaagtgaagttctattctcgaataagacttacatacagcaagcaatcgaaacacttcattggtctaatacttaggacaaatttttttgcaacatgtatctctaaacttttagatcaccccttaaactttggggtaaagtccatttcttaatcttacaaaatggacattttgcgcactaatcctgaggatagaattaataggtcactcaatatcccatgctggttttaaagttggtttttgccaccattcgaccatggatactggcaacaatttctttccaccagttttagaggtggtgttatgtgtgattataaaggaagatggacatatggtttgcagggatttggagtttattaatagtatagtaggtactttgtctacagcaattattttcacattgtaattgttcttattgaaattttaaagctaattgaaaagcatggcatacaagaaaagagagatagagaaagaacttggagaagggctttaagaatagagtatttcagtatagtatctacaatagtaattcaattccagtttcagaaagttgtcacatattcactcctgccgatctcacctattttacctctttcacaccttagttgagtactaataattttttaatttgtctatgtagaaattggcataggcctggtgggctttggcatcctattctcattctttggcgttatccttttctttgataggggcttgttggcgttgggtaatgtatgttacaacgaacaaccccttcgtctgttgtgtcagttaatatcaaataaaactttattgtggtgttacacttgctatctttcttcttttagattttcttcttgactggaatcggcttgttgcttggttggcaatctatgtggcagcttttcacaaagaaggcaaacattaaggtacttgagtcaaagactttgatagatacacgctactatccatttctttcttatctatgaatggataagatgtgacaccatgctacaattattgttttctacttttcttactaaaattagataataataactttgtagttggtcaagttttcaagttgatgcttgtcctaatatgcatggcaatgacataatagttctgcctacataattttgtagacaacaaacttgtttaggtgcatgtattctgcacgagtacaggcatgatcact

SEQ ID NO: 40909 - DNA, 2042 bp, Oryza sativa
gtctaccagccccaactatttgtacaatattcatttcttagtagtcctttttggcacttaatacttttcccttccatttctatgtgcagtggttatggacctcctataccaggccttcctataccagattccagtcattggatggattctgcaatacccattccaggtaaagtttctcatacatatcagagcaaggaggcgcgatccatgatcaaatctgatgttatcatggtgtaattttctttttgttatctttattctgccatgagtcctacttctattgtcttcagattatggatatgccatatggatataactgatgttgcagtattcatctggtttctgcagctgtttggtcagttcaggcgtaaacgtgcatgacaactcacggcagaaattacccttcgtacgggagcatattttgtgatgttaatacggaaacctgctgtgtaccatctgccacgatgcagtttaattcttgtgtgcatattcatactttcgcctttctaatctggagtttatctggcttttgctcattttgctaactggcagtagtttagtgttcatatatagacgatgtagaggcttcaaatgattgttgctagaaatttgggatctgggtttagcaaaacatgtggatcttttagcctatttctaacaaattgtgagccagtaactattgcttgaaaggtcttacaccgatgattcttccaaagaaacttacgttgtactcccttcatcgtaaaataaataaacttagtatgggatgtgatagtccatatccgtagtacttaaaaaatgtcacatccaggtttatttattttgaaatgggtggagtataattgtactaggtgtctttattgggttaattcaatccatgccactacaatctctttgattttaaaaaatacaattactattcatgccattacattttgataaaaaaaatatatatgccactatatactccttcaatgtattcataagaaaaattggaccaaattacccactcttcttcctcctccctctctctcctctcttacctgggatccaaatgaagccatggtcacggagcttctcgcgctagctgtgttgtggcgtaagagcagtcccaaccctctatctagaatggtgtctatggcattaactacattgccatgtaagacttttagcttatgtggcaatatattaattaagagatagagagagtgaagagaggaagaaactgggtctcatgcaagacacagcttcaacacgagaacatatacactagacactatcaagttttgcattggaagataatagtgtcttcataatagatgaagaataaatatgattggtagagaataaatatgaatgtatttattaatggtccactttaagaaatcatgggttatatggtgtatttctattgtaatatcttattaacatggtaccatggacactgcttatggacactatgggttgggactgctctaatggatgagctgcatggtgtgctggcagttatgcttcggaaccttgccaccggcacaccattggaggtcgttagaccaacgggctcgatggggattggaccggtagaagagatgattgattagagagagagggagaaagaggaggaatggtaatatggtctaattttttctataaacgcattgaatgggtaagtagttgcatattttcattttctattaaattgtaatataatgtcttcaaatacacgaataagaatgatattttgtaaaaatcgaagaagttgtaatggcacgaatccctcgtttattttgcgatgaagacttagagtgcatgtcaggcatatttttcaatttactctttttttgacagcgactcattgagggttaaatgcatgtgattatgtccatactgcaatagataatgtgcatataattagtccctggacctaaccagcgatgatgcgctatgagctcatcgtggatctcattgataatgcatttgcgcctctcatcattgctgcctttgaatcttgctctttttgttcttttggcagaatttgccgt

SEQ ID NO: 40910 - DNA, 702 bp, Oryza sativa
tgcaagtacttcatcattgttgaagaaagaagagaaatttgtgtggagcccgcaatgcgagaaggcgtttaaactctcaaggaaaagctggtttcctcagccgggtgtttaatctgtgcgcggcatacctcgacaagagactttcatgagtggtattgtgaacgcttctcgccaaggattggggtgatgctcatgcaggacggtcatgtagtagcctatgcctcacgtcagctacgacctcatgaaggcaactaccctacacatgacttggagttagccgcggcggttcatgctctaaaaatctggcggcactatctcattgggaatcgctgtgaaatatataccgaccataggagtttgaaatacatcttcacccagtcggatctgaatcttcggcaaaggagatggttagaactcatcaaagactatgatgtgggaattcactatcatcctggtaaggccaacgtggttgccgacgctctaagtcgaaagagccattgcaacactcttaacgtccgtggcattccacccgaacttagtcaacagatggaagccctgaacctaagcatagttagtcgcggattcttggctgcgttagaagccaagcctaccttgctcgatcaaatccgcgaggcttcagaagaatgatccggacatgcatggactcctcaagaatatgaaacagggtaaagccgctggttt

SEQ ID NO: 40911 - DNA, 1018 bp, Oryza sativa
tggtttctttgttcgacgtttgatcgtctgtcttaaaatattgcctactggtgttcgaatgagtaggatgggatgtgcttatccccacatgcaaaacgaaatgtctcattagtatatgtttaattaaatattatatataattgttttaaaggaaaatgaactaatatgagtttctaaaacagtttatctataaagaaaatgaagaaaaaacattgtttaattgttcactaagcgtgtacgtgaaaatggagtgagtagaagtcgtcgaacaaagccttgaaaagttgttgtacccaaattttccaaattgttttttttaagataaagtataacaaactgatactccctatgtcctataatatagcaacgaatctggacaggtatctagataggatatttcatataacaacgaatctagacatatgtctagattcgttctactatgaaatatttcatctggtctcaggttgtcacttttctatccagatttatcgtagttatttactactacgtcgtcactatagaagttggtaaacgcatgtaatttacactttttactgccacaaaaaatcccacctgttccaaatcctactcgtgttgtccccatgggaacaaggcaacaagcctccctttgcagcgccagaaagattcctagtcctcctctcctcctcccctgagtcccctcccctccccagctcccctcccctcccgtcacatctccgcccaatgtggcatataaaatcccccagatccagccctccccacctccactcccttcctcattgcacacacgagaaacacagattcacacccacgagtgttcgttcgtgcccgatcttgcaggtggctctgtgttccgttcttgttttgttccggtttcttgcgctaatccatcatgttcgcaggtgggggtggggggttggtggtgatgcctgggcgcagtggtttatcgatcccttccctgccttgtggcgctgatccaggagcggcgaatttctttgagagggtgttctttttt

SEQ ID NO: 40912 - DNA, 3622 bp, Oryza sativa
attctgatggttgcatgattaccatgtttacatggtagctgtaggttttgcactacaaatttcccctggatatattgtctgagacttagcatcagccatactttgaccatgccattgctaatgtgtaaggataatgagatgatgcattgatgcttgatgtaatttgtgggctttggcctattttatgcttccaaagtattttgcaggtgattgtgtggttttgttttgtcttctaatagtgggaataagttccttgctctagagagattagttctcaattgcaatttgtatccattaatggaactacgcgaggtggattcttgttggatcttgcttgctgccgtcatgagtcatgactggaacaggttccagttcatgtggagtgaatcaaatgcagaatacgttctaatgccaatgggtcttcccttgtattcccaatattcttttgcctattgctatggtaaaaaaaaagttgtttgcaataataatctttaaaaaccttttaatttgtacttctattgaatattattgtaggtagtgaatccatctcttgtctctacaatataacccctcccccccccccccccctccttgtcttctgtaattatatgaagattagccagcaaagttagatgtaaaataagatactttctagctaatgactgctagaatggagtaaatcggtaaatgctcataatgcattaggatttttaactttgaattttcttcatgaatacctttcaaatctaggaaagctcaggtgattgttgacattattcgatgcttcctacaggaatcaaaaaatgaaggtagccgtccttgattctgtcaattagatccctttattctaacagcgttgcctctaacctaaagaatgaactgagtgcacaatgtctctattgctgaggactcgttctgttcaccaaatgaaaccttttttttgtggttttgtagattttcagagactcagaccgatgcttgttcatcgccaggtgcccaggttttccgttcttcttggtgaagttaagtggatctgccgtttggtggctggtaatattgatctgaatctgatacatatcaattatatgctcggtgcttgttgattgccatcaataataccttgtgttcatctggaaaatatcatgtatagtgtatttaagaactctgtatcagagcagttcgaagattgaagatttcggcaggctactgtggcttgcccaaccttgctgtatcactgttttacaacttcctaataggagatgtgtttatgtaactctgattagataccgttttatttggagggattatataacttactactctctccattttaaaatggacgacgttattgacttaagacatgtcttttgatcatgtgttttatttaaaaatttagtgtaactttgcaaaaaaatgtaagtcatgcttaaagctttaaattacttctaatgataaaacaagtcaacaaaataaatgacacgtgcatttgttttgttttaataagacgaatcgtgttatgtcatgtataaaagttatcagcaccatacattttaaaaactaaaacgaagtttttttttgtttggaaagtaacattgtccgtttatattttaattatccgttctcagaggacgttttgttcgttcgtatgacaatcgtattacattgtcagatgttggcacgttgaaacattgctagctgaggtgactgccagttccatttttcttacaaacagaacaaaattgcctaattcctcgaaaaaaaaaaattctacttactggacggtacattaacgtgcccatggtacattaacgtgcgagggcccagaagcgacggtttggcccaatctggccccaagccatgtcttgtgtatccacgtgcactcgagttattatattcatgaaaatgaacaagaaatatcaacaaatcgagttatctgcatggaaatgaacaataatactcctatgtcaacaggtcagcctgctcctcagtaatcagcacatgcttatcctcattttggcacgatcgtcatgttcggtgatgtatttaggatttttatatggctgattcaacttatataatttttttaaataccctaaatataacaaagttagaagtataaattgatcatatgcgttttaaaaaagtttatttacacatatgtatatatatacattggattagaaatgttttgggtgattccgggaccatatcccctagatccacctatgaccatgtccgtgcgacaattcaccgtcgacaaaagaaatatcatattgagttgaatgcacgaggttaccaacgagcgcaagcatcacaagttcgagcaaactgtcaccttagatgtatataggttgcgtaggacccagaagcacaaaatctcgtgagcagatcgatcagcagcagagcagaatggctctcctctccttttggtcacgagaacggatgcgatcttggccatctcttttcccaaaaggaaaaattggcaagattttgctttgcgcctttgcctttatttttcgccgctcacgtctacatcggcgacgagctttccgggagcatattgatactactagcacagataaggaacctgacagctcaagcactagctgctgctgctgaaattatggcaattaaagagagcgtaaagcagcagcagaagttgttaatcacacttggcacttgcaaagaagggtaatcaagggagagtaagagagcgaagggtgtcatctgcatcccgtgacaatagatcagagaagccaggaggtcaggtgaaaatttgataggaaagcagtggccatcaaatattaatgtagttgtggctggattacaagacgatcagctcgaacacaaccaaccaaactgaactgaatgatgctccggttacaccaaccagtatgataagacaagagaaaattctctcaattcctacgaaaattgaaccaaacaaatcttactctcagtacatttctcctgcatttatttacagtaccatcaagttgtattgttttttgtataaaacttatatttaatttacaaaagggagtgaaagaaaagggtatccatatgctatgcttgcatttcggtttcgaagaaaatattcatacgttagaagtcaaaaaaatacggagaaatcttcatctctccctctgtcactgccggcctccggcgcggccgtctctacggccgccgtctcgccggcggcggcggcggtcgacgcagcgaacgcctcgtgcagcaccttctccacgtcgagcgcctcggcggcggcgcccgcgtcgtcgtcgtcgggcgtcgggatgaacggcggccgcgccacgtggaggacgcggtcccagtccacgccgcggaagaaggcgtgccgcttcacgccgtgcgcgccgagccgcctgcccgggtccttctccaggaggagtccgatgaggtcgcgcagcggcgtcggctcgccgggcatgtccggccgcgcggcgaggacgcggtggaacgtctcccgccggctccgcccccggaacggcgtgcgcccgtacagcatctcgtagagcaccacgccgaggccccaccagtcgacggcgtggtcgtgcccgctcccggccacgatctccgcgccacgtagtcctccgtcccc

SEQ ID NO: 40913 - DNA, 3117 bp, Oryza sativa
ataatccgtgtattaatgcctgagcaatagaagaaaaaaaatcaagttagcaacagcaacatgcaacataactgtagcttccgtctagaaaattcctgaactaattcacgtgtggtgtgaaaggcaggttaatcagatttgatcatgtacagtgagctgtcatcaacaccgaacaggaaagccaacacaaaatagactggagtagtagtaaaccgacgaaataacttagaaaagttcacctaattctcgtgaaaaaggggggaaaaatacagagctctaggctcgccattgtagtggcatatcaatctgaatcccctgaaacgcaactcacgtgcaaagtcctagtactttctttctctgtagctcatcacattcacatcgctagattggattggaaccctatatactgttcatgacagattgcgtgtactaccaaaaaaaagatccagtaaaaacatagatatttcagtggtaagtttgagtgtccatggagcacaatcacaagttgatactctgatgtaatgctgcaccgtatctaagcgcatttcacagcctttgcattgcatcggttgcatccagtgcaatttgctgaattgaggtcaatacacaggaaatattctgctgtttacgtcagtaagtgaggtgtgactggtagcaagaatctgcagggctactgatactttagcaagttgtgataaaaccggtggatgaacagaataagaacctgattccagcatgaaagggagattccacacggtacttgctactcttctgatttctgaatggttaattggcgaccgatgctgattctcaaccttttccagttgaagccccagcagtaggcatgataagaatcagcacactgcaaatagattagttcagacaaaaagaacacaggaaaaatttgcttcattgtcaccccggttgctctggaagtgtggattaccttgacagctgggagtgacaggaaatagctgttccccctgctgaatgatttcacatgatagaaatggtgaatttatcgtctctacctgtcaaaaaatactcaaaagactacacagttgatatcagtcaccatagtatttagcacactggcaaccacatatgctctgctgaaaactgaaatgagcagcacactaaatacacaataatagcagaaaccagagcagagtgtacaagtagacatttccgcagatgaacgatctgcagtcaaattgccataacactgaacgttgttgaacaagattacaagcatgagaacttatgaactggacagaaattcagaatttataactcgaacttcactcaaacaaggtaaaattaaaagcggataactggatatatacatctcaagttgttcacaactacatgctcccttttgtggctattagaccacctaactgtgtgcatcactgcatccttgatgacaatactccaattatctgaggcagaagcagtccaatcctcagaaacatgacagtattacagcaaccagatgtgtgcattctgtgaacgatgcaaacacaacagaaccgggtctacacatccctagaaaaacaacagtagaacacttggacatggctcattagctattagatcaagatcacacagttcccgtggccagtgatattaaaaatggaggccaactgattttactcaagattagctgcacacttgagtcactgaaacttatcttatttacagcacaacatgatctcctaattcttcctttgatgttaatattccatccttccaggccgaaacacaaagttccttgccttgcgggagcacagcaaagttgccaatgatacatagaagctagtcattgtgctgatacagaatgcacctagggatacccatccgttctctccatgccagccaccaagccaaccatggcgattgcttcctgccattttcccttctggcatcctagaatgcgcactgcatccttccccgctgcatatcccagggtttccagccaatgctcctggaaacttctgcaacccatcagttgtcggcaaaggcccagataggctattgtaggagagattaagcacctcaagctctgtcatggcagctatctcaggaggtaccacccctgacaactcattatgtgagaagtcaagggtccgtagcttccccatccccccaatacctgaaggaatctgcccatccaaataattacaagagagattcaaatactccagtcccttcattgcaaccaacccgtctggtatctccccacggagctcattcctagacagatctatcccggtagctgcttgaagatcatagcccagctccaattgccggcctgccatatccgtggacactgacacaaacagctgaggtggaagcacagcctctgatggactcccctgaccactgcctccaccattaaggacggcactgacattgaacccaccatccgggatgaaacccacaaacctattgccggacaaatcaatccactgaagtgttgggaacgagaacatccaatccggtagctgaccagagagctggttaccagccagtgataagaacctcaagctctgccatttggccacagctccactgagctcccctgtgatcttgtttcctgacaagttcaccacctccagagatcggcacccggccaacggcagcggaatttcaccagatattcggttgttcgacaaatctaacaccttcaaactgtcaagggcatcaagctccggccgcagtgctcctgaaagatgattccccccaagccgcaggtacagaagctggaagcagccggcaaggccagcaggcactacaccagagagcctattacgcgacaaatcaagcgcctgcaagtaggttaaattcccaatcccagtcggaatctccccggagagctggttatccgcaagaaacaatccctgaaggctccggatggcggtgatcccgacggggatctcgccggagaagcgattgtgggagaggtcgaggaggaggaggcccgaagcgtcggggtcggcgacgacccgcggcgggacggcgcccgtgagcgcgttccgcgagaggtcgagcgcggcgaggctcgccgggaaggagaggcgcggggagagcgggaagcgaagcgcgttggcggag

SEQ ID NO: 40914 - DNA, 14165 bp, Oryza sativa
gaggaggagggaggcgaggtggtggaggggagaggcgttcggcatgggggggagttggctgggctgggctagggtttgggcggcgcggcgccggcgtggagcggaagcagcgcaggtggtgcaggagaggagcagcagcgggggcgtgtgggcggtggtggcttccgtggggtttatttttgggggaaaggtggcgacggcggaggaatttgggggtggggttttacgagccgggggaagcgcgcacacgtgacagcggcacggctggttcgcactcgggcgtgggatgcactgtagtctgtacgtgtaggggggcgccttccggcgaatgtcagatggcacgaaaaactttttaatggtacggactacggagggcatttcactggtacaatcgtgaatccgtcgggccatctataatatgagccactcctcgtggggaaactcagcttacaatggaggataactgtggatgggctactcaaaatctgaagcaactcaatagagacactccaacccatagtgggtatgcagccacaaaaccccatatatatttttactaccctacccctaatctctctctccagacccttcttttctttttttcaccgccgcacgggtctctccctctcgccgctgccgccgctcgcctctctcgttgccggcggctgcgaggacgacgaggagggccgcctctcccatcgccggcatccaccgccatccctctctccctctttcccgtcatcggttaggggcgccagatccggcgccgtagtgggcggatctgggccccccgcggctagatcggggaggatacgatggcgggcatggcgccggcggtgacgggcaaggcgccggcggaggaggccgagcaaggcgcgcagtggccggatctcgtcgctgtcgtccccaagcatgacgaccacaaccacgacgtcgtcctcgtgctgcttggccgtgagcacgggcgcctcaagcccgtcgacggcgccgagctcgacctccgcctcctccctcgctcctcagcccgtcgacggcaccgagcgcgacctccgccgcctactcccgttcctcgccaccgctcctgctgcagcctcctcccgctcctcgccgctactcctgccgggtggttgctgtggcggcgaagggcccgagagaggggaacgggcgagagagagaaagagagagagaggagaggggtggaaggggaatctgtcgctggagacatggtggccacaggagcccgtcgctgcaatgcgtcgctcgcctttgtcccctggccgaaaagtagcgagaggcgcgtcccctagccagggcgcgcacggactcacgaggggatgacgcggatggaaagattgacggatggtgctaggggcacgacctaggggcacccgttgtagatggcctcatactactggatacttcctccgttataggggtgggtagaaaaagaccgagatcgataaatgcggtcatcaatttggtcctaggcagggaaataccaaattttgttcagtcaattgttagtctcctcggttaaatgaatagaccgaattaacaaaaaaaatgtctaaatacaacctacaatccactatgttcaataggattaaactctaattttcacgttcctacttcttctaggcatgcaatctaacaagagtctttactcataagcgcttatgatttttttatttttgtgttgaaaatttccattatttctttgcatatatgaaaatgatattgaatttcggtcaggaccgagaccaagacaaaaagactgagaccgaatttgttggtcctgatatttttgcgttgaaatttggtcttcacttttcaaagaccgaaagaccgagaccgaaattttcggtcagaccgaatacccacccttactccgtggtgttggaattggatcgtgccattgcaaattattaatttgaacaaatattactacaattcgcgatatcagctagataccattgaattttttttgcaaaattgaaactgtatcgtcgttgtcagggttatggataccacatacttaatagtagtcgactaaatctcggcaggacccaccacatatcatatcttatacggaaacaaccttaggatataggaggagttccgcataaggaaggatgaatagagttctacatgaaaacgacaaggactactcggattgtatccatattggtctctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcgtcatcaacagacagccataatcccacgtcgcacctgtttccggcggaagtgggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaaaagaggacttttggacacaaggccttggccagatccgatcccagagcgattgggggctggttgacactttgttacttgttcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccaccccctccacaccaaaatcctaagcagggggaggcgctcgagagggtcgaaaaatccgcagcatcgccagtcgtgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacggagggcgcggcgagcggcggctgttgcacgccattcggctgtcactccctcgtcagcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccactgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcgtccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtctattccgacgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggaggacaggaggaaggaacgccgtgagggcaagtcgccggcaactccctccggtaaacggcgaagtgaggccaaacaaaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgtgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcaccaccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcgtggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgcatttctttgggtagccaaatagggcgtaatgttgaggcttatgtcgatgacttggttgtaaagacgcgcaaccaagagactttactctcagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccttaagtcgtttcatatcgaggctgggagagaaggcgctacccttatttaagctcctcaagcgctcggggccgtttacttggacggaggaagctgaacgtgccctcactcagttgaagacatatctcagctctcccccagttctagtcgccccggggccaaataagcccctactactctacttagcggcgaccccccaagtagttagtgcagcgttggttgcggagcgcgatgaagacaatcctcatttcgcgcacccccgccctgtgctgacttggcccgggagcgagcagggaggagaagcccccgagtcaaacggtggcctaaggcccctgacgaccggagtcggccctctgcccgcttgtcagacggtgctgggtgcccccgaccctcaggaaggccccgaggccactgcgggaaggccgcacctatcgccctttggccccgaggttaaccctgtgctgactcgacccgggagaaagcagggagaagaggcccccgagccgaacggaggcctgaggcccctgacgaccggagtaggccctttgcccgcttgtctgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctatctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctacactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttagtccgtctcgactttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcgcagataagactctacctgaggaccgtgaagggagtgaacgcgtccaacgcatttccaaacgctacgtgctggtagaagggaccctctatcggcgcgcggctaacggaatcctcctgaagtgcattcctcaggaacaaggcgttgagcttcttgccgacatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtacctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacggagctgcctaacccgtggaatatcgaacaccttcgtcgcttctacccctgaggggggggtcgagtgtcaggttttggctcgggccaaccccgtacccccctcgggtgtgcagggttagccggggggctaccacgcatgcacattcttatttctcttatttcagcatttcaataaaagcagtttcaatttcctaaaggttgtgtctgtgccgttttttccttttgaagaatcttgacttgaaataaggtcactcgtactcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacattcccggcctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaattttttcatcatttttgattgcagattaagttggtctatacaaaaaagaggcatgaaggccttaaaaaaaaaaaaaaaaaactggagtctggcgggggcctgggggctcagtccgatgcgcccgggtcgccggcctcgtcgtcacggtcgtctgcaccgctggcgtcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggggtgtgtcattgactggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgacggtgagttcggcagctgcgaggcgggcggctaagtcgctttcgcccgcagccgccccgctgatacgcgccctcgcgtccagctccttttcccgcacctcgaggtcggcagcccgctgctccagtgcggctctctcggcgcggacggattccaaattgcggcgtgcctgctccgccagcgctgcctcacggaggaaaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgtctcccggatagcggcggcggcctcgcggtccgccaagcccctctccacggcgccggcgtgttcctccaatgccatagcacgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctccgagacgtgacggcggtgagccttgcggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggagaatagccgccttggagagaatgcgacgcggctcggcccgccggaggacgcactgggctcggggatgtcccccggacccgattggtcctggacgtcgcctggggaagtgggcccaggcgatccgcccgcagcctcgtcgcgagccgccccggaggctgtcgcctgagcgtcgcccgagggagtaggcccaagcgacgcgccagcagctttgtcgtgagctgcctcggaagacgccatcgcctcagcctgacgagcccgggcggcctcctccttagcagcttcttcggcttggcgagcccgggcgacctcctcccgagcggtatcctctgcatggcgagcccgagcggcctcccgggcggcctcttcagcttcccgaaggcgatctgcggcctctcgccggtcagattctcgcctccgttcctctgcggccgccggatcttcggcctcggattggccggacttgggatggcgggaggaacgtgacgggacatcgctgaagcaaaagaaaaaaccagaagacaaacaagatgggtaagagaaaacttgcttttgggataaaagaaagacggtcgcaaagagagtgggacgaacctgcgagggggtcggttaaatgaccaccttggaggggaaatcaggtttccccaggatggttccgtctcccccatcttgcggagccgcttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcagagggggaggattccttgagggatgagagacgcctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccctgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaaaacggaccgccccgggtagtctggtgccgggcgtccctcgcccagcatcactatctcccggccggtggcagattccggcataaagcggcgcggcagcccggcgtgcctctcgctcacgatgcgagaaggcggaagtacgcttccgtcgagcagagcggaacccgtgccatggcgccggaggaaggatgattgagaacgagcgcgtgtggcgaaggaaaggcgcagcagagaaagagttagagctcaagcagcgaaggcaaggggaatagtggcgaaaggaagggagcaaaccctttcctcggtgtctttatacctttgccatcgctgtgcccggctcctcgtttctcgcgcccactatctcgctccctcgtttcttactatcccgctccctcgtttctcgtgcccacgcttccactaatcccattcgcccgcttgcggcgcatgaggtagatatgcggttgtggcagtcgagatagatcgtatcgtgcgcgcgttaattacgctcgccgaccgaagcaacgttaccatatctccaggcgaagcaaatcggctcacccagattcgtacgtcgctcaagtaatgtggcagtcttgaagagaccgcccattatggacagccaagtcaccattaccgatgtgcatgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgaggggggg

SEQ ID NO: 40915 - DNA, 1573 bp, Oryza sativa
gttacttgttcatacacaaatccaccaaacacaagagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcagtctccctagttctacttggacaaggggacatctatgggtataaatacaagaccccctagaaggagggaggacacggaacaatagatcaaggcacaagatcaacatacaagccaatatacgccaagacacgccgccggatattgacttcagaaataagcatggctagtcccctacggtgtctatggatactgtcaggagagacatagcgctgtctttgatctcgccggatacggattcaaggaggaaggctaccctgttgtcgactacgagtcagcacttcagaccgccaagtcgacaacagttagataggctaccccaaatattgtactggtgtgattatggtgaataaaagcaacgaccggcttcggccaataggagtagggttattactctgacaatttaggggcccgaacctgtataaaaatcctcgtctccatcttttttactacaatctcgtatatattctagtatcaacgatccccatactatgtaaataccggaatcgcgacatcaaacatccacagtcgtcgtcagatttttcatgttcttcccatcagggggtcatccacgagaaaggcaaccagctagctccggtgaagaaccctccctccctcccccttcgcatcgacaaaaaggaggcagctagcgagcatcctcccctatccgagatcattgccggagccagaaaggccatatccctggtgcttcctccctcccccatcaccatacccttggcatggagctcggctcgctggatccaccggcctatgattcatgctatcctggaccttgccggtcccaccgcctccgaataaggtaggaacccgttcccggactgcattgcctcggcccgcttgaggatcagacgatgaccatgctcgatgtgtggtgccgcagtccaccatgatccgaacatcgacaccgctaatgtgtcccagagctcgctaatgaggagaataagggaaaaaaagaaggaataagatgaaaaatttgatgacgattgcatggttttaattttgcaaaaatttaaatggcacctaaccgatatcgtgaacagtagtgtcatttttttcaaattggtaaatttggaatggcatgatccaattaacaattttttaatatatgacttttgtacatacatttgattatccatctttttttatttgatttgttattaatattttttttaatcataacatatactttttatgtttgcagaaaaattttgaataagacaaatgatacaaacatttatcaaaatgtccacgacatcatatattgaaaactagaggtattatattataatattagcgtataaattgtgaaataaacgacatgtgtattcagtttttaacgc

SEQ ID NO: 40916 - DNA, 33675 bp, Oryza sativa
  unsure (1)..(33675): unsure at all n locations
gggtctgttctgttttccatgtcctttaagtaaggggaaaatgaacatttgagagcacaagatgacaagaactgttgcgttcgaaaagtatgttttttctctactaatcggttggattatggatacgatgatttacttctaggacgagggagcctcgtccaaaataggctaggagggcagatatagatcataaaagggcattagggttgaaatgcacttgatagtgcagtgactaagaacgtgtgattttaaccctaaggccctttacttaaattcctagcatgctcacaatttaccgaagataccaccggtatatcattccaatggaatagctgatgtcatgattatgttagcataatatctaggtacaccagatcctatacctatcggatcatgctaacgtcggtatagtacctggtaccatatctgatgcatatagagtatcgtgctaacgacagctattccgttgtaatggtatgctgttatatagtctacctctttttattttgtcacttaagtttaaggcttgattagaattttagacagggcctccaaatttcagaggacggcccagtacgaggcaatactggactcctagcctcctggctagtgatgtgggcttaaaagagctgatcccagatgggcccttttattttaagcccacgacagcctttgatctcgtgtgttcttttccccacgttagtgaatcaatcaaccttgccaagtgccaactaacctactcctatagttgattccgtgaaatccctgccagtggtatagtcgtacatggtcctgttataattaatgccacttttcacgatcctcagttccttattatagtgcttatctatatgcatgtgcagaatagaatcatagattagccaatttgcagtacctttttttccctttgagagtaccaacttgtagttatacaccaatatacttaaccacacagcgaacagtaacacctccaaatctcaattaacaaaacagaggaaaagatcgaagtgtagtaatctccagacatgagtgaggtagtacaagcaacgtactaccagtctaccaccaccagtaacagcaagcctcgcagccaatcgatgaccggtaaaccgcatcaggttcgcgtggtagtacaagtgcagaatcgtgtgtggaggtactacgcgccccccgcgcgcgcgacggcgcgagcgacgcggatttctttaagtttttccgcacggtgttacatgggtttgcgtctccgctaatcgagcgcctcgcgcgcacacgcgcgacggttggttggttggttcggtttgtttaagattttggttgatttcatcgagcgatcccgcgagcgtagacgtgactgcgcagccgccgcgcgggggtttttttatgcagttgagtgaatgcgcgcgtggtcctctttctctctctcggctccgagtctcgtgacccccgctgctggagtcgtcggccgtcgtcgtcgacgctgattcggtgattctcgtcccaccaaccgggtttttctatagggtgggtttacactttacagattaggtcgctttccacgtcggccgtggccggtcgccggcgtgacagccttagcttacggcggcgacggcagcggcagcggtgttgtgtagcgcctgccttcgtacaaggatggtagggtatcaacaatgcagtcaaacttttttcttgtaaactaaaccggtaaaaaaatttgttaattatatttttgataagtaggagaaaaacgtatatggttatatggtagttttagaagtgacatggtaataacacatagccgttatatgtagaccgaggtcacacattttctccatagcgctagtggcttcaattgttatctttgtttttctatgtcagtttatgatattttctattacaatcatgttttacttaatttacaaataagttcaaagtattgcactaaacaccaccaaatctagaaattacaaaaaaatccccttgcactctctctccctcaatgtctctccctctacgccaataagctcgatccccacgggtgtggataaagagctctccagctgacactgcctctcctctatttttcagcatatatcaaaggcatctctctttttgaccgacgagatctttagctaagtcatcgttttctttctccaaagcaaaacaaaggcggatccactttgccaaaggatccactgggtgatctcaagactagggccaatgaggtcattgacagctagattcatagatcaggcgatgggtagcaggttgggagtggcccataaacaaggagagatggtagagcaagctgatgagctctacaatgatgggattgttgtggctgagggatgagatgagcatgggactaaatctacatcgacaaagcatcatacaaataggcctctcgatcttcttctcctccactgcgcttgttttcacttcctaaccccatcattagcctctcttttttttggtcgagctagcgaacactagccgaaatttattaagaaagtgcaagaaatttacatgctacaaccaacggcaagtcggtctccttctttcattggccatcacccgttggagctccgcgctcggagaggaggtggactgcaccgcattgctagagcatggcctcgccgaccatggcttgcgaaccatgcctccacgctcgagtacccttgccctgacgaggcgtgtgtcttttgtagggcacgactaaggctaaggtttaaggcccccatcctttggccaaatacatataatacgccattcggcgtattagcaaaataataataatttacagataagactttcatatatgtgtttttagcgacttaaataccaatgctggaaaataaacttcgatgaaaaactttaaaatttcaaattttggtagcggctaatgctgattgaaggaaacgatggggacctaagagcatctccagcaatagaccttattttgaagcgtctaaaagttaaatgagggctgcccccatttctcaaggactaaaaaatgcctccaactccagcagtagcccctatttcttagtccctactcatgtttatcttgtattttaaaatacaatccatatacagtatgtttaacaccacaaaaattcgaacacaattatttctaactcacataatttaaccatacttaaattcacaatttcaaacactacaattcgaatacaaaattaaaatttttaaacatgtaaatatggtatgggtacagtgccatatacgacaacaagatgcaaccaagattcgtaattcaccaatgaaaatgaaaattgctcataaaaaatacactatgtgaacccaatgatgcattatataatttaaaaataatacatcctacaaccatgaatgattcgattataaataacaaatctgaaagtaatatatgtcctactagcaagtgacactaaaattattgtggaaataattaacaaaaaaggactccaaagaccaatcgtgataatggcatatcctactagtaaaggacacatggatcatccaatagaatccaacttattccatcgaagtgctcaaacttctccattaccgccaccaaactcacctccaaagccactactaccatcaaatccaccattgagggcagccacctttgaagctgcaatctgtgccctcatagccaacacatacgttctcacatccggttccaaggtggaaacatcacaaaacataatcttctgttcttgatcccacactaacttacgctcagcaaataagagcttgcgctcttgaatctccttagtttccttccatctctcttctttcaatttcgcttctttctctttagcgtcaagcaaatctttcatcgcctctttgtatggtccatcttgtcctccattcttcaacttttcctttgcttgcttcctacctattggtctctttttagcactcggctgagataaatcaggagctgtactcttgctagcatcatctccttcatcttcttcaccagctctctcaattggggtcgaagacttcctagaccgtggcctcttgtgggattctagtgtttgaaactttggagaattcctcaacttgagccaacaatgattaaactgaaatgccctattctttggtgcagtggacgagtataatgcctcagcttcaagaacctgcaacataatttaagttttaattcacatacatacaagattgttattaataataataaataaacaatttaacttacaagctcttgatgtggtatgccacttggatgacgacgctcaatttgattgtagcaaccttgaaacttgcttacttccttctgaatgttaccccaatggtgctcaagagagtttgcattcctatcagactcaaaatcacggttagcatggtagtgctctgcgatcctctgccaatatgccttccctggttgctcattgccaataataggatctgagctaatgctctgccatgaaatgcacaattgaatgtcctccttatgagtatagttgcttgatcttttggcacttccttttgcaccatttgttgaagtacgaaggtcttcatttggcattagcacttcgacatcagtgtcctcggacatcatgcgcacaaaggaatcacctccacttgtcattgcaatctagtcactgcaataaatatataaattgacaacctttccaatctatctcagaaacatcaacaagtgattgcaatgtacatcaggttatactgtttgcaatatgtatttatttagcatatatattggttgcgcagtactaaggactcagtgcaaacacaaatttatttcttaaatattatatatgctctgcaagattagctctctgacatagaacaagacactgcatataaaacatgaatgatgacaatgtacgttttgctgtgcgaatgatttagatgggcctagacgcctagtaagcccataaagatcaaaatcaaacaaggagactcagacatacgaaactgaactttactattgtgatttgttttaatcaccatcatctctgaatttttttactgcagcatgtgtgcggccggtgatagatagctgtcgatggtcggcgctaggccttgtggacagcgggtgggcagctagttcggggaggacgtcgagactcacctgggcatgatcaatcggtgacgacgtgcgttggccgaagatgcaaggaggtcggcgacagtgagtgacggagtaaaaccgatgattgtgatggcttgaggcggcacaccatgggatctcgccgaagtttcttcccgagggatgtcgggtggtcgccgaccggagcaaaacgacctggcggcttgctcgctgggaggttgtgggaggatggcgatgacgcgggagggaggatgacgatggcgcgcgctcagaaatttcccccgccaaaaaaaaagaggatgggggctgtggggttgagccccccggactgggggcttggaggagtgatctaggggcctccctagattgggggctctagtagggaatctgctggacctatatttttttgcatcaactctcaaaacttatttagggactttgtttgaggaccctgttggagatgctctaagtaattaagaattttctttggttttattaaaattaagctggttactatagttggtgttaaaactttttattggacagcgacgtacgtcgtgaggggattaaagaatcgggcaagttggccgaaagccaacgtggttcgtgtgggcgctaccgcggtagcgagcgagaggtgcatgcacctgtcagaaaacggatgcaccacccagggaacggacatcttgttttttcttttttctttccggaatccggcggagaggaacgcctgtgcaatccatgaaaaccgcggctggctttgggggggctttagctacggaacaaaattttcgagatgttgcgcctacgcctcccgtacaggctacagccctgctgcagtgctgcgtcgtgacctgacgtgtctgtctagctgtctcgtggtactagtacgaaatttactgacacaacgcactagtgcatttcccagctgttgaatttcacctaccattggagtgaccctgtttaaatggtagttaaaagtcttttaagtccctattacatcagatgtttgaaaattaattataaatattaaacgtagactattaataaaactcattcataatcttagactaattcacgagacaaatcttttgagcctaattaatccataattagcctatatgatgctacaataaacattctctaattatagattaattaggcttaaaaaatttgtctcgcaaattagctttcatttatataattagttttgtaagtagtctatatttaatattctaaattagtgtctaaatacaaagactaaagttaagtctctgtatccaaacaccacctaattcgtactctaatattctcaaatgtactgctactactactacaatactgcatggatccaaatactcttataaacagttaacagatcgatattgtaaactacgagtaaaaagtattccctccgtactcgttttggacagcgacacggtctccaaaacataattttgacttcttgtttctataaaaatatatattaaaaagtgatatatgtatacttttatgaaaatatttttcaagaaaaatctattcatataatttttacattttcaaactcaacaacttgagagttattcatgatttatattcccaatgtttgacttaaatattgtcctaaacgacttccattatgagtacagaggaagtacaatttacccccgaactattatggtacggtagtacaatttaccctctaaactataataacatatattgtattcaatacctcaaaactcttaaaaccagacgaataccggggcactattttggacggttttaggctaggttagctgacttggcatttctaacgcggcaaaaaataacaggcccacttgtcagtgatccatatattctcacctcatctcttctacctccttccacctcgatctctctctcatccttgaaccgagcagtgaggagaaggccgcggtggcagcaaagactactccccgggttgcttgaggtggagcgtggtcggctagagaagcccagggcggtgacggtgcgcgacgatggccatgatgctaaaccgctcgttctcacggggggagcactgcgccgcctggagcacctcccgcgcgccgcggtaccgccctgtggccaccgaccgcgctcgtactctagcgccagcactgagccgttgccaccgctagagctgccgatcggattctattccagggcaacgacctcgacgttgggcccttgtcaccatcacatttgtcatcgcaagcctcaccgtcagtgccaccatctttctcgtgccgcgcagcacggtgacaacgacgatgtgtccctgttgccgtcgccgtcgcagagcgccgacttgcagagctccaacttgacatagtatccacccaggtcactgcacaggcgcacacgcagtccatgccgctatccctccttctcccgcctgcatgccagccccaagaacacggtgacgaaaatgaggccaacgtgcgtggccgactactgctaggctgaggccgacctgcggtcagagaggcgaggccgagaacgagcggccaatgctgtcgtcgccgttgaaggcaaagggcgcggccgacgcgctcgcgcgtagcctccacctcctggggtccatacttgtcgacgcccgcctcttgcgtagctccatctctccggcaacaccgccgtcgtgcccgacgcggacgcaccaccaacaccaacaccgcaccactccgccgttggccgcacgagcgtgcgcacgaggaagagagagtagggtgaccggggaggcgttagattgagggagaagtatgacaagtgggcccacggagtttttttaaaacttttttgctgactggactgacacgttggcatctcgtaggtaagctcaagtcaaaaccgctaagaacaatatttaggtggttattagtctagtataaataattgagagtgcaaaatgtctacgtgagccttcacgtatacacacaatgtatacaaactaacaaatattatttttttagaaaaatgtacatgtactttaaatagtatttatatatacgcgtgaagtcccatctttaaatttatcatatatatatatggagaaaaaaatctaagacttatattcataaagctattagaattttttttaagtatgaaatataatgaatttgaggataaaactttacgcatacgtataatagtattgaaagtatatgtataatatttttaaaacgttttagcgatatttagtatagttggtatgtacagtacggagtatggacatgaagtttggtcctgttcgagaacccaacaaagggcagattaagttctagattttcgtggcacgcttttcaaactgttaaacggtgcgtttcgtgtgaaaattttctatatgaaagttgttataaaatatcagattaatcttttttttaagtttgtaataattaaaatctaattaatcaaaagttattaccacctcgttttacgtaaaacatttgatcttcatatttatcttcagaagattcaaacagaacctttgtgtgcccaagatatgaacctcttaattaacaaatagatatagttgtatagctatagctgttgggcgcacagctttttcatccgtgaatggattacattgtagaagtaaaacttatttcgaaaactatactgtataagtattcgacactggctttaattagctgaaaggaaactttcatatgcccttttatggaccaacatgtcgcacggaccacatttggtataaatccactgaacacgtttgatcttttcccgcctacttagctggagccttatccattaatttcaaacagttagtaagtcctcaaatggactttgagagtcacgtgacaacaactagggttttttttttttggggggtgtccactcgatctttcatgcatattcacacctttcgccttttcttttgaaagatcacggttaatttagtgctatattaaagaaaagatgaatagtttaaaaagagagcaaattaatttaaaaaagatacgaatattagtgaagtacctaatatcaaataattagaagggataaggaccaaggtcatctaacccagccggaagacctctgggtgtttctctaaaaaagagcaaattaatattcagttgatttagaacaatcgggctaaaaccgccatacaacaataaatacactaactagcttttttttaataatggaatagataacatctcggcctttgctcaacagagctacagccaattattacaatctagcacttaacaaagagtgtagttcaaatagaattaaacacacacctaaacataaaaaaaatgaccagaccaatataaggagcacacaattatttaagtctatttgtgaatctccatccatagttggcaaaaagttgcataaccgtcgtctcaagcttacgacatataactttcaaaagctctccatcttcatcacacttttacggttgtgcccaaaaccggagccaatatgttgctctgaagaatgcctgcataaatgaaatagatagtgatttgtcaaaaatcatatcattcctactcaatcacagagcctaacatatagtacaagcttctacaagaattagtttgctccttttcttgttcacccccaaagccaaccatcaaacatacaatgtatgaaagtaggaaggtataaaccaaaagagtactgaaacgctccccaaacaaattttgcaaaatgacaatctataaaaagatattgaatagtctcatttttcatacataaacaacatcttaagctgccattccaattccgttttgccaaattgtctttgttaacataacccctttaagcaagtaccacataaaaatcttaattttaagcggcatcttaagtttctaaataatcttatttctctcaatgtaaccattattaattaaggcttaaggctagatacattgaccttacagaaaataaaccattttgatgataattccatctaaaatagtcagtagattgattcaactgaatatgtacaatagaagcacgcaattcatgccaatatacaagattctgaccaactaaaactcttctaaaagaaacattaagcggaacagatcccatggcattagcaatagataaatttttccttcgaactatataatataaagatggatatttatctttaaaagccatgttttctagccatgtatcctcccaaaacttcatttgttcctcattattcacaataaaaaaactcatattttaaaaaatatttttaactttcataagacctgacaaaaaataggaatcaccctaactagctagcaaagcataaccacgacaacaaaactaacagccttaaaacaaaacgcagttcactgtacattggtaaaaactcgccgtcattcgtcatcacaccaccgcacacatgatcaggcgactccaattttgataagaattaagaaccaaggaacacaactttacctgaccaaaaccgaagtccgtttgactaatgctttcgatgccacatatcatggctccgacttcacaaccaccgtgcgaccgaatcatttcatcattatcatatcttatcgaatgaattactaataatctatcgaatgaattactgcggcacaagctaagactatctctatcctattttttgttgtcttcctcttatgatattactccactgcttttggaccacactagtggagctaggtttagatgtactaggttttcaagtttgctttacttagaagatagctgaaacatgatttcaaatagacaaaatagaccaaagtggaattggatagagaaaagattataattgatgtatgagttaactaagcgtcaccacaaaaacatggtttccagtgttattgatggttcggtttttccttgtcatatctagtgagcaaaacatatggtttagtgcattgacccattcacacccaattgattattcatttcattcctaaattttgacctaattccatttacacataccgtgagtttattttttattttttgcggggaacaccgtgagtttataatacaactcgtaaagagacaaatcattgtgataaaattatactactgttagacatacacatgactcccctgcaatagagtttacggatgtgccgaggttaaaaaaccgctccctaacggcaaggtcgctaacagcaataacggttgaaaacaagtgaaattcaaacattttttccgcaaaataaaatttagcttggatttgtttgaacttaaaccagttatatcgaacaatttcaaatgaccatgtcgatctatccaatgactgtgataatcagtctgttagcgtcgtagaaaaagtctagatgagaaaagtatcgagaggatgggcgaacataggtcagctcgaccaccaaattgacccaaccaacttgcatgatcgatctttgccgttaactacgtacctcccctcctacgagtgcacaacaccacaaaccagcttgtttcctccatatcacaaaaggtaaatataaaagactgaggaagtataaacatttgccgccaccaccattgattatcgagttcatcctctagtccccgcagtccgcagcagaggaaagaaagcatccaaaaatctaagccacaccaaaaaaatccttttttttttcttcttccttccctttcctcgatcagcatcatatatccaacacaaaaatctagcaccaaagatgcagcgaaaagccgagagagatgcctgccggttccggggcggggcgcgcgacgccacctacggcttgctactgctgctgctgcgcagtgcagaagcccactccactccgcgcgagacatccacttgcccgggcccggccggtccgctggtccccacggcgccacacgccccgagaaccaatcacggggcctcgcttccctttaaaatcccaccaccctctcctcccacttgcgcctagccccaccacctccaccacctcacctcccccttcccttcccttcccctcttctctcctctactagctatagtataggccgcccccgtcgttttgttaattttcacgccgaaatttccacccacaccacgcgccgcctgcctacctgcgcctgcgcgagctgcagatcgatcgacgagaggccgcgtctcggtcgcggggggtggagttgatcgatcgatccaaggaggggtatgatgaggaggtttctgccggtggggggaggaggaggaggaggggtggagccgtcgtcgtcgtcgacgacgccgcagccaagggaggcggaggcggcggggctgcggttcggtgggggggacatctcgctgggcccgcacggcggcggcggcggcggcggcggagggggcggagggcatgggcatcagctgcaggacgggagcgtggacttgctggcgcggcacagcagctcgccggccggattcttctccaacctcatggccagcaacggtaagatcgatcgatcgattgcgctagccaacccattgttcgattttatttgttcatccgtgttcaatttggcgtcgcgtgcgtgcatagctagcccatcgtgtataggcgtatagctaattggttaggactactcagagtcacggatcttcaatttctagcttaattctgtcaggagagaacggctagctgtgcaaatgtcaacctcgtctttgccttcacatgccccatctctttctcgtcacacacgcacacgatcgaagtatcgatcgatcacatgaattgctgttctaggcttctagcaacaaccaccaaaaaaaacgaattccatcgatattattgttaatggtgttctttctctctcagtgtttcctccacactgtttcagattcttcccatacttatccgaaaccaaacgggtttgatcaatcgatcgatctctgtctacctggttcttaacttctatgcaactcccatcactactaactgccaaagccactagctcgctcggcgacgacgaaatgctgatgagctcgcgctatctagctaagctcgatcccttttgcaagttgcttctgcggcgcgcgcgtgaatcgatcatcgcgtgcgacttttcaccggtcctaactggttttttttttgggttaaaaagtggttttcgctaaggccgtcatgggaggagctagtgtgtatatcagactactatcagtatgcgttgtggatatccatggatgtgttagtctgcggctttttgctacgtgagttgccataaatagtatcatggagatcctctgtgcccatttttctactcagagccattagccataggctcctatatgtggttagtaacttttgtgtgataataatgcatgtttgccacagttagggtcaatatatatatatatatatatatatatatatatatatatatatatatatatatatatatatataagctgttaattaaggatccaccatgagatgttatatccatgagattatgcggcttaattgttttcgtgataatgtaatatgagttcaagtttttaaggcatatgttattacgaggagtgcacaaatttggctcggcgtgtaagaaggacgatggaaaactatgggctacacaggaggcgggttttctcaagtagggtatcatcgatagtgaaatgtggggtctagggttttgaatacaccgcttttattctttttacgtacgctttttataatcgagtgtctctagattgtcttattttctattgcaacttgctataaatggcttagtttttttgccacttgcacctggtgtccctctctctcatttgatccattattttcagttgcaaagtcattgcgcatgacaatccattcttcactacaatagtagacatggggaaaaaaaacaatttgaagctatagtggagagagcaaagagatagatgtttttttttctaatttaatttgttcataataagactagaaaaccatgcattcatcttccaggatttgcacaaatatgtacatttgattaattagtatcaccattcaccaacctagctagctaaaacaagctctttttaaaaatgtttttggcaagtattctcatttcatataaaggatacctatatgcacctcatttgatgaaaatcattgcaaaattatgcaccatcattatttattccatgagtattaaattaattctgcgtcacaaatattcaacgttttagagcatacagagataataaccctttaatgaaaacttcaaaatatcatttattcaaaaattaggaataagtgtgtcaatatctttttgaaatgcagatcaatatgaacatagagttatgttataattaattttcacactacatatataccaacatctaaaatggccttttgaccgagcaacctgtatacaacaattggtaaggataaaaatagtaccagtagaaatgtcgaaatccacatataagtactacaccagtactaaatttagtaattatactttgatcgaggtaggaatagcctcgagtaaagtttaaaagagtcaaatgtctttcagtggagcccatgtagcagcatttctttcaatgcggcagccagttgcactctagattctgctctagatagaccaacttgcgcatatatgatcaattaattagtatcaagacagcaagcacaattaaattaccagtggatcttagtgcctcgaaccctagccaaggcaaaaagaaaaagatgagggcatttgattaatttgtggattaattaatttttgatcaatggattaattagggcgccacttgccttaatgtaaggcggggaccacgtgtgtgtcgccgcaacttggcctgcggggtgggccccccggtttgtccaggttcagctcctctgctgatggcctgacggtgacgtcacggtcttgcctcgctaaagatagtgacctacggtgcgttgagatggcatgcgtgattgctcggcttcttgatttggcgtttgctttctctcttggctgcgtctatgtcagcgtgcgaggcttgctcatatgcacgggccggcacgcggcatgcacgtgctagcgtgtccggtaggcttcaatataccatctgttcgcatcgtagtacaaaaaaaccgaagaaaccatccgattcaatgaagaaaattatccatattcttaggttgttgtattttgaaatggagagagtacttgttcttattaatttgaggagaataagatcgatcccctggaagtagtcgtaggtacgttcaaaataaatataaaataaatatagtgtaatgtgtgcatgtcagttcactggtcagaaaataattttcgcgtcattcgcagcaatttgactagaaatttacattgtggaataaaaaaatcgtggggccaaaatttcaatgtttttaatgaaaattttaggctagatcttgggattttcttttttaacacagtacagacacaaacatgcatatatacacatgcatactcaacgctctgaacatacacgcacaccctatcactatataagcacctttaaagaggaccgtcatgaagtcgtcacagacactgtcaacatattttaaaagttgataaccaaccattttgctaagggcctgtttagtttgcgaaaagaaacattttgggtgtcatatcggatgtttgaccggatgtcggaagggtttttcagatacgaatgaaaaaaataatttcataacttgcatggaaactgcgagacgaatcttttaagcctaattaatccgtcattagcacatgtgggttactgtagcacttatggctaatcatggattaattaggctcaaaagattcgtctcgcgatttcctccctaactgtgcaattagatttttcatttatttatagagagaatcccttatataccaccgaaagttggtctaatcccttatatgccattgacaattagttcttcccttatatgccattgatccaaatttgcacactctctcacgccactcccgtcagttgacatgtgttgaccgttaattcttaaggaaaaaagacgtatttacccttctgagtatagggcatgcctaacaactcagagagggcaatatgtcttttttacttgagagttaacggtcaacacacggtcaactgacggtagtgacatgagagggtacgcaaatttagaccaatggcatataagggaggagccaatttttagtggcatataagggatcagatcaatttttagtggcatatgagggattatctcttatctatatttaatgcttcatgcatgtgttcacaaattcgatgtgatgttttttgaaaaaaaatttagggaactaaacggggcctaagttaaaaaattcaaatactttttgggcttctattgggacccaatagtaatccaaaatttgaaacctttgatttgaatagcgatgtaactattgggcatacaaggtttgaaaaaatggttacggccggattgctaactttgatattattttcatccaaaacgaccaatactgaattggagggagtagaaattaagttgcaacacgtaagtacatgtttgacgatgtgcttataagtaactagtaatagctagtaaagatgaacgcaaatgcaaacactaattttaattgtttttgtctctttcatatatataatattcgtctcactaacgatctactactctttctaattaaggtggtcgtttgaactcatctttctgtaagtttcatattcttaatacttgtgaccactcaaaatagaccttacattttaaaatggatggagtacaactttctggaacatatggttctagtcacgagaatattcctctcatatactccctccgtttctaaatattcgatgccgttgacttttttaaacatgtttgaccgttcgtcttattcaaaaattttaaataagtattatttttttcctatcatttgattcattgttaaatatacttttatgtatacatatagttttatatatttcacaaaaatttttgaataagatgaatggtcaaacatgtgctaaaaagttaacggtgtaaaatatttagaaacggaggaagtatatcctgtatctatcgtgctattttgtgctggggcaactcggccgggccacttttaatttcgtagtgctagcttgtaattttttttaattagttagtagtgcatagtgttgatgaatggtaattgttgtggtttaagttatgtttaactataataaccggtgattagtcaagtttaatttgtacatggatttcaaatagaaatttggtagtgtttaattatgaaaatatttatagaaccactatgcatatataacattacacctgcagttaaacacacatttgaacatgagaatcaaacctaaccttaattacgtgcacctactacagaaaaatattgtagaatcaaatacacactactccattcaaccttggagaagcaagtttgaacatcccatcacatctaggttaaacttattgctcaacacgtgtacctatagagctagctctaacggtatgctaataccgtaaactattgtttacttgtcacacttggcagttttcaactagcgtttgggtaacagtagctctttctctcacacacacagttaatttaactaattagcgatcattagttaatttccgtgcttgctacttggcaataaactaagcaggctttccaggctcaaaaggcgggggaggcagcggagccgaagcccaccaccacccttccatggccggcagcggcagcggcagcagcagcggcgggaggaagatgaagtcccagctgagcttcacggccgggccgccgcacctctcgcacatcgcggaggacggcgccttccccgaccgcgccggcgccgaggcctccgtgccccgcaccttctccgccggcggcagcagcggcggcggcgggttctccatcgtcgggccgtgggaggagtccagggacatcatctccaccctcggcgggtacgagtcccaggtaaagattgctcggcaaatttgattgctagggctaccttcattgaatcattgtacactacaaggcttcttgatctcttcatcccttgtttatatttactaacattcataagaatttggacacatgtatgaaacacatacatttatacatgtatgaatctattcaaaactcaaaacaacttataataattaatgtaaaacagaggaagaagtagtagctagctttgctgtgtttgtgatatatatatatatatatatatatatatatatatatatatatatatatatatcgcgatgtgttctgatttcttgggcgtgttggaaatgggggcagttcggcggcatggcgagcacgtcggcgctggagatggccggcatggacaggtacctgcagctgcagcatgaccaggtgccgttcaaagtgcgggccaagcgcggctgcgcgacgcaccccaggagcatcgcggagagggtacgtacgcaatatcatgatcaaaacgcctctatatttgcttttgctttctcttcagatcttgacacatgagcatgtacgtcggtgtgatcgatgcgcgtccgtaggaacggaggacgagaattagcgagaagctcaggaagctgcaggagctggtgcccaacatggacaaggtggccattacgatttgaactttgcataatgttcatacctatatttacatgatatttgaggaagaaaggaacatccctagctaagtattttcttttaaaaaaaaactttccacatttcttgtgccattagcacacagattcatgtttctcgccttaataatagacatggcaaatgcacacgcattcacccatgagtgtgcactgtgaagtgtcccttaacacatgctcaacaaattcatggacaccaagcgcaaaatcataacctaatagaatttctagaaaaagcgtatccatgtttgtgtagttaaattctataggcactgagattagagctttggtgcatgacagccacaactccaacaccataccaaacatgctttctcaacaaattcatgattattgtatatagatgaaaggggtcgtacgttctctcatctagttctagctaatattaattagcggtaacattttttgcgcatgaataatgcaaccaattgagtaattaattatgttcgtgttgcaacagcaaacaagcacagcggacatgttggaccttgcagttgagcacatcaagggtctgcagagccagctgcaggtacgcatatttgaggatttcttcacaaggactaatcccgcaagtaggggataagattgaaaattcacatttacattttttttcgtgaatgcgcaaaaggcgcgcccatcaatatattaaaaggaaaagaggttttgttacataacgcaaccagctagacgagcctatgcgaaggaaaggaagaaacgaaaaaaaaccgacattgtctatcattcccttttgttctaatcaatttgtcttatttaaatcttttccctctcaagtgatgtatgggctggtaattaatacacctctcaaggctgagagataacatattttctatttagatttgttagcgaaatagccgtgctttgctacaaataactacaaattatatgcatgctagtattgtttggaacaaattaactacgaggtgtgttagaagatatattcatccctggggatctctttacactataaactttgtattttagagatgaaataagatagaagaaatatatatataagaactagtttgtaatgctgaagcatattgatcggataagtagttgataaaagtatatagctagcatattcactggtactatcattaattgtcttcgtctacaaaagtatagatcacatttgccattataatggttatatacttggttagaactcgtacgtgttgccttttttggttgttcatattttcattttttagccgaggctccaaaacagaagcgatataaacttttgaattttgtgtcgtctttctgcgtgcaggctctgaagcatgagcaggagaagtgcacttgctgcagcaggcctnnnnnnnnnnnnnnnnnnnnnnnnnnnnntgaaaggtatctatccttagtttggaaccctgattacggatgatactttcatatttccttgagagtaacgcatgcgtggatgcatgaaccaattaatgtcagtgacacaatccaaatcgaccgtgagcattttgtcgaaatgtgtaaattgttagataggacatggcaagggacatgtatatgcatgcctgcatgcatgagtgagtgcatggagctagctactccgaaatagcggggtgcagccattgtgatcccttaattaattctcgatccactgatgattaattagcttgtaattctgtctttaaaccttttttttaatgacgaggggagagaaaaagaaaatgaaattttggtcagcatgcagaaagaactacattattaattcgtgccatttggggtgctgtttatagctaaccttctcgatcgatcacctttgtgtgtctcaagttgcaaccatactggtttaatttgtgctttcaatgtaggaggactaatgcagtgtacgtgttacgttgatgcaataaaaatcaccctttttaagttattgcagcaattgcgtatgcatcactactaagaaacgacttttggggcgttattttcgcaggcctttaagtacatagagtatttgaccgcctacaaaaatgtgttttgacggttttttttaagtagtgcatgatcatctcgtcgattcacctgtatcactgtatgtatggttaatttgggtttcggagttggactatgtctcagcttaaatcgtttccaatcgaattccacaccgcgcgcgcgccatgccacaacaactgctgcgtcgcacccacttgcacttgcaccgagcgccatggcgagtaggccggttcatccaatcctcgtcgcgttcttggcgctgctcctcgtcggcacttgccaggcaaggccggctccggggaaggccgcgtcgtcgtcgttgtcatcggcggcgaagggggcggtggtggacggcatcacggacatctacaacttcggggactccatctcggacaccggcaacttcctcgccttgatggagcacaccgtggcgcctccctacgtacggcgcggccatcggcagcgccacggggcagtgctccgacgacgggtacctcatgatcgactacctcgccaacgacctagggctgccgctgctcaacccgtacatcgacaaaggcgccgacttctcctacggtgtcaactttcgccgtcaccggcgccaccgccctcgacgcggcggccctcgcgaggatcggtgttaccgcgccgcgcaccaacaactcccccactggagctggacgctcagagagagctgttggtgtgcgaacggaattactggcgctgacggtggaaggatgagagtgtcacggaacgaagaaaatatcgcgtccaaatgccatattatgaaagtagtgcgaattgagtggtctatcctgaaaacggtgcatattcggtggcatattctgaaaattctcgagcaagagaagctggcgcgagcttgctggtgatggtgggagagatcgccgcgaacaggccgcgaacaggaggtcgtagcgccgcgcggacgtcgggcgcatgatgaccggcgtggtggagtcggtggtgctcgtaccagaggtggtgcggtcgcgtggtgagcgcggcgagggaggtgctcgagatgagcgcgacgcgggtggtgatcccgggcaacttcccgctgggttgcgcgccgagctacctggcggcggtggacgagacggagcgcgcggcgtacgacgggaacgggtgcctcgtgggtctcaacctgttcgcgcagatgcacaacgtgctgctgcagcaggggatccgggagctgaggcggtcataaccggaggccacgatcgcgtacgccgactactccggcgcgtacgtgcggatgctggagggcgcgcgcgacacggggttcgacggcgtggcgctgaccaaggcgtgctgcggcgggaagtacaacttcgagatggagcagatcagctgggatggcgtggcgtccacctgactcagcgcgcgtacagcgtcatggccgagcttctctaccacaagggcttcgcgtctcctgcacccgtcaagttcccgcaccagtagatcgtctggtatttgcaagtagtgaaaataatgtaagctgtgacattttttgacgaagatgtaacccatgatttagtcatatcatgtattccttttttttttcaattggtacaaaaaatagcagtatcaattctttttcactgatttcaggacgcttctaatttggatttgccgatgcttcacgagggtgttacaaagttgcagccacccctattcctactttatttctaaactgatgtacagaacgtgtatttatgtactccgtggatacaatacaatgtgcctcagctacaacattgtttatggaggagtacatatatgaactacatgctacggcctactcctcaacaggaggatccacccaacggccatggtccttgattaactgaatcaaggcgtcagtggccccctccattgcaatgccccgttgcacgacggtctgcacccaaaacaagtagaacttgtgttaatggaaggaaaatggcagctctaagtttttgtttcagctcaaagagcatatatatgccatgcagttaacatccctactgttgattgtgtttgcatgatcatgtacaaatattgacttgcagctatgttcaacgatataccgtgatttccattattccatttgatatgattcaacttccacaagtataggaaaaggttaccttgccaacataaaggtcgatcttcccaggagcacctccaacgtatccgaaatcagcatcggccatctcccctggcccattgacaatgcaacccatgatagcaatctgccaggcaaatgtagacatgattagccatcaggctagctaatatgcgattgaaaacaagggaggcagaaggtctgtaagagagtttacagagacgcctggcagatgagaggtcttctctctaatctgagcactgacttcttggaggtcaaagagtgtccgcccacaagaaggacaagagacatattcctgcagcattaattaacggtcagaaatcgccaaaagaatgttctgcttcacaagagagaattgcctaaagttatttatcctcttcggtaggctataaggttcatttactgttaaaagtgcaattttgcacttcttcatgatatctcacgagttaaaggttgacgttgttcatgggatctacagtctaacagagaagaattcatcagcttaccgtttttgtgttgcgcatcctgcagccctgtaacaagttgaaggatgtgtccctcaaaaactcaaattcctggtcagcagcttcaagaagtacaccatcaccaagaccatcaactagaagagcaccaacatttgccccagcaccaataacaaggtcatctctgcatataatttaactcaaataagcacaagagaataaaggtacagtaatttcaaggggtaaggatgggcggtcaatgcatctcttaataagcacttcatagtacctgttcacgcttttggggaattctatgtgatggattacagggaagttcaaaccgttggtttctaagtactcaaataacctgcaaaacattattaaaaaaaataaaattttaggtaaagagaagtacagaacaatggaaaaccaggtggaaacattggtctgtatgtcagttttctgcagagtcaaatccattttcatttttcatgcttaatgtgtaacttagaattgactatcggttcatcccaacaaatggtaataatggagggagtggtattaactggcctactgtgttcacttacctcctagcagcgtgtactctgccagtcttctcttcaccataaggaacactgtgcagtaacattgttatatcatcaacacccttaagaagatctagctgttcatatgattcatctccacgaagggtgacagccaatctagtgcctacataaaaaaaagattcatcaataaaacagactaagcaaaatgttaaaatacagaaaatgacataaacacaattcacaaaacaacaaagatcattatcaaattcaaatgtctaccttctggcaaaagtttgtgtgcaccgcttgacagttcatccacattgacaagagcaattgcatgtgggagtggctttgtcagttgctctgataagggagtcaacacacccatgctgatgtcaactaatcttttgagtgcaagcctctgtaccattttacagatttcaacacaaaaattttaaaggaatagaatgttaatataagcttgtgatttgtgaaaagaacaaataatgttgaaggaactcacagcttgagcatcttctacaggtgggagctccttcaaaagaatagaatctacagttgccagatcctgatattcatagaaaaattaacatcagtttagactgaagtaccaataaagtttagttgtttgctagaatgtacagctataaggatcagaccttgaaaggcatgccaaccacaagctttgcagcaagagacctataaaggagctcaggagcctgaaaaataagagagccttccatcattacaaaatgcatcaattgatttgattcagatagaaaaaaatcaatgccttctttttgctattgctattctcactatgtactatgaactatgcatagaatgcatggaacatggctactgaaaatatcatgttgtagaattgtatattacaaaatagactattgtcttgaaatatattttggtaaagttacacaagatcaacacattgcacaaaagggtaacaaatatgtgagttaccttcaactgatccaaggaaactgacatcaaaacagagccatcacggtgcaagacccctctgtagtctacttcctcaccctgtcataagtgcaactaataagaaatctagcactattgtttttatgataactatggactataggagttattttgaactaacctccttttgtaaaggcaactgaccacttctacgctggaaatcaaaatagcgcctgtgcttttcttcaaaaggagcctgagaacatataatgtatataaatagaaattcttaaaagaacaaatagaacaaaacactactaaaaatagtcaaaattaatgtgtggcattggcagctaaacaagagaaaagtgtaaaactagagaaaggtaataaatcgttaccactcctatttgaaggtctgcggcatgtgtgccaagatttgccaatctccggcaaggatcaatctcttcttcaggtggttccgtgagggagacacggattgtatcgcccaagccatcctgtaagacaacaaaaggaagacataaggcatgcttaccctttgcagatggaaagatatgatatatgcaatataatacacaaagtaaaaatgcaattaccatcagaagtgttccaatgccaatggcagacttcatcctcccatcttcaccctctccagcttctgtaactcccaagtgcaaaggataatcccaccctaggttatacatttctgctacaagcaagcgatatgcttggaccatgataacagggttacttgctttcattgaaaacacaaagttatggaagtccagcttccgacagatcctggcaaattccaaagcagactcaacctgaaattatttgtagaacatgtcattcatctatcaaaacgatcattaattgaagacatccatgaaacgaaaagttatttgaatgaaatccccagaaaggaaataataccattccgcgtggagaatcaccatagtaactcattatgcggtcagacagacttccatgatttgttcctatacgcattgctcttccatactgcttgcatttctcaaccaacggggagaagacctgaaatgatatggaagtggctatgcaagtaaggaaacatactgcacattcttactgactaaattaacactaaagagtgagatatttggaaccttctcgatatgctcaagctctttttgataatcatcttcagtatattcaagctgctcaaattgggcacggcgatcagctgcaagtagagttctcagcatatgcacagagttgataagatattgacactaaaatgatacacatcattatttcactcaccaaaattccctgggttgacacgaattttgtcaaagcattcagccactcttaaagcaactgtcggggcaaaatgaatatcagccactagggggatgttgtaactgttgaaatgcaaaagcaagatgagaattcattcatgaaaactcactgaatctggaaaaatgatgactcttacttcttctgaacaagagtgttcttaatctcaaagcaggcatcagcttcctttctaccctggactgttattctaacaaaatcagcccctttatctgctatcctcataacctggaccagtgctatacttcgttatttcactagtcatgaaacatagaacatctaaaagaacacatgattaatgcatgcccagcattcaattattcaagcatagaattaaaaactaaaacatagaacttcaaataggagtgtacctcctctacggttttagcaacatccttggtatccgaggtggtcatagtctgaatcctaatgggatgatcactgccaagtggcacattcccaaccatcacagtgcgggtttttctcctccttgtctcatatatagattcacaatacttttgcctgggaactaaagaataacaaaagggcaaaagacatgctgtcagattctttacagaaaaaatgttcattcagttaaaagcactaagaacaactaacacgaatatacatgcaaggtgaacaacagccggcgagttatacctaaaagtgggcttccttctgaagatggctcgagctccatggtatcagaaccggtacttgagctcttggccacaagcaccctgcctcttgatgagcccacccttagagtagcaggaaccgacaagatcttagcaaagtcgacgctcctcgtgaagccgatgccaccatcacggaccctgacatgtgggagcggcgctggtgccactccggtggccatggctatctcgaagcaccaacttctgggttaggcaatcctacaaacaggtgcatggcaatggtagagatgagcacagggtcatctttgtgggttttaatggacagaaatggaatattcccttattgcttccagtccaacaacaggacaaccatggtgtgtagttattgaaaattaactatttcacaattcgtacaaaatactgacatatcaacaattagcaaatttaataactttactttgctaataataagagaggttggtaggacagcatgaagaaactgatgcttctactacaattccaaagaaaatcaaagtatagcaccaatcaataagcctggtcttttaaatagcatttccacttagaaattgaacatgcttgcagaaaattgagataaatattttttttaaaaaaaaaaaactgattcgtgtatccttccggctaagaacaaagggagaaataagatggcatgaactcttgatagctcaaaaaaaactaagaaaaattaagaaaaatccctcctaatccaaagataatgctctctaagttgatcaaatcccgaattttcgcagccaatctcaagagctctacagccctctgaatcataaaaacccaaaccttctaattcccaagcagaagcacgaattccagcagctcccccgcagcaattagcaccgacaacgccagctcccccgctagaattccagcaaataaaccaagcacgaattgcgcccaaccaaccaccacaggaggatccacccgatcggcgtccccccaacacacaaacacacacacatacacaaagctactagaaatctcaggaagtagagataaggctccccaacctcgtagctcccctccggcgaccgcgacgagatcagcagcggcgaggcgatgcgatgcggggatggagacagagtgcgagagctcgcgagctcggcgaagaggacgacgaactggcgagcgagtggtgggctttctaccggattagcccatttatccccagaggccggcgcccccgcaccgcgcggcgcgtcgtgtggactcggtgcacgagcaccgcgttgccgtgggcagtggctgcgtgtggggtccaagagatgaggtgttggtggaccgggtgcatgggaggggaaggctgacggcgtggggttggaggtgtggaagtggggttccgggctctccccgccatgatttaatcgtgcccgtcgttttcccatgcgcttcgtaattccattatcattttgttttgtttttattttattttttattagttcacgatggagagaggctgttttgttcgtttattatttctgccatttgtttttcgtggccggcatgggattgtattgtaccatgaaaaaaaaatagtttaatctggtgcgagagatggtgcttgagccagataaaattgtctgattgttccgtattgttactggctagaggagaaacttcacgaatattcatgggtcatcgaaggatgttttttccttgatttgttggataattcgaatattttattgagaaaacaaaaagataaatttggacttatttaagacccaaagttctttcacggcagctgaggtggtggaatgggactgtctaagaatctggtgatagtttttgtaggaaaaatattttgaacataacttatagtgtaagttgtatatagttatattataattgctatgtgaagtatattgtaattaaggtgtaattttagttttaattcaaaatcagctgataatgttatttttaaagtatttgtaatgataaaataaatgataattatattttgtaataagataaatcataaaacgtatgcccgaaagtcaagatgctaaacaacaaaaaccatagggagtgcagtactatttattgaagaaataaaaaggatattaacattctttagaaataaaagaaacttgatgttgtttaataaggggagaaaaggacatcatttagttcattacatttcaacatttcttccatgcatgtactttcgatgtttgatcgtgactttgacaaggagatcgatcttaattagctagtgcagcttgaaacaaagctacctgcccaaacatacacacacatcgtcgtcaaacctcatgttcaatgccaaaggggagtgtggtttgagcggctgacttgttgtggagcaaggcatccgcgcgcgacggccgccgaagaccataatcaccttctggtccggtggcatggtatgacgggtagatgacaatattgagacgatggccagttcagtcacaccacatgtgttgacctggagcaaagcagatggcacgtttccctgagacaaccgtctccatgtgggcggaagttctcccacacatgttttgggtcgtgggaactttgggagcgttgaaaggtaggcataaaaaccgtggtggaaattttcgacccatcaatctagtgttttcgtaacagttatactgttttcgtttctagttatatataaaatcgactcatgttgttttaattttctgttatgttgatgtcgtcattgaatagttatactgataaatacggaaaattcttgacgaaccagtaaccgtttccaatctttttacctcagataaatgtgcaacctcatgtgaatttaaatgcgtgctagccgggatgaaactggtttggatagtttccgtccgtccgaaccatttttcggattcggatagtttctgtcggaattatccaaaaattctcggattcggaaacgaatttggatattttttctcggaaacgaaaacgaatacagtaaggatactatccatcggaatcgaaaaacggttaaaaactatccgaaatttttttcggatatccgcagatattgagcaaattttataaaaaaacatgtatatatacataactttttcatacggaatcagatgaagacaaacttcatatcaacattatagagctcgatgagatctacaactttattattgactattttattatttaaggtcatttaagggtctaaatattcattataatataccatattaaattttacaaaatctcagatctacaattcaaacgacatctgatggagatgtgttccatatcaaagttgtagagctcaacgggatctaccactttgtagtttataacatttgtacttgaaagcatttaaagtataatacatacattacaagtttcgaagatgtgaagtaaaataaataacatctccaatttatgcaatggtaaataagttatacatctagtaaaaggtcttggaatagaaaatgataatcatatttgcatatggatctcttagaggaacaaccatgaaaatcgattttcacatacgattgtggaaccgtctataaaattgacgatataaatgttggagatatttaactaaaataataagcgatatctctttcttaatcaagaaactcaatttgaggggttttttatataccggtaaatattcgctactgtattcgttccatcttatattcgctccgtatctgtattcgataatattcaattttatttccgtatccgagttttcgatttcgaatccgattccgaaaaaaaaatgaaaacgaatatgataaagctagtttccatccgttttcgatccgttttcatcccttgtgctagggcatacttatgtgggtgtaggtatgacatatgtcttccccttcattctcgctaagctaggaatcattcttgttcccgatttccgtctcttgagcgcgagactcccacactagagaagagcgagcgggagggcggtgtcagatggcgtgatcttaaatcgagcgatctgatgaggtgcgggtagaggaatctaatttctgttgttaggggggcatttttttattctagggaattaaatttatgctgtctattgaaaataagtatatttttaatccttaaattctcattagagaatgaaaggcagatttaggaagagactttcaggcaactcttggccatgctcttagagtgtcaaatacaggaatgtataataatacttaaccaaacaatattattagagtctacagtaattatcctagactgtttaattaatcattttatagcaaaaatgaaaaagtcaattacccaactttctccgatccagtctatgaagtccaacaaacccaatacgacagcccaatgtattacagattgagttgggccgcaagcgcccataccaaaaacatactgtgaggttgtcagtgcacgacgcgaaggaagcagagaaaggtcagggcacatatggttgggaccgcctatgcatcactcgggtgagattttttcttccgaagagaaatcacgcgacaaacgtttagcaaaatcgcatatggttttatttataaatcaaaacggctcaaacttgagtagttttgatcagaaaaaacgcgcaagccatgcaacaccgcctcacgcgcgcgcgctgttcgtgaaatttatcggaggcgggtgcacgaggccacggcggaacagcagctcggccatgacgccgtacgcgcgctgcgtcaggtggacgccgtcccagctcacgtacctccccgggtccgcgcacgccgccgtccccggcgcgccgcacatcgcgcgcacgtcgaacccgtacgcgcccccgccgcccttgccgcagcacgccctgaacacgcgccgctcgtcgaagccgagcgccgctgccccgtccagcgtcgcggcgtacgcggcggagtagtccgcgtacgcgaccaccgcggcgccccggtacgcgcgccgcagctccccgacggcgcggcgcagccacgcgttgtgcagcgccgcgaagaggttgagcgcgacgaggcatccgcgggcgtcgtacgccgcccggtccgtcgcgttcaccgcgctcatgtagctcggcacgcaacccagcgggaggttgcccgggatcaccacccgcgtcgcgcccatgtcgagcacctcctgtgtcacaaaacccacaaaaattaatttagttcttaattaattactttgtagccaggattattattttaaaaataaggtcccaaaaattaatggaaaagaatggtgtgtaccttggctgcgctggctatggactgcacgacttccggtacaagatcgacggccgtggcaacgctttcgatcatgcgtgtgacgttgccgaggctgtatccaccgtccatcggccaggtctggaggaaggcgtagttgtagtcgtttcctccgatctctcccagcataaccagtgacttcgacagcttttcacggatctctgcaatgcaatgctcacacaaaagaacttttttctttcagaaaaaagtatatatatataacacaagatttctctatatgaaagtcattctagcactgaaaagctgtacattagcttaattatttgtgagatacagcattgctgactggcactgatcaggcaccggtcgaaattaagctgaaatgcgtttcagtttgttcgttcaccttgaggagaactagttgtggagttcatgaattccttgaaccatctgagctgcacgtatatatccggttgaagtagtacctcaaggtcttaggttcatatcctctatggatggattgtttacagggttaagttccctacttcaatagccgtatatatccggttggatgtagaggccgggtaaaaaatacccttctctaaaacaaaaaaaatctgagctgcacgtcgagggggctgttggtgtgggggacggtgatccgcctggcggcgagcgccgtcgtgttgagcgcggtggcgccggcgacggcgaagttgacgccgtgggcgaagtccgcgccctcgtcgaggtacgggttgagcagagggaggccaagatctctagctgcacatcgatcgatcatatccacaatttaatccgaaacaaaaacgcatatatatataacgtaatataatattgtttcttccatttttcagacggaagagagagagaaattaaactgatgacgtcaccgaggaagtcgatgatgaggtagccgtcggagcaccggccggtggcgcggccgacggtgacgccgtagggaagcctcgtggtgtaccggagcagcccgccggtggcgccttgcctggcgaggttgcggtgtccgacagcgagtcgccgaggtttgtagatggccgtaatgccgtcgactactaccgtacgtgtcgccgtggacgccgccgacgccgccggcgatgtcgtcggcggcgctgatccgaggcatgagccggcgaacaggagcactgtcacgagcggaacaagagccatggccgcgcgcgctaggttgccacagggtacaggtcgctactttgaattattttcccacgctaattaaagtaggctcgatgcgaaacgtggccggtttttttcgttacgaaactcagctcttccgtagggaaacctacgcgacagcattaatgcattaatcgagttgcttgcacgaatctccaagtgagggaggggttacgcgttaggcgctgccacgtgtatcgatcggcacgaatctccaggcagtcggcgagggttaag

SEQ ID NO: 40917 - DNA, 10848 bp, Oryza sativa
gagcacccacccgccgccgcgccgtcgccgattcatggccaagttcaacgtggtgcagaagaacaggcgcgagtggaagcaggaccgcaagcgccaggcccatggcgaccccaagaccggcaagctcaagcagcgcacggcgcccgtctccgtctccggcaagcgccagcgcaagctcctgcgccgcctcagccgggtacgcttggttacccccccccccccccgacatctttccccctactcgtgtccttctcgcggcgcagcggcatgctttgtggtagtcgtggggatttcttattttctttgttcttatttggtgggatctggtgttgcaggagcagaaggaggctgtgatggccaaggcgctggagaacaacatgggcgacgtcgagatggtatctgcggaaggtgcgtttgcgatggtcattgctgatttaattcgtttgaaacttgcaagtgattgtgaattgctccacgttctgtacttctattacactgaatagtgatgcttgttgtacaattgggaattagctctattgttgtgcagtgattccatgcaattttacagtaatattggttatgttggtcatggttgcgacttgcagtgatgtcttcttttatgctcattttgattattttgggcccagttgcaatatggcaccatttgtagtcataatttccacctcttgttggtggaagactgacaactaatgtaggcaaaaaaaactttatgcttgtagttacagaggttggaacagctgtttttcacttaaatatagtattgcagacgatgaagataaggaaagtcaggttgttgcgtgacagtgtgagtgaatatggtttattcactagattttcatgatgatggatggttgtttttgtatgtgttgattcagtgtatcaagcaacaccattctgttctgttacgatgaatgaattttactgttgtctaggtgctctaagttgtaatgttgtgaaacttaccaggctatcctagctgtgtagtagtaataatttttatttggctgtatatttactgactgctatttggttgaacgtctgctgttaacacaaggaacttatcattgtacctcacgtggttaaactagtgtttgaataaataaggaaatatgcataacattttcttgtttgcatgaattttggtcaattgttatactcctcttgtttatttttggtgagctataagaaaaaatatatgaaatattatgtttgagaatgacttagtgatggtaagccaaccatcaaggattcttgatagttaatcctaaaggcagatgtctggaataaatttcaaatcaccgttttatatttagtttgatttgccccttttcttgagatttgttggaccttctttatgtgtgtgggttccgaagtttatttcctctggattatattgaactggtgatttgagatgagattctagcatatgttgctcttggtgttagtacgttttattctaggacggccatacaatcgtacactcacacttaacaacttagtctagctagctgtctgctactgctacatgcgtatccattgttttgcattgacacaaggcaaagttatgatagggttctcaggttgttccatactaggaagcaagtgtgagtcagcatgactagagttattagtcctaagttgaccatgttatgcagggtattctgttaccatgtgtttcttcactactactgccatgttatctggatgtgctgtttacataatgatttcgttgccttgtcctctgtttaggcaaccacatgtttatttttataagtatctggtgctaaatgtgacacctgattttgtgttttttgaacaggctcttcagaagctgcaaaggacaagtcacaactgaagtttaatgtgaaaaagaactcaagagtacagatcaaaagattaaaaggcaaaggtgagttattcgtgtttgattgacctgatattttcttcataggagttgatcactctgtttacttatatttagcttttgtcctgttagaagatccattaaagctttgttgtttcattcttcaggcagaaagaaagccaagaatgcaaagccgccgacaaaggacaaagttgacgccatggtggagtgactggatgtggttgataacactcagcttctacattgttgaagggatccgcaaggattgaaaataccatgagctatcaaagcatctttactgtcttaatgtttagtacaagctagttagctttctaatcaatgtatcctactaaatacgatgatcaagacctgagaggttaaatgcatggtttttggaatatttgtatgaaagcctgatttgcatggtttctgcgtatttagtcgtgacatcctgtctgcacttcctttcacgttggacacaattttgatcgatcaatcaagcaaatcacctgactcgcatcagcaggcagcaggggcgagctcatattccaattattacattttcgactccagtaattactatttgctaaaggctcgtcttggctagctcaggatttaaaaaagggaacactctgcattgagtgtttgagaccatgctaaactcttacgttaagctattatcacaattcatattggagtgaacgtaccatcccgtggctggagtcaagcagaattcggtggcacggtatatgctctgaagtctgaactgctacaatcttacaatactgattggaagctgaaaaattcagctcgttttccctgcctgtgcagtcgcagaagtctttcaatattttgtggagaacaggagtagtgtaattatagacaatataataatgttggaacaaattatataagggaagtttctatttgggcctacgtgggctggttcaaaggaagcacattaacaactttccacgatccagtaacacaaggcttgtgtggctgacttgtgggcccgcaaacagctaggcgctcccgccctcccaatggtctaacgcgctcgtcttcggcgcgctcaactcaaaaccacgccgaccgaaaattctcctcttttcccctccccgctgctgctcctcgccctcattttttccgagcacattggtcgccgccttccccaaattaatcaccaccaatccgcgtcctctccccctcccccaccggaggcgccaccaccgcggcgaggaaattgcggcaacgcgtgtagcggcgcctgcgcctcctgccgccgtcgtcgtcccgttccccgccatcgccatcgcgccgcaggtatgggccgtctcgcgcctatgcctctaccgcacttcatcctgccagaaaaccctaaccctagtgccgccgaccagttgcgtatggatcggcgaccagccgcacgcgtgtcacgcccagaaattcacgaaccagaatttctaagctgaatgtgcattaaacccctgtccagaaccagccagggtacacaaacgacaattgttgacatacagatccacgtcttacaaaagtataaaagattacaaatgcagcggaaaagataaaagcgagctaagcctgaagacttgactcctgcagcgggcgattccattccacaggcatccttgacggcagcggcgaaaccaacttcttcgaaacatctccaactgagaaaaacttcaactctagtgtgggggaaaagagagcaagactgagtactacccagtgtactcagcaagtcatactggaagagaagttatgatgcaggatatatccaagggaggctaaaggttcttttgcataaagctagcatttaaaagcagtagttgaaagcagtaaaacagttgtagtaattaatcaatattaaccaatcactgtcaaacgctacactacgttgcaacaggcccaaccaaccacttgaactacaccagttcattagctaactaggggtgagacaatcacggtgaatctggtggaccgcccataaccgtgggcacggctattcgaatagtcttactcatatcagaggtgtacaactgtacccacaagacacagccccacaacacatttcgtgcgccgacatgccaccacgacatactggaaagaggccgtgacaggacccttcgcataaccccctctaactaatcacaccacacctcgggtttcacccccactcctcgcaaggcagcgggcagtcccccctcgtgccacggtgaatccggaagccgatcaaccggacacgctggccgacccacgcgccagcaactcgcgatccctccccgcttccttgccatcgccgccgcccgccgctgcctgggccgcctagatatgggctgtcccgcgcgcctatgcctctaccgtacttcacctcgttgcaaaaacctaaccctagctagcgcggtctaccagtcaactacgaaaggatcgaaggatcggccaccagcctcgccagcaactcacaagtcctctccgccgcttcctcatgttcaaggccatccccgatgtgcaaggtatttggccggtatctctcttctgaattctaattaccgaatccgcttgaggctttttcgatttgatcgggtctggaaacatgaagcgattatgcgatttagaaatgttgatccatgcacaaatgattgttgcaacttaggtggtgaattatacctctcccaagctataggtggataaatttgcatttgtacataagaggaataggggggagtttggtttctggattattcaccgcttcgtgttgtgttcatccgtacgagtttcatactatctccgtgcgtcgcaattaattagtcggtcttgctatgctgatatggatgtcgctcattctcctgtctgtctcttgctttccctgctgagtttgttagctgtttcatattccaaattgcctttatcttattatttgatcacattttcatttcctactatcgatcgaactattttgtttcctctagtaaccatttaatagatttggagaatatgtgtatcttattaatcgatgtttttgtgattgtgcatagatcttccccaactatctttctctgattaagtaacctcgatactgagcttgtgagatcactcggacgattccactttttttttttaaaaaaaataaacaaatgcagaagctctgtttcattcattctcttagattccacgtttcggtttatcccgaatccgagttccatttttatagccatgagctttttcgttgttacaaaaggatccacaagaattataaatgttttcagcttgaatcattgtttgaatttgctctgataagcttcaatcatttcagcttggtcttaaaatgaaatttcatcatttattcgcttgtggtgaagaggctaatgattgcaacccaatccacccaacttcaacaccaacagttatctatgtccaagtgccagggtatctatcccagaagaaaagggtgtctggacaaaatctgattgtttcaaaggtccagaaagttcttcctgaggaatcaagaataaagtcagatgctacaataaaatgggcacttcagcttcatagtgctggctattctcttagtggaaaatttcaggcctctgatctctgtgtcgatccatcaacagaattaagtgtttagtcacaaagagtgctgcttaagaaagcaactatgaagaacaaaaggaaggattttaaaagattgaggctaattatcaagcaagacatccttggaatcaaatgtgaagctgacctcccaaatgatgtcaaattgctattggaccttcttaaagactatcatgctagtgactaggtattaattgctcatcacccggggttgatgaatgaagataacaagatttctactatattccacataatattcactgaacttgaagctctaatggtaacagatgccgtgaagtatcagcgcatcatctctgctttggcttcgctgtatggaaatggttgctggaaaccttacgcctattgcaacaagcatgtcaagggagtttttgttgacggctgttaaatacaaaattctcgccgtcaatacctgcataaaaccataaaagtaaaacatccaatatagtgataggatttatttctaaccatttccacaaatgttggtgtatattcgtatgcaggtaatcaactaccaaagatgggaaagaatgagcatgaagaatacaaatatattttgtgctgatggacccacaaggttttgagctacagcatataaaatgtgcaatcattttgagccaaaacatggtgtaccataaagtggggcccacatgttagcattctgaagaaggatatgggccaggggagccggccacagttggaccgaacccccagctggcccaatccagcccaacttcggcatgatagttgtacttctcatcctatgacggttgtggccgttaataccggtggaaaccgtcatcaaaagagacacttggcaagagaaggatgaatatgctatttggattctatggagaatattccttagcatctccactctctcaagtcacctccacactataaatatccctctcctctccctcattcacacacactccaagcttgagctgaattataagaggctctattgtactactttgtatactagaattagaaagagagtagagtagaagaacttggaggaattccggagttctcggtaatcctctcctatttcttttattctgttaattactctattttcaatagaaatatcttcctgagtaatttagatttacttgcaagaattatctattggttagttcctaatcagcatacgagattattgttcactataatcaactaaattataataattgctttagtgagttataaacactagagtagatattaattgcttacatatggtgtttaggtaatttatatctagtaattgttgtgtatcccacaatgcgtaggtggtaacagccctcaagagcacttaagtccttcctgttcgggtacgtagtagagcgacatttgggaacaacgggttgccagtgcctgaagtattgcgctaggattaaaattaagctttccttggacactgtttctcactagaaaatcgtctctattattggctaactttagctttgtgtccttagatgaacatgataagaaagtaatacacattccttgtggaaatcgataactaaaaatactcccgggtgaagtgccacatcggtatcttccatgcgcttgcgaattttatttgaaacgttaagaaataccaacagttttcaccttcaaaaaccgcatgaccaactatgaagattctgctgaagggttttatatctttacagaaactactttcaccatatgataaaggatcactctacgcatgtccaagaggtaaaactgtggtgtttttttgtgcacaaacagatggaacacatgttgggcacaattctcttggggctcatagttcaattgatgatggagctacccaaatagtcagttctgggtagcatattttgatgaaggaatgaagctgataaacaatggttcaattgagtaattgccaccacgctcggattttgcgtactaccttttgtcaacttaactctgtagaaagaatgattgtacggtttaaagataacattatttgtttacatagatatgtacatagaaattacagaaaattgctttgacactgggctaattaagaatgattgtacggttcaaagagaacatcattcgtttacagtgatatgtacatagaaatacagttacagaaaattgctttgacgctaggctaattattttggtagtcattttttgcttagcagtagggtcctctttacttaaaggttcggattaaaaaggattaatggcaaacttgtttgcttgtcctgatacagcctcttttaactatgatatttatttcttctgttactggtctgtatttgcgaactaccttgtacttattgttggtttttgtacatctgcaaaactatgcagcctgtagtttggctactaatctttgagtatactgttctagttacaattggtggtgtgatatgctctcatgatcaacagctatacaggttgtgatattactgcatggtggatattgtttgctagtttctaggagtacttgatttgatacaaacaaagcccactttaggtatcgtggcgaatggctgtattaaagtgcgaatcatgtgtcctgagaccttacgttaccagatccggcctgcacttaattggaattgtattatttctttcgattattctggcttaaggattcccgtattaattgggttacttctatcttctcttccaatgctttgttttgatgtagctctgtacatgctttcagtcaacaactaaatttgtgagtgcctgtacattctgcatgtattcagttagctcaactaaagatataacttattctgtgcacgttcatagggttgtgtcattgtgtgcatctcagctcttcattcatcctcatttgtactagttacgtgcttctcaccagctcggcaacaatgggacacatcaggaaaagacaatagaataatctatgatagaatatttcatgttatgcacggtttcgatttcagagcatcagatgcaaacctaacaggccggacacatgtcaacatgctatgatcggttttcaccatagaatcagcacaaaaatctgcatttgttaagatagtgactgctcataggcattttggcagggaaactgtgatatgatggaaatgagatctttctacaaagcataccgtttcaaagtcaaattacaccggtttcagttaaaaaaaatcagattattacattatattgcaacaaatagtgcacaatgtttcaaaacaatggacacagaaaatactttcatgaagtcactgttcaaaatttcaaatataccatgtttgttcatcgctacaatttttccaaacttgcttacagccacagttatcaggtaatgctattaaggcaaggatttgatgaaattaacaataagatagatgtgggcatcaaaagaagggcctccaaatggatgttggcaccttctttaatcaactgtgtatcaaacccgtctggattcatagacttgagtatgactacgtcatcatgatgcctgccgagtaggattgaggacatcagaccacattatgggtactcaacaggccaatactaacataaccagtcatctgttcagccttatcatctgcagatattggaattggtgcccctgcatcaggaagttacagttagatgcatgcccaaacatgatctaacagctgtaacaatggctgaagaaaactgaatggataactacattatattcatccttcgatgcaaacagaaactatttcattggtctccagtcactaattcagtaacagttgcagtggacatggttgacataataaaatcttgatagtgttaagcaagacaaaaaggacaccacattattcagtactcatgagccactaagttttaggctagattaagaatgatgtagtaacatgtatagcacatccaagcgactttacatttcctacaaggggggatttactgaaagatagtgttgctaagctaacaaagaatatatatctttttccattagattttcttatggagtggctcactgatgttcagattccaaagccctaaaaaattagataaaacctagcactaattccagattctacgcatgaagtatctaaagtggatagaccgaaatagcaaaatgccacatcatttggaattattccattgtgaaaatgatagatccacaatcccacaaggctgaaaaaagcctttgcaatcacacgttctaaaagaagtagaagattcaagtacatgaaagatagcatacaagtagaactaataattcagtgcaaaaggttgtctagcagaaaattacacatgtaaattaacaaaaaaaaaactcccttttactcataattgtctaactttggcaggcccttactaatataactgtggtggcctcaggttccgttgtgccaactttaggtggcaatccaaacatgcccttactctatcaaatcaaataaatgagcatgtacaccaagtatgtataccaagcacgaagggagatattatctttgagatcacaggcagagaacgctccctttgagattgaagccttttattgacttccacctacaatttagctaccttttgcttcctaagctgctcatggaacttgttggttagtgacaatctgtcaatcggacaacacaggagcaagataattgtagaattcattttgtaatatcaagttagaaagatcacacccatgcaaccacatgataaagtggtagctatattacggcatacatccaaaacgccataggactctttagatgatcatcgtaaaccgttgcaatttcaggcagttgataggatccaatgtggtggcattttgcaattcgcagatcttcgtgcttgtcatacttgggagagaaagtagttatccgaagcagataacgaatgcgttgaggcaggaactccttccaaatgtccccttggtgattgtcaatcgatagatactgcacgaggcagaccatactcctgtcaccacccatatgcacaagggttgcgccaatgtgtttctccgcggtgtccacgcaaaacagcctctccttactgagcttacaagctgggggctgcccatcatcgatgtcagctgataaaacataacaggcacagatgtggccaagggtgtccggatcacaggacaacccaacctaagcatccaggtcatggtcatagtagccacgacctttgaacggcaacgcccatgcaccatgctgcgtccaccgggagctctccaagtcaaaagacaaggtggcaagaacgccgctgcgcttcttcatggaatacttcgtcatgctgaagaccatggtccgttggtcatggtgcacgccatg

SEQ ID NO: 40918 - DNA, 1515 bp, Oryza sativa
atatataagggtggggggttttcaaaactttaaagtgttaggtgccgctggttataatacctgtggttttatatgcaacttgcatcataattcataatgagtggggtttatcgaaatttcgctctattttgaacgaaccgagcaaataattcgtgattcgagcaaatataaatagacagaaacacccgcctttcctttccttgcgcgcactccctcctcccacccaccttccccccttctccccttccccctcacacctttcgccttcacctacacacaccggaatccgagatcccggtgaccgcgtctcgcacgcgtccccctcccttccccgccgccggatccagcccccgcgcgctcgccggagtcgccgccgagctaaaccgcgcacccgtcccccgcccccgcccaggccgagcccccgggtctccgcgcgcacgtgggggggacggcgccgacgccgacgccgcgccagatctgagagatccgcaccgacgccccccatcctcgccttccccgaggcgtcacgccagatcccccagatctggaatggtggtggtgttgttgctgctgctgctgccgtaggtatgcttaggtgagtccgtgatcctcgggaatcggtcaccgcggcccgcgggtagtgggagggaggcaaacctcgtcgtcggcgtcggcggcgtgaggtgctgcggagaggtggtcggggaaggaagatgcagcggaacggggtggtggaatgcagcgtgtgccggtcgcggctggtggtgccgagcccgcggagcgtgtccagggcgtacgacaagcaccgcagcaagatatcgtccaagttccgcgcgctcaacgtcctgctcgtcgtcggggactgcatccttgtcggcctccaggtgtggcttcaccctccttgtagctatatatttcattcaagtatccaaccgctaggtgtctgtgttacatgtttagccaatcccaaatactcggtagtttggtgaaatggtctgacgaaaattcctgtttatgcttaataatcatcctgagcctggagagctgtactaatgatttgctttgtatctgcagcccatcctagtgttcatgtcaaaggttgatgggaagtttcagttcagtcccatcagcgttaactttttgacggaggttacaaaagttgtctttgctatcgtgatgctaataatccaggtgtgtacttttgctgatgtttcttggtgtgcttgcattctgatgatgagtaatttaacccctataaaatgatatgtagagtacacttatagtttgtcttgatggctttggattggtaaaatactctgttagttcattagatcacttgtactcttacatgagcagcctactgaattcttctggtacaattcttctgcgtccaatttcttatagtacattcgtgtatcagaagtgattgcacatttaaaaaaaatggaaggagcagcaaatttgtgctaatcttccaaattgataagctcaactaatgcagaactaaagatcaca

SEQ ID NO: 40919 - DNA, 17534 bp, Oryza sativa
agaatggcgctatgacaatgggtgtctgatgcatgaaccatcctagcgtcgtagtatttggcgagaattgggttcggtgagaagatgtcatgtaaagttggggaaaggaatgccaacgttttgagtttggaggtggggtttctcgttgaggacatatgctcggtgccgtttctggtgacaaaatcctgcatctgatagggagagaacaagatgctccaacccccattcggtttggtttctgcacggtgaactgccgtttgctgttcagaaattttggaggttcctttcaattgaacatccatgtcccatgttaggtcattcctgcttacacgtgcagctaaataggcatagcattatgacctgctatagagttctatgcagatctcaataggtttcccatacccccatcaatattctgattccgtcggtgttgttgatcaatggttctccacattttagttcgtctctcatatgtgcggaccagtatatgtgacggagctattttcctatatatggtaatctgtaggacttataaacttgtgaaagtaagttcgtgtgttatgccttcctaaaattttgcagacattcactctacattgttgttcaaagcttcctctcttaccatgtatgtaaggactccttcaccggtgtataaccaaggataatagttgttgtatattgtttgctacaatcttatcgtagatgtgtataaaatagttttatctcttaaatgttaatgatttgtatgtgccatggtgcatcagtgtttgaatgtatcagaatcaaatgaacttagtacaatgtgaggggcacatttatagatgtgagactatgggactatatgctatgtaaacaaatcattggcagaatatgtattaaacattttagtcttatcaccctaagagtatccttctaactaactgtatatctgagatgtccgctattaaaagcataagtacttctgaaaagcctgcaatgcaaaatgaaaattcaattgctatttgcttttttaatcacatgaaattagaaactatttactgaactccttgcaatatgttctcatatggaacagtatttaacgccttctgtttgaactatgaaatgtttgtatgcttttgtaagcacacttttggtgtaactgtggaaattcgatgtatggtccaatccaactgtatcaaatttgctttattttatatggcatcgcgttaaaaaaattaacagattagagttgtatctatttttaattcattttgttaatttacaataggtgaggaatttttaatgcttgaaatgactgaaagttggatagaaggctcaaaaaacacttcagctccagaatcagtttcttgttcagtttctagatatgaatcatcaccgccaagaagactggggaaaaggtaattaaatgctaatgtaccattattttttatttattttaggttgtggggcatgatgtagagtgtgacttttattttctttactatccccagaaatatttatcatctattagctcaacgggagatctctcctcggacaaaacaccaagctaaaaatatttggtctggatctccagaatgtgctactggttcaattgagttagcattttgggttacagatgctagacatgatcttttttcttggtaaggcagatttcttttttaaccaagatgagtactttatatttaaagataaacttgaaccgttgattttactactactatctgattgagcatgcatcctaaaccttacctttttacagggctgaatcacaatccttgcatcggtggtctgccaggtattgtcttctcctgcctgctccaaggtcaaccattgcagctgcattcagtccggatgggagaacacttgcatccacacagtaagctaaaggatatgctgaatatatgttctgaacggaaaaaaacttagactaactacacttttctctagtggtgaccatactgttaaaataatcgattgccaaactgggaaatgtttgaaagtgttgcttggacattggcgcactccatgggtggtatgtctattaaaactggcaattgtttttcctagtgtacttcattttctgagatgctctttaagcacttctaaaagaattaacactaatactagtttggtttttagtgtttccttaacgatcacttgcttaaataacaacagtttgttatctatgtgtccttgctgttttccccctatgtacaaactgttaattcagaaaaatgttttacaaaaaaaaacaatgttgaattttgtttcacttttttattacttgccataagaaattattgttgcaatgtaggttagatatcatccattacatcctgatatcgttgctagcggaagtttggataatgaagtttgtctatgggatgctaaaacctcccgttgcattggatcacacttcttctgtaatatctcttaatggactcattgtttttcttctctattcgtgagcatttctaaagcaacaattgtaattattttttacattatgttggcagataagcaaattgcatcaattgcatttcatgcaaagggggagcttctggcggttgcttcagggcacaaagtgagatgtttaaacaaatgaactttctatggatcgttctgatctgtacttcatcagtaactgttaaagtttaaattttgaaatacatttcagctgttcatatgggactacaataaacgagatgaagcttctgacccaccaatgatattaagaactcgccgttcactgagagctgttcaatttcatcccaatggggctccgtatctactgactgcagaggtagaatttgtctctctgaattgatgatttatttatattagttttctaattttctccgtgtctccctgtcctagtgttgatgtttaatctcaccccaaggttcacttgcaggttaacaatcttgattctgctgattcagaactgacccatgcaacatcttctggctattcaaactcgccttcggctgtattttttgcaatcatgaactccgcatgttgtccatactctgagtctaggttttcatcaccgtgcttgatctggcctgcatatgtcagagatgatggaagcatatgtctgcttcgcaatgactgggttagtggttcatccgatgtgcagcagccatcagattctgaaactcaacaggctggccatatggttacacctatggatgtatgccctggagaacctggggtgaataattatgatgatgaagattctgcatctttatcaaatagaatagaaatgcatactcccagttggcagaatagctcaagatttcacaacagtagtgctgctactgatcttcacaggattgatataagacaagtttctgacctgagcagtgatacgccaaatccagaaatgcctgcacattcaagaattgatgttccaaatagtatgccaatggatttgttcgccttttcaaatacaatagatgttcaaatgttcctaagagacgtagaggccggacatcaccataataattacactggtggatcacatagctgggaactgccttttctccagggttggttgatggcacaaaaccgtacaggattgcgtgcaacacttcctaacaatgaggttataggagacttacctatcggtggcactgctgggactgataatgtgatgaatgaatcatcaaacatgtacagttttgaacgtgtagggccttcatcatcaattccaattactacggacagtttgagagggctaagtaaacatcgtcatatgctggcctctgtacctggtggagcagggacttcgcttcaaggtgctcaaaatggtgaagctcatgttaatgttgtctcattaggtgttgggtcagaatttgctacgtcactgtttgctggtgacggtactgaattaccctgtacagtgaaacttagaatatggcggcataacattgacaacccttgtgctgtgttagcacctgaggcatgctgcttgacaatctctcatgctgttctttgcaggtacactttggcattcctcctctttcctctgctttattgtgtagtacaaattgccaatcttttcctgttgttatttgctaatgattttgatgtattaaactaaaaatcgttgctattttcttgtgctagtggtaggcagcaacaaccatgtgacagtaactaataaaacaattaatgcacaaatgtatatttatctgaattggtgcatttgagttgcgcttttatcatggttgataaattttgtgctgctgctgagatttgagactctgaacttattaattgctgcagtgaaatgggcacccatttttccccctgtgggcgttttttggtggcttgtgttgcatgcttactgcctcaaacagaagttggtgagcatgtaagccaatcgcctgtacagtatgattcaactggggctggaacatcaccaactcgccaccctctcccctctcgtcgagttatttatgagcttcgtgtttattctcttgaggaggaaacgtatgttttctcgatgctattttttttattatttgatttttatctgccagtgtctgtaaattgactagtgaagtcatttattgcttttgtgatttccttgtaggtttgggacagttcttgtgtcccgggcaataagggcagcccattgcttaacttccattcaggttattttctttccaattttttttgtaggtgtgaccattaatacttttgaggtagttgtgtacttgcttgtgtgaggcggcaaatatgagtttccgcagtcacttccattctgagagcattaacactttgtatcgaacttaagtgtgttcagtgaagacgtgttctctaacccttttggtggacaattctgtagttctgatcatttaattttggactgatgtgatatgaaatctgttctgcatgatgatatttttattcgctgcagttttcacctacatcagagcacatactactggcatatggtcgtcgtcataactcacttctgaggggcattttcatggatggcaagaccacaatccctgtgtacactgtcttggaggtagatatgatttacaacttaacattaaacattttacaggaaggctgatacagatgctctcatgatacttgtttctgtgttttgtattggatgtaatatacttcttgttttttactctactacacataagtttgacaaagcttaattgtgaccactagcttctattgtaattctttttgtaggacttaataaaattataatatcgtgaaaatatatttttcatatgaacgaagtattaccattgtgttataaatctaatctgaacattgctaaagatattattagttgacgttaaaatagtttataatggaaccaaactgtggggttacgatttatgtgcagtaatgactaatgacctcatactttcaggatataaggctatgggctaatactatttctttattgcacttccataggtgtatagagtttcagacatggagcttgtaagagttatccctagtgctgaagatgaagtcaatgtcgcatgttttcatccttcccctggtgcaggtcttgtttatgggactaaggtgagtgacaagttaggtcaatatcaaagatggaatgaatattggtatatctgatgcttatgttgaatcacaggaaggaaagctcaggataattcaacacaatgttgcagactactaggggaaatattcttgaggtactacttacccgttatttacttttaggtctttaatgtgctcaaactggtacctagtctgccaagcataagcagaatttttttttttttggtattgtcctgaatacaagtttgagataccgtgcatttggtcttgatcgaaccgtttaacatcgtttattttttgaagcacactgccaatcgtattaatagaaaatggactggctttcagatttttagagaggatcaacccttttggcttgagcttccttgtgtccaaattccaatctacctttgctgggggtctcgctcattctagataattctaaggctacagatggtgttttatattaatcatttttctgtataatgtgaggttctggtattcaacttttccattactggtaatgaattcatactgagctaggatccactagggttcaatgcttaagaaaatgttgtgccgaggattctaatctattgtttgattggtatagccagttaggccagtttgattggttctacttctgagtgaacccaatgctaattcttttcgcaggaacttatctccacagattcatatgcccaatgaatcatatcccatcccagctaaatcatggtggtcaattttgaaggaccaacatgcagatgttcgccttcctgagtaatccacaacatgattgcactgagactccggaaaacattttgtgacgatcatgaagacttcgctctgcacctaggtaacagtgacgcgggtaagaactaagaagcaagctgtgagagaacagtcaaggaaaccgctcccggtggcagcatatgtgactaagttagtggttgactaatttcattgctagaggtagagcaggaggatgctggtgtattgatgctgccttagccagaaaatggggtagcagatgaaatctagcaattggcatacatgtcaatgtgtcatgttgctctgcatgacgttgtcctaatggactgtaacaatgggatgttgctgcaatcagaagcacatacgctcttattaacatgatttgctgttatgcaaatcttttttctgccggtatatggactggggttggtgtatgttgggcaaatgaatcccaaaaccacattagtaaatgcgagaaaatgggtatcatgatgtcatcgcatatcacttcaagattaattagaaaggctcgtttgacaaataggatagggaaataatatcccatccattaaagggtaatattgtattctaaccattcattctttatacctcatttaatcttagtcattcatccttttttttctttcccaatcccacatctcataaccatttgccaaacaggccttgaggattttgttgtcttattcctcacttgtgaatgactatgattagcgagtgatgaatttgaggctcctttggatataagaaatttaagaaaaaaaaaatactccctctgttccttgatatagggtgcaactggtatagggtgcaactggttttttaagtgtaccagaatataaggcatccatacacatgcaagcaagcagcattaaaacaaaaagtatgaaatctggtcgacttccgtgcgcatgcatgcaaaggctttcaatgcgtggagttagctcttcgtttcttgcgttcgcggggtcgttcacccaccaaatagcaggttgtttgcggggaaggatgcgaagagctgcatgcatgagcaaaggccgatgcacacggagaagcgaagcgtcgcaggcgtcaccctgagaaaatcagttaagcctccttggtattgccgtccagagcatttgcgccctatattaaggaatggagggagtacaggattatagtgttctagccccttaaatcatatggatagaaaaacgtaaaaagaaaaaaaaagtaagaatgataatttgaatggagtgcaacgagaaagaagagaggtagacacaaatgacccattttcccaataggttgatggttatgttataatttttctaaaagttcttatgttttgagtcaatcaaaagaaaattataggacttttgatagctattctttttaatccaaaaggctgcatagtaaaaaaaattataggattaaactccaaaattccaccccctttatttttgtcaaaatggccattttaaaaacttatttcgaaactaaccatacaaaagaattcatccaaaaataggatgggggcttagcgccaaagcagttggcgctgaggttagccgtctaccagtgtggtggccgagccgatcccccgtcaacgtggaacaactaacctcagccttggtgctaagacaactaacctcagcgctacatgcgttgatattgaggtagtggccataacctcgcttagggaacaaccttagcgctagcgtaaatggtgccgagctatacgaccttagtgccattacgctagcgctgaaccctcaccgcttggatatcgctatgtacggacctcagcgccattccatcttgcattgacctatgccggctcagtgcttgcaggctgcctaacacaggagaagtgttgggcgacccaggcacgagtgcttagtgctgaagatcagcgtgggaaggaaaggcgctgataagggttcaacgtgagggtaattggcgctgacatccttgccatgtcggcggggggaacggctcggccgccgcgccgatagggtgtcagcgccaaggcggttggctccgagacggcttatattagcgctaagaacattggcgctgagtccgtgatttatttttggatgaagttttttttacacggtctttcgaaataattttttgaaaatggctaatttgtcaagaaaaaccgtggccatagccatctgcgtgattcgatatttgcgaagctcttcatggatgctttgagattagtgccagatcgtgggaggtaggtgtgtgcctgtgcgctgcgtcttttgaccaacccagtcgttgacccaagacgaagcgaagcaggcgaccattttgtttttttccttttaatttattatttccaaccaagaaacggaggcgtggcagttggttgggcaacgaatgcgaacctacttctcctagtatactgcttttactttagccatcgccaccaccgccattcctggaacccccttccctcttcctccctcggatctctcctcgctcgcgcgttcgcgccgccgccttcccccttcccccgttgattgattggttcgtgtttttcttcttttttttttccttctgaggggtttcttgatgtttcctgccgtgtgatttgatttgatttgactttccccttcttcttgttttctttttcttgcagggaggaggatcaatggagtgcgtccgctccggctccggggttcttgatcccaggtgctctccgcggttcctggggaagaagggtggttcgctcacgtgagtgcttcttgatcccaagcgctctctgccttttccccctgtttctttccttctttgtgagtggtggtgatctgtgatctctcggtggggggtttggtgcggactggatcttgctggggtttttatttattcaggcgtgttgttgagatcactgctttttttttgggtgacgattaaattttcagtgaaagcaaattagtatatctaccagtctgtagtcagtatgatggagaatgattttttttagttcaaaaacattgcaatgaatccgtggactaatcagttatttggatctcctcaacgaacaattatgttagctcaattttgttctcaacaaatacagttttcccttgtgagttctgagcatctggtgcacacaaaacttagtatatttgtactggactaagattactgtctacagctccaaaatcaaaatgtattttttttttgagttgataccatttagagacagtaagacatagtactatgggtttgcctatcaaatggttgggtgggaggaacactgaatgttcaatttgtcttgaagaaagttaattgcatatgtgatttcccccctttttttattgggagtgttgatttgtaatctcaacggagggataggtgctgtagaggctggtgttttattcagacgtcgttgcaatgactagttctctttttgtgatgatttggtaggaaatattcagaaaacgaaaattaattctagaatttaattggtgtgccatgtaccatagcatatcaccttgatatctaccagtctgtagttaacatgatgcataatgtttttcttttagttgaaaaaaatattgtaacgaatccatggactaatgaactatttggatctcctgaacgagcagttccattccttacaaatctggcaaagacaaaactcaaaaaaactaaatgtgttattgagttagtgattttgtctgtcaaatggttgagaggaatgccaaaggtacaaatggtctggaagaagggacatatcttttattgactgtatacaacactgaaggatgtgaagctcaatctaggcactttactgttatatatatcaataaagttataaatcaaattttctgtcagttgagatttgacgcgaattcacaatacatttgatgttgttattgctaagttaaccaggctttctgatatgtgttgattccactgttattaagttgcccgactagtcacgattagttgtaaactagtcgtaaagtcggtcaagctagtcgactagagggctatgactcaaccaaatagcaagtcgcatgactagtcgtggttactcgtagattagttgtgattagtcatagcaaatcaccaattcactatgccaattggcttattgtgtttagtacttcagttttgtttcttgttgacttattgtcttgcttgctacttcatagtccacagtttatactataaacagtgcttaatgcagtataatagtagtaaagactatatattgtatatcctgtttttgcatgaccaagtcatggactagtcgaccaaatcgataagtaggtccaggggtacctcgactttacaacttgacaaccatggtttgttatatgtttctatgagaatatcattaggttttttaaccatcaaaccatacatcttgttattgattttgatagctgctaccattgacaggtcatgtggtaaagccacttctacaaatcttgccatttgtaccaaacacgagcaaaacttgcatgggaatgttaaaccctcacagttagcagcaagtggatcctcttattctgttcacagaagtccagtgcttaagcagagacagaatctttctgctaggtctacctctgcagatgtatatactacttttgatgaaaatgtcagagctgtatcttcacatgctgctgaagaaaaggttggagtactcttattaaaccttggtggcccagagacactggatgatgttcagccatttctattcaacctgtttgctgacccagtaagtgatcataccacatgctttatacttgttcattactgactatttgtagccgatttgtcaatgctattcggcaattttcactatttgtatattggtatgtgtgtgttccttttagtttatcattatgtagtcccgtaacgttgactaaaatggtctagtaattcttgaccattaaaaaatggttcagtttattatatcatactatttgaaccaaacaaaaacatgtcaatttgattttattgtgtatgccactatgatatgatgtctggattcagaatttgtctcctatctgttccttatttagtatataatgatttacttatatttgtactgttcaggatatcatccgtttgccaaggctgttcaggtttcttcaaagaccattggccaagcttatctccacttttagagctccaaagagtaaggaggggtacgcttcaatcggtggaggatcacctttgcggaaaattactgatgagcaggtaaaatcttgccatcctaatcacaaacatgtgtggtttgtcaaaacaaatttatcagcttagttaaatattagctttgcctactcataagttttgtgatatgaaaaaaaaaatgtattgttgagtttcctaactcagttaactgtgttacaggcaaatgctttgaaggtggcactgaaaaagaagaatttgaatgctaatatatatgttggaatgcgatactggtacccttttacagaagaagccattgatcaggtgaaacttcctgtctctagaagtcctttaaatccttcatttctttgttaagtctcaaaaacagtgccttgccatttttgttcaattcgttttccatggtaattactttattgtttttcttctaacttacttagatattgctactcaatgttattttaagtatcttcttttcatctgttgttgagtattcagcactcaacagcatatgctgcatcgtaaactttagatatttctgttgttccctgatttttgttgttagtttccaattgattataactgcttctaagttttggttgatcatagattaagaaggataagattacaaagcttgtcgttcttccactgtaccctcaatactccatatcgacaagtggatcaagcatccgtgttctccaaaacattgtcaagtaggctgctttctcatttgaattctcatctagtcatcttccatattactagatctttaaattctaatctttcagacgctgtagatcattaaattataatatttcagatgctgtagatcattaaatattaatatgatggcatcatgcagggaggattcatattttgctggattgccaatttccattatcgaatcatggtaccaacgtgacggttatgtgaaatcaatggctgacttaattgaaaaggaactgtcaattttttccaatcctgaagaggtttgaccattcccttttccttctatttttctccctacagtttcccacctttggattgcagactgtgaacacaatcatagtataccttttttggtagaaatttccttagggatacagtttgacatagttcttgtatttacctgtggacaaaattcgacattagatacatccttaatcttgtctacaactaattttcagtatcactgtttattcaattatgtatgagtacgttgtgacaaccacatcagagaaactaaattatttaatgccaactacttttaagaaaatgcactgtccattttcagctaactttttgtactagactgtggatatagggagtataccatgaaacttgaaccacaaaaatgcattttctgaaatgctacattgtagtgcttacctgcctactgtatatttgactatccagttatccactctagttacgtcaattgatgaagggaaattaacactataattttgtaaatgagtattaatgtatgattcagggtgattcaatagacagtgcaagtatctagttactttgttgtttactcagtctgttataggtacatgtcattttagaatgatacacgtaaacgtaagtctgaccagaattatacaaaaagttggaaattgaatagatagaataagtctgatatactaatcatgattgcaaatttgtaatctttaggttatgatattcttcagtgcacatggagtaccacttacctatgttacggatgctggagatccttacagagatcagatggaggactgcattgctttgatcatgggagagttaaaatccagaggaatcttaaacagccatactctggctccacaggtatcagacatattaacacttatttttatgaggccatcttgtttagaatgaggaaagcatcttagaatatttctaggatatataaagtgttcgtttcatctctttctaaatggctattttttctttgaatgtatcatttgagctttcaccatctagggaattatggactgttgttttattcctttgctttactggttaacacatcattaacctttgtgtgcacacatggcagagtcgagtggggccagttcagtggctgaaaccatatactgatgaagttctagttgaactaggtcaacagggtgtaaagagcctcctggctgttccagtaaggtaataataactgcacatatttcatattttggcgattcagcgttttcttttttttctttggtatttccttaagaacagcaacttaaacctgtatctctttatgatagtttaatcttctgcctgcacttatctcttgatgcacatatattattgtaacccagcaatattttctggtataaaatcattatcaacgtagaaattttgtttcatatggcataagtttcttgttgatggaaggcatatgccattgcttgtgtgtgtgtgtgtgtgtgtgtgtgttgtgttttattttgaatttttctcatgttcactatttactgcatggttaatttgcttatccatcaagtacttacaacgtaaaactggaaactgccctttaggttcatctcattaaccattcaagaatggcttgttcagtttgcatttttcttccctacatcaccttgtgattaccttctagtcctaactaatttatcatcaatcagctttgtgagcgagcacatcgagaccttggaagaaatcgacatggagtacaaagagctggctctagaatcgggcatcgataactggggaagggttccagctcttggatgcacctcatccttcatctccgaccttgctgatgcagtggtcgaatccctgccctccgcttccgctctcgtgaccaagaaggtggacgagagcgattccgacatggacctgatgcactacctgagcaagatgttcttcggctccatcttggcgttcgtcctcctattgtcgccaaggctgatttccgctttccggaacaccctgttgtaggtgatggtggcttcttttgtttggttttttgcactaggggtttggcttgagtaagtagaaaggcaggctcgtgggatgatagtgaatagtgatggttaaagttccccttttttacagaagtaatatgcatgaagtcattgcaaggtagcttaagtggtggttttaagcaaggagcctctaggggtaaattgccagtctgtaccagttttcttgtgctggtacaaggcaagcctatccttttttttctttttttttctttttgttacatgagcacattgataaaacatcattgatatattactaatgcataaacaccataatttttcctcgtttaatcatgttttcccccttttttccaattcaacttctgccgttctgcgtatgtaaagatcgttacagccaggagatgataccggtacggtatgatgagaaaactcgcaaaaggttctctaattcgcaagaaaaatgcaaatgtttgccgagaccggctcagtacatgcgggagaatagatcatataacctccatttagattataaatcctcaatttcaatctgacgtaagggtatacgatcaaattttcgcactatacgcaggccccaatattaattaacctcaccttattatgctctaggatgctagcgcctggtactgccattgtgctttggtttaaaaagttgatcgctgcataacagtataagaagcatgaagtaaattcaggcgatatttcataccgccagcttaaagaaaagcatgcacggactatattcatgtaggcaatataaaggacctgcagttacacatttcttgacacagcatctgtttccaattttacatccctcatactgccaattttgccaaaccagatcacccttttcatccgactcatctccttaatcaacagccacccgacgaatcacgaggcgcaaagttggactcggttgttggtacacagaaagcagggcatatatcaaattgaactagaaaacaattaagcgcgggagccagataaatacaagttgatgatgttgaatctgaattctggagatgagccaggaggtaaatactcctctagaagaacgtcccttctggaggttgcaccaacttgcgattctgcggggttgccatctccttcttgagctgggtaaggatagtctccatggtgtactcgcgctgccagtttgctagaacaccaaacttcctcgagtcaacctataggatcacagcaccaaatgaatatcaatcagagggagtagcctgcacaaaataaataaacttggcatctacatttgggaggagagaataccgctccagtctcatgattaacacacgacatattgattcttgaatgaaaccggacagatggtggcttctctgggtagtccttgtcacagaacagcttcagctggtagatgcgaccttcatggacactctgccagattgaggaagaaacagacacttagtaaaagttaataatattttatataagcagtacaagaggagctaggtggactctcaaactgtcaaacatgagaaagcatctagagctaatatatgtaagttttagcttgtagtagtgattctcctgcctttatggtcaacataaggaagttgaaaagctcaagtgtgcctcttcccagaaatataattccataaccttgtcacacatatcttaatgccattcaaatagcctttttccactaataaagacatcttctccactaataaaaacccaagatgaagcacagtacgacggtaaagatataaagccacaggagaagattttccatatgagtaatatgatatattgtgagtgtatcaggatagagtccataatctcacattatgtggaccaatgatggtgccagtccaagaccgcatgtagatgtcatctgcatcatccattccatagctcacggttccatctccaatgcccttttcaccacgttcaagctcttctagcaacctgaagtttcgcggaactgcaggcattttacatattagtcaactcctcaggatataatgcagttaccctcttaaatctacttatatagaaattgcataatggtgatatcattgcacagaacaaaagaagacaaaatcaacctagaaacagcatgagaagttttcatacccatgcatcaagtactgaattacagagcaaagacggctacaaccgagataaataaaatggcaatatcgattcccagtttcagaatttagtggatttgtagatgattactattttctgaagaaaaaaaaagaataacaccaatgtatcattctcccgaatgagggacaagagcactgcagctcagctgttgttttcttgtgaagcaaaacaaaattgaatatatctgccattggcgtggggggttaacaacaatgcaaaaaaaaaaaaatgtattgttctgtttgcaagacgatgaagaatcttgtgactcgaataccatacacccagaacagatatgtcggcatttgttaaacgcaagtcattgttttatctagtgcacagacactcagagtgcagtggctctaaaacgggcaatcatggttttgacttctcagattgaagcctgaactttgacttgagattgattatacaatgtattatctcaaaacagaatagtagacagaaatagtgtaacttcacacacaaagttcatcagtggaatataatgaacaaataacatgatctttggcaagtagtctgaatcacaaggccgccgaggtgaaacaatttcagtacaattgtttgaatggtgcaaagttccaacttgtgattagaacacaaaaaggcattacgttcaaacctccaaaccggagacgctaaaagctatttaattccatctaggaaagaaaatattaagagaagaccgaacttaacactgcaagaaaaacgcaatatagcattcaatacccaggtttttataaagcacacaacctgcatgcccacacgaaaaaacagatccagcaaaaagaaaccaacacagtctcatccagccgcgatgaggcctatacaacagctatctaaggaaaccatgat

SEQ ID NO: 40920 - DNA, 1033 bp, Oryza sativa
cgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctgggacctctgcgccagccataatggcgctgaccgtgggacactcagcgccagcccacctggcgctgaggtgggacttggccgcaacccccaaggcccagaccagcaagcctgctggatggcttgcgggctgggacctcagcgccagccataatggcgctgactgtgggaaactcagcgccagcccacctggcgctgaggttggacttggccgtttcggccgtggcccagcccagcaagccttctggatggttgggctgggacctcagcgccaggtgcactggcgctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacc

SEQ ID NO: 40921 - DNA, 15392 bp, Oryza sativa
aatttacaatgtaagttttgaaaactacagtgtaaatttgtgtaatacagtgtaaatatatgtaatttacaatgtaaaaaacaattgactattttatggtgaaaaatgtgaagtcaaaaatatagctagtccctgaaaaagaaaagcttgtccactgacgtaaaatactcctccacatacagattccctctcaccattcagtccttggttgcctgcagaccactcaactacgaatcctcccattatttcccacatcaggtccactctattccttcatgtccctacagactggtgccccagaacagagatttatggtaagcttaaaggaaattcataacactgttaacatagctgccatctccaatccatacgatttccagcaatccctggtcttttaagaagttgctaccaattgattcctcccaagatgcatccaaacttaacaccagtaaacccaagctaccatctccaaatcatataacttcaagcaatctccaatcttttcaagaagttagctacatagtgattccttgcaatacatcaatattgatcaaattgcaatcgatgatcaaccaacttcataagacaccagttcatgagcagagccgtatttaacatgtccacagatcaatggtaggatagttgcatgacttcagaatgaacttccacaatgtgaacaaattggaattgttgcagcaagacttggaagttggaatattaatcgaaattaacagtgaggtcagtagattgctttgtgtaacttaccatctttagattgctccgatgcctcttttccagattgtttccccagtctatatttctggtcgaggaagatcaaacttaaatagctgtatttcaaactttgcaagacatgcaaaagtattatgaattacctgaagatgactcttcaagtggaaaagagtgagccccttcacacccattgtcctcaagatagttttaggtgttgcttctgcaagataatcatgcattgagtactcaatttaaaaatatataatgaaatcaaatcttaaactgttttactggattcccctggatttttcacattttagaccttttgggaaacttattttacaaatagaccccaaaaaaaacttactccaggaatagacctttttgcggtgccaacatcattgacgctgtagtccaacatgatggcgccaatgacattggcaccgtccccctagcatccccacagaagctaactcactaatgtaaagggggacggcggtaatatctttggcatcattatgttggaccacggcgccaatgacattggtgtcgcgaaaagggtctattcctggaataagttttttaggggtctatttgtaaaataagtttttagaaaggtctaaaatgtaaaaaaaatccatcttgattcccttagcaattgactaatgataaaccagcaatttagagtgccaacatttactttttttagataatggaataattatcccaggcactgcaccagcaatttagagtgccaacatttactttttttagataatggaataattgtcccagggactgcactagaaagtgcacaaagccacaggcacaaccttttttagactacctacatgattcaattaagatttagaattttgatctagtgtgagtttcgctgtgctactgattatacctcctacaagaaaataaggaacagtacaatacacgcttttctttgtatagacagttgtccaggtgcatagctaaaactaaggccttttatggacggaggtagtaatcacagaagcacttgtaatgttggtctgagatttaaatggttcatcaaaataattagaacctaaaggtaaaagtgaatccttgaatttttataaagaaaatagagtaaattacagaaaactacaggccaaaatttgtgataaatttggtgttaaatctatagtttggtgatattgtggcttaaatatgtaaatttgcatagttctgtgaaatttgaaacaagtcccaagaaaattgacagtagtaaattgaactaaactcatgtcaacaaaattgagtaagacctcaaaggagaaaaatacagccacttctattcactgtatgtccttaataaattttaatgattgaatcaaagacttcttgcagacaccacagtccactaaaatcaaagcatcaagctaaactaaatcagtatagaactattatagctctataccataagttaagcattttggcatgtaagcaccagattctaagaaatacaccaaaaatgcctagactgcgcccaagaaaaatcaaacagtatcatctttgaacaactatgttgtttttaagataaatgaatgcctttattccggcctctgcataagtcatgcatcaaccattagtgattagtcattacaaagttttaggcatagactagcacagacaatgcatagcacccatctcacaaaattcaaacatgaacgaaaaacttatgcacaaaccctatcagtcaactatgtaatatagtcaggttaaaaatatgatgtgtgcagggattactgttcactagtgcaaacagctccatggttacgtgttgaaccaagattcatacatcagatgctagagtaatcaatcctttataacttctgcttctgaataccctttgccaccaaaaacatgattatatgataaaacattcaatgcatactctaggttgattatatacggtggcaagcgcctaacgcctaatcaccaatcaggtggctctaggtggaacgattggctatacaggtgaggcgggagttgcacacctatgcaagctaggcagatgtctttctgaagtactaagcatagcaggtgaaccgtgttggtggcaacaatcaagccgctaccttagggcttattcggttcataggaattccaaatcaaaggaataggtaaagttaagaggtctcacctcatgctaagaatcctacagaattagcttgaaagactacaatccttaggaatttggtaggatccattcctatgaaacgaatgatgcatataggaaaaattcctaaggattcaattcctacaataatcctatgaaaatcctttaaaccgaatgagccattttctccaaatactgatctgctctatgcctgtgccaatgtgagatactgcacctcatcatgtgggaaattgcgaaatcgctgtatttatcccactgcgttcacttacaaaccactgaaataaacccaaaatgagcagaaacttctccctcatccttgtcccaattctaacacccgaaaccaccaccaatttcgtattaacaaaacactcttgattgctaccggtgcagaattcgttaaagtacaggacaagcaagcagctcaaatcagtagccgacctcgatttttcacctccaatcagtaaactccccaaacttgtaatttgtaaacaactaatgggtacaagtttcccctccaaatcacaccaaaaccagcctagagcgggctaaatccgcttccctaagcgctggccaagcgggcatttctctccttgccaaaatcgaagacttattataaccaaacgaaaagatccaaagcatttcctgaatctccgaacaaacaaaacaatgccccccaaatcccgcgccgaaatctccgctcccaatccgagctttggcgcgaaccaccaccaccaccaccaagaacgaaggagcaacccacccacccaccaaccaaccgcgcaagcgcaacgccaatgcgccgcctctccaatgggggagctaagctaccggagatcggagagaatgggggggagagaagcaagggggaaatctcactctcggggccgccgagctgggcgacggcgtcgacgaagcgctcgtggaggtcggccgtccaccggaggcggggcttgggatcggcggtcagcaccaggctgggccctccccccgccgcacgccccgcctcgccgccgtccggccggtggtggatcagcccaggcgggaacatctcctcctctttcttcttcctcctcgccggcaacaaggaagagaagaagagaggaaagacgagacctttgctgctcctcccaaaagcggaggatccaatgaaaagtcccaacgctttctctctctttcttgcttcttgcttctcctctgctgctgcctgctgcctctcccctgctgctgctgctttccagtggcagaggcagcgattctcctctctcctcttgcttctcttcttgacctcttctcttctctctcctctattgcttctttctctctcttcaacttctgtgtttatagattggagggttgtagtataatctggagatggatgggaacagcagtggccataatgatgcgtgttactactagtgcagactgcagagcaacgtcattttcttactgttgttagattattacgccctaacttactactgtcatcagagctaggagtaggtgataattatttgtgattagcacactacagccaccctccctccctccccatcgacgtatagtagcgagtacaatagcaggctacaagtcgagtcgactgtaagcacatgtgaaagagacgtgaaagagagaagataagagagagaaggaaagcaggatttatagccagctgcagcacagaatccaatgcattgtgtgtgtatgagatgtaggatcatacattaatggtgtattatataactattgataaactattagattggatatatacgaattagagctattagttggctatactattaaacttgctctaattgagttcaactcttaggctctgttcgtttactggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcacgtgctaatagactgcttcgttttccgtaccggagggatgggttcccaactcaaccaaaagaacagagccttattaattaactcgtttagtatggaattaaagtacaacgtctcaattatgctctcctagctcggcttaaatcatgaaaacattagaatctggtcgtttgcttgctgttttagagcacgctctaaaaattaacgcgtcattttcaaccagtttaatagtctatccatgttataaatatatgatatattgtaacctgattttcatcttaaatctataacctgattttttttctctctcctcttctccattcttaacctaagcataaatttgatttggtaatttttagagtctgctttcatcatttattatactcgcttttaaaacttaatttttaaagttaattttgagattttttttatcaacttatttttagtcttcttggcttttaaatcgatagcagcacacatagatgttttatccatgataatttataggtgtttagtttatttttccactgacttgttagcactatatcaaactatcatagcattaagagcaagtttagtagtatagcccactacttactataagccaatgttaaagctaacatgtataatagcttatgctttcatcataagatactccctccatctacttttgatagtcatatttccaaatctaaaaattttatttttgataagcatatttcacttcaacaacttatcattttaatgactttctcagatttaatgcatgactctccattcttccacacatgattggctacatgggcattgagaaacgtaaatataaatgaatcgcttgtttacgaggaatgactagtagcatgtttatatggatgataagtagaattacttatccttggtctgtgtgccaagatgaaatatgactatcaaaagtagatggagggagtaggatttatttttttcatcatctctctttatctctttatgaatttaatgcttatttcttggagcttgtgtggagctagctcttgcatgagagccaacactccctattttttttatctctctttttcacataagcatttagcttgcttatagctcacttagctcactgtaatccttgctctaacacaaacacaagtcaattaattgtagaaaatatataataattgggtttcttgcactttggtgctgaggtaggtattgggagctgggcaaatgattggtgcatggaaaattcagcctggcctctcttatctgtctaccatctcccaatctctatctctgtgtgtgtgtgtgtgtgtgtgtggcgtttggtgatgctagcaaattgacaaatgggattagtttaattggggtttttttgtgccctttttgcttagaaaaaaagctagtgggtggaggatcatgtgagagctgaacagacagctgagtggcccttctccatttgtttaattttctttcgcgtgttatttaatttgtaaaaacccttgcttacatcggctttgcacatgctcaatgtccatatccagacgtcatgtgtgtttcaacgcgtacaaatgcaggaaatgtggtgcttcaaatggtctctttcaccttgctaagagtgtatatacaatagacctaaattagtaataaagctatcagcctgattacatcggaatttgtttgtcgtgtcgactaaaagctgtgttgcgctggggttttcaacttatctctctcattttcgcacgcacgcttttcaaactgctaaacggtaaataatgtgtgacaaacaacgtgtaagcttccgattgtgttctcttaatttgtgttgggtacttgggtgttggggtcaaaccatgagaaaagaatcaagtatatgattgttgggaggatgtatgtagtccgggtgagactggtatgaaaatggaaaatgtacaaaatgcaaattatgtatattttgttagggaccactattttgtgaagattgcttgtacggtgatgcctctagctatatatgatagaggtggtatgtagacaattgaggatgggagctaagctccaaattaagttcgatgggctgactctacggctatattcttctcgatgagttgggaactcatctcccaggcacacagaacagaacgactcattagcacatgattaattaaatattaactattttttttaaaaaaatagattaatatgatttttaaagcaacttttttataggaaacttaaaaaaaactgtttagctgtttgaaaaacgtgcacgcggaaaaaagagataggtgagttggaaaagaagggaagaacacaaactacgtatatatagagctaaagttgagttagaaatatttagaagagaatatatgccaaagatgctgatgtcatatttttttacaggagattgactcgaccagggaaatatatacaaaagacaaaataataagcttattaaaatttgatgtgttttgcatatattatccttccctatcaatacaaacgatgcaaagcttttgcccttttaaaaaagatataattaatgattgatgcatagatttttctatgaacttaacaaaccaaaaaaaccattttgtatgtcaacagtgtgacatgcagtctcctagcattgtcacgttatcaaaatcatagacagaaagagaatgtgaaagaaggtagcacactacgattttctatttatattttcttgaacctttttaattttcaattaaaaaataaaccaattctaaacttattttcaaatcttaaacttttggtcacgccacgtggtaagacaaattgctgttattgttttggggttgtgtggccaaaaagatgatttagaaataagtaatgatctattttgtaaattaaatcattaaaaagtttaaaaataataaaaattcgtaccctacaagatcctaatttttacctaggtgtttataccatcggccacctataaaaaccgtcggccttgtatatttctaagcgtatatcatcggccactactccctctctgtttcaaagtagttacttatgatcatctatgcgtatagcgtagaagatatgtttttcaaatgtaaaaattgctttgttttaggatccctttgaatcgtagggttgaaaaaatagagaaaaagggagaaacacatgattctgataggaattgaagtgtaaaacagaggattgtaaaacacataaaaaaactcaggaatgatcatttgattagaccgcaagaaaaaacgcaggaattagatgcgggagatagactcaaaggaaattttccaagaggttggagctcttgctaagtttcctctaaaatccacatgcaatgtgtcattacataggatttgaaaaacttcaatcctttgaatctgtgtcattacataggatttgaaaaacttcaatcctttgaatcaaagggctaatagaaaaatttcctataggatttaaatcatatgaaattcctacgtaagtcctttatttactttagagcagagataatatttctctcttgatacagaggataaaatattcttacgaacgaccggtatttagcaaatatcctatatttagcaaaataggatggacgctaattctaatagcgtccaaaaaaaggacgttgctttccatagcgaccaggtctggacgtcgttcacctcagcgtccagctatgttgtgcagcctaactatcccaaagccatatccattctatatacgagaaatagaagcgaggaatccctgcagggagaactggtgcggcatcgaggattcgaggctagggcctagggcagttactggcttactgccgccgatccaacaggaggagactgggaagtgggaagccgctgctgtccccgccttgtcgggagcctgatatggcgatatccgccaaggacacaagaaccatatctatcagttcttttagaaacgacaagtaattttaggattagtagtggaaatctaagttataatttttgcctggggttgtagttaatggtgctgttgtagctcaaagatgtgttttagtttagaagcatatgtatgtgtattcatgagagtttcagactttctatgactcttttctgtttgattggttctatgtgtactagtactgaattacttacacgcccatagtcatatgatctattgtttggtactgttgtgatattcttctgtagtgtgaagtttggaagcatgcacgtattctgaaatccgaaatactcaattatatgaatggacttatttttcttctgcttcatgtgaatacccacaaaaatagttacatctgtatttcatctgagttgcgaggcagtgcgtgagcttcttcaataacgattaacgcacaagaactcattgtgcctgttcccagcctgggcctgccatcggcggcacaggtgaacggcggaaacgaaagcttcatggacggaagcttcatgccttcattacagcgagatgccgagggcggcaggcgacaaacggaaaatttcaagggctgccgcttagtccaatcctgcctgggaggcgagcgtcgcctaccaaatactccagttgtttgtgttaacgacgagatatatgggtatacgtagttttttctttctgtattttatgggatataggttggtaggcggcgccagacagtggacgctgagatgaacaacgtccagaggtggacgtcgaggtgaacagcgtccactcctggacgctattagagttagtgtccatcctattttactaaataagagctcttagggagtgtttgaggagaaggggattgaggagattgggaagatatgcaaaacgaggtgagccattagctcatgattaattgagtattaactattttaaattccaaaaatggattaatatgattttttaaagcaactttcctattaaaattttttgcaaaaaacgcaccgtttagtagtttgaaaagcgtgcgcgcggaaaacgagacacaatctctcctatctccacctaacgaacagagccttatttaccacatatttaatttgtaaattattaattactataaataaaaaaattggggtctacaggctacagctccaatgagcatcgaagtggtttaattaatgatcgatgcaataaaaaaaatgattatccgataatatatatcactgtatcgggacgaattatcactccaggattcatgggcttaattcatcgtaggattcttgtttgattaattaattagataaagtttggagtttcttcaagacaaaacaaaatgagatcgagtaatgataccgtaccaacaactagtggaacttagaacggactaaaagtttgcatttaaaaattttgggtgatgctgatgagtggctcagtcgtaggaggatagaaaatagagcctgtgttactaaacactgccatactacaggtaagtgctattggctgtctacactctttggggtgggtaatgtttgtaatttataatccctcattttttatatatatgtttttcgaactattaaggtttgtacatgaaagttatttaaaaatatatatttgtcatttatgtaagtttttatagctgatacttctaattaattatgcgctaataagccatactgttttaatcgcgcacgagagaaagttccattgcacattgaagaaattaaagacaaacttgttcgaaattgggctattattcttcatttctggatttagtgcagtcgcttggggagctggggttgtgagaggaacgagaagacgaggaatggaggcaagactgcaagatacgcgaggattacgtgcatactcttgtgttgactgctgccctagtctctaatgggtctcaaacaaaacatacacatatacatggtttggggggcctccgtcgcccctctcgccatggcctaggaacggccctggtctagacttaaccctagctcaaaaaagcaaatgatcaacactcagactataacaagccgattatattaaataactccctctaggaaatccaacaacttgaaaaaaattccacgcttttttattaattttttctttttactgaaaattttggtgcagctcttttctttctttcttctttttttcaccttctgccttttcttttctttttgtttctctcttttttttacaagcagctgttctgcgcaaggagaagccaacaatcggcttataaaattacaaaccaatttaaagaaaaccgaaaagaaaagcggctactcggtggacatagtggaatgcatgcgcatgtgtactgctatggaaatattcatccgttggttgatattgaaggagaggttggtaccaaattaaacgagatagcgatcaaaggaaaaaattgcatgcggaaatctcggcaggaaggaaatggtcacgcaacaatttcaagatttcagaaacaaaaccaccgtatagaaggctgatcttctatttttcatgtgcacatcatgtctggctgtcagtagagatatcaatctaatctcaatgataggcacatagatgagctcctctagaaacactgtagaacaacacccagcacataatcctcaccaagcaattgacgatctgataccaaccgatgacaccctctctcgggcccgatcttctggtgagaggataactctcgcttttatcgaatgtgatatttgcgacgtggctaccaaccagaacaggttcaggatgtcgtgcaatcactacaccacaaacgatgtcataccaaccgtgacgcgtggttgataatccctgcaatgcaaacgagagaacattgcaagaacaagataatatacgatctaaatattgcgaataggtaattaagcacaacgaagtagttgcaattgaagtggtagatataatctacccggcaaatcaacacaccaactattggggtctctgaatctatagtcgccaactaatcgaacaaggattagagacaaggtaaatagcacttggaaaaattcaactaaataaaacccaattgttttttaggtgtacaaagctatttatagatgaaaataaagctagagataggtgttggttcatggaggtggatagagacacttctgagatgggactagtatattacaaggcccaaggcacaagttcggtttcagcaataacacaatattattttgacaattcccattgatttaggatgaattttgatatgatatcagatgggtttgaaaggtgaggagataggctttccaacaagtactagatcatccaaatcggagttggcatgaaggcgctaggtccgttcgaagtcaatgttgtctctgcctttggaggccgaacaggactttgacttgttattggaacttgtgaaattatgtgtgtatccgatgaagtgatgtcctcatcagcaaacaaggctaaaactcgacaatggattcattgtaggaacactcatttgataactaagcatagcttcaaagaagaagctgcaaatttgtcaaacaagcatcgaatcatcgcggaacaaaaaagaatatccaatccgaacaaaatccagaaatagctaaacccaatccctaatctgaatcattttgatacaccatacaaacagaacccaagccacatcacgcccaaatccaacccacgacatcgtctccgttagcgattaggcactcggcgatgttgtgcaagccacggagcgcggcatgcagttgttgtagtcatgagcattcatgagcacggaatcctcctccaatagcttcatcatggcgtcggcgtcattctggtgcatatgccacatgatcagcgacgtctgcaccactagcctcttgtcgtcgaaccgccactgctccctgctgcttctcgatgactccgtcctgctcatctctgtcacgcccagaaattcatgaaccagaatttctaagctgaatgtgcaataaatccctgtccaggaccagccagggtacacaaacgacaattgttgacatacagacccatgtcttacaaaaaatagaaaagattacaaatgcagcggaaaagataaaacaaactaaacttggacgcttgacttctgcagcagggcaactccactccacaggcatcccttgacggtagcgacgaaaccaaccctaacaagacagctccaacttggaagatcttcagctctggtgtgggggaaaagagagcaagactgagtactacccactgtactcaacaagtcataccggaagagaaggtatgatgcaggatataaccaaaggaggctaagggttcttttgcaataaagcaggcatttaaaaacaaaagttgaaagcagtaaaaaaattgtagtagattaagcaatattaaccaatcactgtccaacgctacaccacgttgcaacaggcccaaccaaccacctgaactacaccagttcattaagctaaactagggtgagactaatcacggtgaatctagttgatcgcccataaccgcgggcacgactattcgaatagttttactctggccagaggtgtacaactgtacctagaagacaagattccacacatgtcgccatgccccgaagtatcaccatgatactgcaaagggggaaatcatgacaagaccctccgcataaccctcccctaaccattcacaccacgctaaggtttcacccccacccccaacgggcaatgggcggtcccctcttgcgccgcggtaaatctggcagctggacaaccggacaccccggccgacccaactccatcacgcccaccctcgccaccggtgcctaggaaagggtcaagctatacttcagatcaagcagttacccactcccgcttgtggtaagcacagtaagtctcccagggtttcccgtgaaccagttcttaattgccatgggtgcgaccagcaaaaccatgcacccacagcccaccatttagtgtattttaattaactaacaccattgcggtggcaccaatccaaaactatgctattagtcaaagtctatgtaataatgtgatccccatttgtgtactagttgaactaggcatggctaagcatttcctaaaccaacatctaatctttctgatacccaagttatcaatggcataaggtaaacaatatatgcgggatatttgtaaattaggtataatatgatcaattgtaatgcatgacttgccttgctctcgcactgatgagaccacagcaacgtcttcgagaaaccgcggatcgacgaaatggccgaaatctacgcgacaaacagagcacataagcaaaacacactataagactactgaaacaggaaacaaaaccatttttaatggattctagggatttttatgaatttactgagacttgaatggacttaaacggagctcggatgaattacttatgaattttagaagataaactgtgtttttactaataaagaaaagcctaaataacttttattgcgcaatattacctagggctgacgtcagcgagagggggcggctcggcaggcgggccccgcatgtcagcggcacaaggggagagggagggggcgccggcacatgggccccataggcagtggctaaaagtgggcggggtggtccaccggttggttggccccactggggcagcagcacaaggcgggggagggggtgccggctgctggctcggcacggctcaagccggccggccatgacgaggcggcgatggcgcacgaccgacgacgacggcaagcggcggcgcgagaggcggcgcggacggcgcgaaaggtggcggcgtcggccgaaggcgacggcgcacacgcggagggtggctgcgctcatgggagggaggaaaggaagaaggagaggggatcccttaccgaggcgatgacggcgatcggcgcgggaagagacgagcggcggcgacggtttggagaacggtggacggggtcgggcacaacctgggaaaggcgatgactaggttaggagaagggaaggatgaccacggtgactagaacggccggccggagttgggcggaaatggagagctcaccggcgtgcgagggaggcggcgcttcggcgagtttggctgcaagcgagcggtggccgaggtagcacttgcggcagcggagctaacggcggcggcggcttggcgcggcggaggccctagcggcgacggcgcgtggccggagatgggcagcggcggcggagctcgggtgtggcgtggggagagcggcggagtgcacgggcaagcgcggcaatagcggaaaaaggtcgagggggctcgagggagtgatttataggtgcggaagggggcggacgtggccggggaggtggccgatttggccggcgatgtggggtggagagaaagagagagtggggtgggattcaaaatgaatcccgcccatttttgggcgcgtgcgagggcgggaggagcggggaaggggcggcgacgtgggcgcagggcgcggagtgggcgcggggaggcgggaaaggcggtggcatgggcggttgccgccggggcgcggtcggctggaggaaggggacgaccccgacaggtggggcccacctgtcggcatcccggaggg

SEQ ID NO: 40922 - DNA, 12310 bp, Oryza sativa
agatataaaagacatttttcctaattgaccaaatttgcaatgacatagatccaattaaccatttcctttttggccccctcccttttggtctcaacaatcaacatcaaggcacagccaaaactcaggtatcttgatatcattgataattgttgctatatgaagcaaagctttactagtgtatcatcacactacagttttcaaacagcccataatttcattttatcctttgccgggggcactaaattgccatatattaataaatgacatttattcctagccacctatcattttcagcatgcaaatacatacttacccaaattcatcaaacacaatgcatgtagcattcacttgtgacagctccttaatttccaaagaatcatcttctaatatcgcctgtttatttttcatgtcatttctccagacaagatataatgtggtgaaatgaatcctgtgaagtagtcatgatgtaaggaatcatgtgccttattatgtttagatatgaaaagacatgtgtttcccctcaaaaaaaatccaaaaatgaaccattatttgtgactaaagaaaaaagaaaaactgatcagttaatatggcaacaatttttgttaatatctatgattccaaagttagatgcactggcaatgacagcataagggattaaaagcaccttatctcccctcaccactgccttgtccaatgtccaaccttgcccttctttccttctctactacacgtgcatacacccttgctagcctccctacatttcccatttccatcaccatgaataggttgcagcacatcgattgaatatcacaattttaatgtgaatatatatatatgcagagtgaagcagaggaacttggatgatgcgtgctgaagttatcatggaacaggtttttgcttcaccatactcatgcaactttcttcaaaatcaattatgtttaggatttgcaaccatattcctttagatctatgatttgattaatgatttgtttgtggtattacaatcatttagagtggattcaacccgttctcttatatctattgtgtgtaaggattttacaatcacatttcttcagatccatgattttagtagactacgtgtgatataattatcatttagggtgtatacaacctatttttttagatctatcatatgtttatatcttttacaagcagattcctttaaacacttgattcaactagtaagattgtactgtactaaatgtgttgctatcatttattagggaccaaaacagattggtagtgtgtgcaatggctttatttaaaaaaaatatctcttttgtgtgtagatgattgttatatctcctcacaatacaaaatattgatcttaaagccaaacttgatttggcaagaacaaataacccttaaaacacataacacatttaattttctattaaactaagaacttactatatatcgcaagatatatgggcctcatatgaaaaggagtattatggatagtgttagaagaggtgccaaaatttagttaaaatgattaaaagagtgcagccaataaatatggactaagcaagaaagaaagctcctctaaacattttttccgaaaatgttcttttagttgcaaaacaaattgtagcatgacaataccaagcgtctaattgcgctgaatgcattcatcttatttaactatgtgtttttttatatggggttgtttgtgaatttaaccctcctagtggagttttcaccgtaggctaatggaacttgaaaatattccacctaaaagcacccaggctgtaaaaaaaaaaatcatatcttctatataattgatgctgactagctactaaactcaatatatgagtgtaacacatcatcattcagtagcaattaatgcctaaagtattttaaatgttatacaagtatagtacatcatctatattttattatattttagaactcaacatgtaagcatggcagatcatctcacatcatttgatatacatatccatcatttctataagagctctttttccatccttgaggaagtaccatgaggtaccatgaagtactaggtaccatgaggtaccaatctaatctagccattgattaagcaggggcatgattggaaaaataagtcaatagacaagattatcgttcattggtccttccaatcggcaccacccaaatcgccaatagcgatatagagcgccgcaatccctttccgtctgtcatgagttctcgcccaaattgctaaaagcaaggtgacgccaccgctgggagtgcccgagcccaacgccgaccccttttctcagttccgctgccgccgccggcggatagatattagtaaggaattggtgaatacgcatgttgtgtttaggcaatatggtgcctgctattaataattgaagtcgtgtatctttgggtggtgattatgcgaattgattttattagtaattgaagttaaattccagtggagccgtagctgccgcctgatggtatgatgcaattagctaatttcaaaccaaacttgatactgtccattgaacagagggagatagtataacagcacaaactgctactacatatagttttgacgagattacatcaaagggaggcagtacatattaccaaacaaaataatgatgttcatcctgtcatccatcacacaaattaagaacatagaccttgagactaaaatcatcagctttacctatgtttcctcctaaaaccatcagcttcttatagctaattccatccgcagcagcaacgaaaacatgcaaaaatatgaacctgaagcttcggcggtagcctcactctccattcagtagggccctcgatctccattattcggcagcaccctagccgtagcggctcgctcgacgacttatcacgatgcagcaagtgacgttgaccacgccaaattcacacctccccaatccccaccccgcgtgcggccgattcacttccacagattgacgagaggagcaagcatgaccggatggagggatctgaccgggagtgcttgatgaagatatgctttccccctcatctgagatggatctgaacttggaacgggctccatctcttatttgcaacgtgtgttgagaaggaagagacgcagacagatgcgggcggaagagacgcggaagaggagccccttctctcgctgctgcgcgtggtgatgcactaatgcggaagagaacgcgaaagtacaattctaccctcccacctacggtaccgcctcaatctgggtatgcggtaccacgcggtatgaataaattccagtcgtccgatgctaccaaatcgatggccatgatttggtaccgcatgccctcaaggatggtaaaaaatctttttctataatattagcatgcatgtgcttaactctaaaatatatggatggatatatgctaagttttataaatatgatagatagaaatgttgaaatattgtggaaatggtgttgatttgtagtattcaataaatcgtactcccttcatctcaaaacataagaagtttttgttgaatgtgacacattctaatactacgaatctggataaactagtatgtgtttcatgtaatcaaaactctttatattttgagatagatggagtatacatatgatattgtaagcttataagatttgatatgcattaattattgtccagtgataagccatgcttgcatccattttctcggcaaacgaaaaaaaacacggaatggaaaaatagtaaagggcagcaagaaaaaaaatggaaaaacaattgcagagagagagagagagagagcacccatccatcttcccggaggcgaaaccctaacccacccaacccatcgccgccggcgaaaaccctaatccatccgccgccgaaccgaagtacacggtgccctctgctccctcccacgctcgatccactacccgctgctgttgacgggaatgcggtttccctgacgaaatcgcggttcggcttcttggttcttgcagatggggagacctcgaggccgcggcggaggaggaggaggagggagggggaggttcggcggcggcggggggtcccgcttctccgccgcccgcgatgacccgccgccgcggcgctcctcctccgggtggggggtggcaccgccgtcgcggcacctgtgggtgggcagcctctccccgggcgtcgccgcggccgacctctcggagctcttcctccggtgcggcgacgtcgagggcatctcccgtgaccccggccggagcttcgcgttcgtgacgttcgcgcgggaggaggacgccgtggcggcggtgcgggagctgcaggggatccacctccgcggggcgcccattaggatcgagttttccaagggggttagtgtcgatcgtcctcctcccgcccccttcgccacggtttgccacgcttttaccgaattgttcatcatattccctgtctcaaaatcaccagtatccaccaatgaattgtgcttatcttgtcatggttgcaaacacgaatcgccgaaaaataaagcaaaaactatgtttcacaacagaccaagtgtcgcgataagttaaaattggtttggagttttgctcttagtcaaaaatcagaccaaaacaggatcaacctagtatgcttgaacaatgaactataagttctccgttctcaggcatgctcggataacacagaaccttaattttgttcatttatccgcatccttgctatcatacgagtctttcatacaaagagacttgtcagacctttggtttcactgaaacggatagttcattcccactatgtttgttcatcaccgaccaataaaaggtcgaatgctctacagagaggaagactgacaactcagattgcagatagttaggactactattacatggttttcccttgttatcccactgggaactaaagttctcgaactcaatcaaagattcaaagttcactaattgtgataagcacaacagttagctgatgtctcaagtctgtgaatctacaaggagttaacttccataacaccaaagctccaaaaacagggattttagatctgatgcagtacattgctgtggcctgactgcctgagtgataaaaatttggggaaaatatattgcatatgaaactatctggatattcagttttgcgcacatataagcaaatttaaacagctcatgagacatcaatgaaggccttccgaaatcccagaacgtcaagatcatttaataatcttggcatgcccacattaatatttttgggctagtcggtaccctttctatcttctgcagcttatgttttaagtttgagatggaactcaaattctattatgaagaagataatctctccttgcttggttaaatagagaatgcatatgacaaccactttgctatggtataccggtgcaggacttggtttccataaattaccacaggcactcacaagagctttttgctattattgtgcaaccagaatagtctcatttaaatccttaggcattctattaattgacagaaaataacagcactagtttaggaaatgtgattgaaatgctcaatatttagtttggtctgaaggaccatgttgaagttgccacttgcacatggctgaatctaacagatcaatcttcacctttctcacccttcatgtcatgacaagaactaacacccaaccagaataatatcatttgaatcctgatgcattctattaaatgacagaaaatgacagtggttcagcaaatttgattgaaattatcaatgtttagtttggtctgaaggacaaggactacgagatgttgccacttgcacaggcttaatctaacagattaatcttcacctttctcaccctttatgtcgcgatacatgctaacaattgcaataatatataggttcatctatatccctattaaaagcagggtttgttactttgttagtagtgctttggtttatttgtggcatagaaatgcatacgtttgtcttgactagctttgtggcttgaattcacatagtgtatgagacagttttgcaattgatcacaggttatcaatcgagctttttgggtagttgaattgttgtaaatagctctatttccatgaagtttgatcagtgatacaccataccaccttgatgctaaaactgagccaaagattcatgtcagatgatggaactatatcttaatcaatgcagcatcaatattgaactgtctcgtgatgttgtaaatatggaactataccttcgtaaagtttgatacaccatacaatctagtttgatacaccatacaatcttatgttgttatactaatattgagccaaaggttcatttcagatgatggaactatatctcacccaatttcatcatcaatatcaaactggcttgagttttttttccccaaaaaaaagacttcatacaaaactcctagttaaaaacctgccattaaagatgacccaaaagtgccataacactataacagaagtcttgttcatgatatagaaattatagaacaaatatgatattattacagatgatattcacaacagcagaagtaccaaatttctacattgttgtccttgtgatttatgagtatcaaatgaaaaatggattctagcacttgatagagttgatcccaactctccttttgtggccttattccaagtttgaaacagcaggctgtgattgcggttctatgtggttgtttgactgattatttcttatcattcatattgttttaaactgcatctggtagggctaattgatcagaagcagcatggacataggtagagcagaccaatcttatgtcctagagcttgtcagttaaatagcaatatgagcatacaagtacttatggtatctgtgttcatcatgatccatttgctactctggacctgaaatatttgaatttacaggataaaggttcaagtagctctatggatgacagatactcacaacatgctgatcaaagacgttttactgaacgaggaaggaatcagcaatcaagtcctgaaaaatcaactgataaatccaaaagaagcaggccagcagaacctagtgaagtattatggataggttttcctgttggtctgaaggtagatgaggcaactctctgggaagccttttcaccttttggtgaggttgtcaagataactacattcccagggcgtacttatgcatttgtccagtacactactattgcagcggcatgcagggcgaaggaaacactgcagggaaatattttcaataaccctcgagttagcatttgcttttctcggagtgacagtgtttcagcagaatttggaaaaggttccttagatgccccatattccccccatttaaactctagtgttagacctatattcagggagcaagattttgaagattttcctagggctaggccttttgatagtcctccaagagatatgtacatgccatctccacattatggccctaagagactttctagagatcatgatgatgtgggtttcagcagggataattatttgcgatatggacctggagtagagcctgatcctagatctaattttgaaccttttaggatacaagggctcggtccagaaagaaggatgtctgaggacccatatgaacagcataggcgtagccctgctggtgatgcaccatggcacaacattccattcgagcgatctcagggagccttaccattagaggattctcggtatgctagggaagatccatacccattttcaaagaagttgaggactggtgaagcacatgactctgaacttcctgaataccctttctctgaatttgatcgagggaaggttggctctgcctacccaaggaggcccttctatggtgtgccagatgatgacatacaccccagaggctatcaacttgctcctatgcatggtagaaatcatgttgatcctttaaggaatccaactccacttgtagataggcatataccagggcatgcacaggacagcttttctaggcatgtagaagtggaaagatcaactcctgaataccatgaaccccttctcaaggaagaatggaaatgggatggtacaatagcaaagggaggcacaccaatttgccgagcgcgatgcttccctgttgggaaggttcttaacttcatgctgtaagtctgggttcttcactgtattttcttgttcattctgagtatcattattgacatctacaacattagctctgcttatcgtcttaataaaaatcacaaaatttccttcatggttcaagatatataatacatagcaaatatatcatagatatcgttttgccttttacatctaatttatactgcatgcttttgtttgcacctgatgaaggcttttgtagagctatgttttgttcacgttgttcttgatttaattatatctctgcaccatttgcctctactcataatcttaataaatacagacgtttgccttcacggtccaaactacataatctagttgatcaatttctatctgcattcttttggttgtatctgatgagatgcctttggtgtttatgctctgttctattgttctagatttgagcatctctaagttcaacatttagttttaaaccgctgttgatttcatactttcaggcccgaatttttggattgcactgctaggacaagcctggagatgctctctaagcactattaccaagctgccagcagctgggtggtgttttttgttccagaaaatgatgctgacatggcagcctataatgaattcatgaattaccttggtgataagcagcgtgcagcagtttgtaaacttggagaaaggagcagcttatttcttgttccaccctcagacttctctgaacaagtactgagggttccaggtaaagtcagcatatctggagtcattctgaagtttgagcagtcagatccagaagtttcctcgccaactcgcaaaccagaaacatttgtgagtcatttgaaccatgatgttcgtgctcatgaggatctagatgcattgagaagaatcaacccaccagatatcaggccacttcctcagggttcagattatctcgggttgtcgcctggaagctataatccagcaagtgcacatttggttccgccttacaagtttggaaatgctccttcatatctagaatctgaattagctcatcaaaagcatccacctgactcccacagggagatagcacatgacaagcagcagcaacacccagatgtattgccctcaagatggtcagataacatttacaatccaagtccaggttctggaaatttgaattatttggctgagagtgcgatcccacatacatcaactgataggacaccagaggcatactcatttgctcctcaaggagtaccaaaagtgagtacatcagggtatgcaccagttgcagatgaggcatcaaacatgtcctaccctcccatgcaacctgcatcacagcaggtagttagacctcaacaacctccatctctcccattatcgcttccaccagagcaacttgcacaattggccactcttcttgcacaacaaaaccaaccaggaaaagagcctgtggacagcttaaacaaagaatcaggattcatacggaatccacatggacattcttcaatgatgccacacagctcaggttctatccctgtccaaaactcattgccacctgctccgccatctgcatcacagttacaggttcatgcgccaccagttcaaggttcagtgccaccaaatccatccattatgcatacaccgaatgctcctatgccttctcacaacactttgcctttaccccctatgcatccttcgggaaatccagctcattcttccatgcctttgagatcgttcgtccctcctcttcctgaaggccctccaccccttaggcagcacacatcaagtgctctacaagcgcaacctgcacttccctctggaccacagactagccagcaaccgtctgctcaggaagaccatcacggagaccctcaaaagcgccttcaagcaacattgcaattggcagcaaccctacttcagcagatacagcaacaatctaaacctggtggccagaagtagatgcgaggtaattgtttgcctaaagatctcttttaatttctgtaccatttacacaagaatatgaatcattgtcctatttgaaccaaatcgtttatgccatcaatgtaattgctaaatggtttgtatattgtttaggagaaactcttgccttgtattggtccgttggtcattgttttccaaacttttacatgataatcaaacatcaaggacattgcattatcatttttactcttaatgcctgtctttacacaagtgttgtatttctgtcacctgctagatagaattatgtttggaaccctggctgtcaattaaccagtgaatgaaatttcggttcaaaatttcagaaacaatttcattattttcgaaccccctggccagtcattctctcagccgaaattttccagtttttctctctttttttttaatttggtaaaagtttattcaaattcagtcaaattatgttaattttttcaaaaaaaaaaatcagtccaaaaagtgccgaaaatcctgaattttctggaatttcagtgctaccgaaatggctgagattttaagcgaaatcaaaagtgaaaaccctgttattaacatataaattttaaggggaaaagatatttgttgaagaagcaggatgcaatccctctctgtatgtgatacatttaattcgtctgagtatatatatattcgtaaactagtgggacttgggcaattatgagttggaactattttatttactttctcatgtttatgtagtaattgtggcaaaagcaggacaactttagtgagatatatttagtatgcttgatttaaactaaaaaattttcaatacatcatttgtgcttatgctgatgatattttcaaatgccatagtctgaacccgctcttcaatttcagcattccatgtcagtagtagaaacaagaaccacctttatttgctgcaatcaccacttacaacagttatattacctgtcatgacaggttaaggaaatttgcagcctgcaaggatcatatggtgatattttctccttattactgaagagcctgagagtctgaaactgctggtgggcacccatacctataccggatgttttgttaacataggttctgctatgaattagcattgcagtttaattttgaaagcttactcctaggtggcaaccacctccgttgtcttgtctgtataagattgcaccgttcatcttttctctctgtttttgtgttaatcaatgcatagacccatgaataccacttccctttttgcattcatacatcatgcattcgtctcatcgatgtgtcgtctctctgaaattccttttgcatgcttccgctgttcgcctgtatgttttttgacagtgtggtgtacgcctccattcatgaggaatactagtagtgtatactaccttcgtctcaaaataagtttactttgtacactgtctagattcatgtacaaaagcaaacttattttgggactaggtagtatatctcattgaatacaacaattttgtgggcagttattatgaactagactgtgaacagagcatcccaaaagatgtcctccgcaggtaagattgaagtgcaagaagagggaaatgcatatgccattctactgtctactgtactgaaacaagcttactgctatggaatttggagtactccctgggatgcctatccttcagattttattaaggggtttcccatgatgcaggggtgggagctttattaacctttgtgtgctgtaaattctttcactactttcagtgcacaccagctttatctctctgccatgtatggtctgtctgctaaagtgcatagcctatatatttgctgttactgcaaactttagcttgttaaaagtgttcatctgtagtatcagagttcagagttccatggaacagcattgcagcagccaatctttctcactttccttttttttatgtactattgttttaagtactcttggtctcaacccaatgatggccctatgtgtggcttcagtgctttgagatttatttaattctgctttgtttgctgaaagcaaggcaaattcgtacgggtgattcaggcgattgttgcctggtccttttttttatgagaggatttttatttatttatttcttgggtatgagaggaaacctagcagcaagccagaagttatggatataagattcttgcagaaatataaaattatggaggacatttttcgtccttcatatactgtacaaaacccttaaaaaaaaacaaggagaacgagtagacgacacatcaacgagaagctttcttgtacaaattgtgctgataatgttaggccgtttgaaacctaggaatttcatac

SEQ ID NO: 40923 - DNA, 17011 bp, Oryza sativa
taatgtgtcgagggatgttcactgttcttgcattgtcttccaaatattgcattgtcttccaaatagttatgaaaaaaattaaaaaaaatataagatagattaatgtgtgatatattactttacaaatatgcattcaaattcaatattcacaagttgtaacaaaaataataaattaagctctaattagtatacgtgtgctcactatcatatttgttttgcagaagtcaaatttagacgtgtacgttggcagagtgatataccatatattaatctatttatcaattttttctacttttatataaatatttgcatggagcatcaattggaatatccatgccaccctttcgaaactactacgatttcttcgtaagattatttcttaatctacattggttaggtaacttttcccaagctatttgttactctatccatcccataatataagggaccagattcatttcactataatgcgtcacatccacccaaaataccttatattatggaacagaggaagtggctttgtaatatataattttaattttaattaatttctataagcaactgtccatattttcgatcttaaaaactgcattgtaagctgaatttcgcccatcaatttaaattatatatttgtctatgatttgcctttttcaactttatatctcacattttagtgacatgtaataagtcgaagatcccaatccaattaggccattaacagcacacacatgtggcattcagcccaacccataacacgtaggagattcacgtagccaaacgaggtccatgtagccaaagctgggcgtgcattcttttgatgaaaagctatcatgcatcgcgggggagaacgatgcggccacgctgtggaagtcgtcgccttgcacttcgtggcatggtgcgacgcccccaccccacaccccgtgcgagatggtgggggtcgttgttggcgaggccaccaccctgagctcgatgggacaacgtcgacgccagagagagctgttgctgtgctggagagggagctcagggtggttggatccatgacggagatggttagatccatgccggagagtgagccttgttgtcgccgttgagctctttctcaccatcgccgacctgctgcccgtcgccccgtcagatccgttggggagagagagagagaggagagaggtgcgtgcagcggggtgagcggcgtcgataatggggaaaaggagagtggcactggttgtgggggataggggggacggcgccgcctcctgccaccgagctcccgctgtcccctgctaccgagccaccgacctcgccgtcccccgctaccgcgccaggccccgccgctggtcagaggaggagaggtggatccccgatggtgttgtcgctgctcggtccaccggtcggaggaggaggagaggtggagcctagctggcgctgttgtcgcttgggccgcgtcgctgccattctgctcagctccgtcgctagggagatgcttggcgttgccgccttgcttcctctccaccaaggaaaagacgttgagaaaggggaggaaaagtgaaggagtgatagtggtgggacccaccacaagtgatatgcattgtggagcatgtagcaaatacagttcttaggtggtgttcttttctcctgaagatgaagatgaagattaagattaagtttttaacgcaaaacgaggtggtattagcgtatgattgattgagttttaattattacaatcttgaaaatagattaatatgatattttagagcaactttcatatagaaaattttcacacaaaacgcaccgtttaacagtctgaaaagcgtaccatgaaaatcttaatttttatctaactcttattgaagagaagaacgggaccttagtctacgtggtgtgcaaggatcggtaaaaatctgtggcagactgctgttgctgagagaggccccgccgagaggagggcgtggccgcttgttgccctccatatgcaggtgggctgtcaatgtagagctccacgcgcggggaacatcacgccatgtcaccacccatgcgtgtgcatgcggaaaccggcgatggaacggcagcatctcatgcggcgtgaacgcatgatgatgcctcctgtactcctgtggccctgtgggggtggcgatcccaaacactgtaacgtctcctggttgcctaccaagtgccaactactatgtcccccctttggcagctttgttttgccttcttttttttagaagggaaaaaaatactcttcacctccatggtgggccccacatggatttgccatgaatatgatgaattttacaaaatactcaaaaatcccacatgaagtagttcgattttcatgtgaattcgcaaaaaatgtcatgcatgatatatgcttgctactccgtagaactcgctcgcaaaagtgttattgttgaggtttcgtgctgaatggttcgatggccgaatgatttctgataattatttgaaggtattaatgaataaattaaatattaggaaaaataaatttaaaaaaattctctaaaaacttgaaaaagccgtatcatttaggagctagagaattcatctatcattctattccttaaaaaaaacatggcataagatttatgcttgtcgcaaactaaacccagttcttccaacatcaaatatttttgacatgaggaagagatgcaacgttaaatatttacagcaccaacgaccctagggcaccgttcatattcatgggttattgggttatgacattgtttagcaactaggtggcattatcttatactctctccgttttctatttcaagttgtttgacttttttctaatcaaacttattttagtataactaaatttgtagaaaaatatagtattattctcaacacaaaacaaacatattatcaaactatactcaatgttagatttaatgaaactaatttcatatttaaatgttatttttttcgataaatttggtcaaacttaataaagtttgattagaaaaaaaaagtcaaacaacttataatatgaaatggagggattacaatattcggttattatggctgcacatctgcagtgcagcagcagtcctgatagaaagtttgttgggtcctatagcagaaatactcttccgaacacaaccataaattgttttgttctagaaaaatccgatataactcttattctagctacttcccttcaagtctggaacatatttttgtttgcctagaaatttaaaatgccccaaaaaaggaaatataaaccgggaatccttggcgtcgggcgctcgacgccagcaggaaaaatcgggcatctcggtcgcgtctcctccagcttacgcgttgcccccaccacgcaccctagcacatactccattgcaacaaatcatccacatattttggaaatcctcttttaaggaaatttgtttcattttttgttccaaaaaaaatatttcacctagtgtactcacaatgtttcactatgtatagatctaatgttgcagtgaattgaaatattcttttgcaacaaattacccacatattttgaaaaccctctattaatggaatttgtttcatgttttgttccacaaaaaatgtttcacctagtatacttataatgtttcactatgtatagatcaaatgttgcagtgaactgaaacattctttcgctatttgttgaaacattgtttttatataaggtgaaacaacgcccaatttaaatgaccgaaagattttcgatctaacaattccgatatacttggtggaacagcgcgcagcatataaaaataattcaataataagctaaaaaaaatttcgtcggaatatatccatgtgtgatcttgttttaaagatttaattgcaacgaatttaatggtgcaatcatatcatgatttggataaataatttaagaaaaaaaatagtttaatgtggttttgcacgtatgcgttatgctgacatcagcacccgatttttctctctcctcatcgggcgcccgatcctgagttgcctcaaaaataaactcatgaagttatctaaagggctgtttgggaaacagggacttattccaaatacctgtcacatcggatgtttggacactaatttgaagtattaaatatagactaattataaaacacattccataacattagactaattcgcgcgacgaattttttgagcctaaatacgccatgatttaataatatgatactacaataaacttttgataattatggattaattaggtttgaaaaattcgtctcgcagattagcttttatttataaaattagttttttattaatctatgcttattactctaaattacgtccaaatatccgatgtaacatgtacttaacaagttttagccccgtataaacactctcgaagggtagagcatcgattaactttctttcctgtactccatccagcaccattacaaactaaagttgatcgagtactactagtcactatagtacactactttgttgatccattagtgattgatgtaatattcaagcaaatcattaattagtactgatgcatcttatgtgtgtgcgtgagaaattaaatctctcaacgaatgtttgtatatgcaggcgcatgctgagctacctagtactggaatctgaacatgctgctccttttctttctttgattctagaatactgctcatctagttgtaacagaaaagtttgcaataactgaaatacagtaaaagttggtagatatcatcgatagtcagctgatcaatgaaggggatactaaaatttcccagatttttttttgaattaatgggtttcttttgtgtgtgtggttaatttcccagagtactgctggcttagtagtaccaaatttaatttactgactactccagaaagatcaacacttaacatactctagatcaattagctaggtagacatcaaaccatattaaccatataataataccactactttaacaaaactggcataaatacattttttgtaaggcaaaccagacgtgcctcaaatcacttttgcatgatactaggtgacaaccacaaaaaaaaattcagtgtttgcttgtgaaaacattttcacctgtataacaggtatacacctatatggcacagtgtatgtgtatgaactgttgtgtttttttcttcaaaaaggaaaaaagaactgttgtgctttgcttttccatttcataaaaaaatctaaaaagaaaatactcgtagataaccgtatttaggtattcttatatcggtaacaactactccctctgttttaggctataagacgttttgactttggtaaaagtcaaacggttttaagtttgaccaagtttatagaaaaaagtagtaacatttttaacccaagacaaatttattatgaaaatacattcaattattgatttgatgaaactaatttagtattataaatattattatatttatctataaacttagttaatcttgaaacagtttgattttgaccaaagtcaaaacatcttataacctgaaacggaggaagtcgacaacatattttgcattcaatatatattactccatccgttccaaacataagtaatttttgcatagtgtcaagttaaatatttttaactttaagtattaatgacaaaaaaataaaaaagatcaatcatgtaaaattgatattactagatctatcattaaacaaactatcatgtaactctttttatttaaaacattttattttatagacattgttggttaaagtagtatgtccaagttaaaaattacttatattttgagatggagtattttgagatggagggaggaggtcacttctattttcttgtaggcctcaacattccaacgtcgcaaagcatgcacgatgggcaatcatcaaggacagggaccttggatccaccatgcaatgtgccatgcaccttttgacctttaatttgcatgcatgattgccaagcaaatccccatatagagtttcatccgaaatagtttaaccagtgggtgaaatcatatacctacgactaattaacataaataaaaaataatttaacatagcttgtaaagtcatgtaccgataatccaatagctctgacaccacgtccaaggtgattatcctcggttcctcacaataagtgatttttgcagaactttataagattcaatttagtttctctgggaaattggaaaaaaaatataagagagtgtgtgtttagagacatgcctaatctagaagaaaaaacaacaatggcgttatatggggcctaattgttttcccaatttgtgatctcggacttgcttccacgcaagcagggtatggttaggtgggtttttccgttttcacgaaattcttccaaaattaaactatgtaagttggttagtagtatactagattatgtgaactaaagtcatttttatgggagacgcagatcagggccctactgataaactattcttggaatatgtgtcccccctgattaattataagagcaagtgagattattttagtagcaggtgcagctaagatttagccaaatctgcttgaaaaaaccgtgctttcagcaacctttctggttcaacacatgattaaaatagagaatgcatactaatttaacttttctagtaggaagatttctaaacatgacttattctgtcattaatggaacggattaaattgcttctttttcatgatgcttacaaagcaaaaggtcaggtaaagacatttattggtgcgtcacaaaatacagagttaacttaccagttaccagcaaattgccataaagaacattgaacactgaattgaccagtttttttacaggtgaacatttacttaaagcatgccaaaaagtgtactacttgtttaacataacacctaacataaacatgcagccccatcgtttagcttattcgagaaataagcgaaacaacatatttgcaaaccaaaaataatttattaataaaatttttatatatgtgttcttaatgatctaaaattaaggttgaaaaataaacttcgatgaaaaaaaaatcccaaaatcaactccaaatttaagtttaaaaattcaaattttgattaagcgaaaagataagtccgattgtgacattgttttcactgagggttatcagctccaacaactcttatctaaactcctcagcaaaatcggggaaaggctgaaagaaccacttaaactcagacagattaacacatttctatcatcgtatttccaaactaaaatccaactactgctcataagttcctatcacctttattattagtggtggagtttgagctaactttttaaagggaccaacagttaaaaggagaatgaaatacataatatttatgggaccattttacagtgtctccataatcctttgtcccgattcaacttggcctttatacattttaattttttttcacaatgcacaattgtttcatatacttgtaaaatggttgcaactaatccaacaacttcacttcaatgcctgcaccatatcttctgcaacttttaagccacttctgctgccatttgtctccttccctgtgactgaagttcttgaactgaaataaagaaaaagaaagtgttaaagatacaaacaaaaatactcctactcctaggctactcctccaagttgtagtaacagtaaaagtagaaaaataaaaaaagagaggaagaagttaaagcttgagctgaacatttggggcattgtgccaactctgactgcctgcctgagactgactgactggttaattgctctctgtgatggtatgggcggctgtgattttgccagggtcgttgatcaatcaccgtccgattgtatggtgtgtgtgattagtccaaggtagtcaagctgggcaggagtgagttgaggcttgtaaaaaaaaaaaaaggtttttaaatgttcctcccttgtccaaagtgaaaaggggagggggagggaccactttgaaagaaaaaaaagagcagctcagcaagcaatggcattttgcataaaggcccctggaggaataattggggatacacccccaagtgtgtatttatttggaaaggactctactttggatgaaatgtgcataggtttagcatacattacatctgtttttttaatatatgacgccgttgagtatttataaacgtttgtcttattcaattttttttgtgcaaatataaaaaacttaaatcatgcttaaagaacatttgatgacaaatcaagtcacaataaaataaatacttcctccgtttcatattataagattttctagcattacccacattattttttgtgtgcctagattcattaatatctatatgaatgtggacaatgctagaaagtcttataacctgaaacggaggaagtaatacttatattattttttgaataagatgaattttcaaacgtatcttaaaaatcaacgacaccatatattaaaaagggtgggagtattggttatgctcaacagaacatgcggaaataacttataatttatccattctatttgggaatttaaacttttgtttctatgagaaccatataaaattattgcaagctaaacaatgctaaattgctcagttgatcaggagttacccatgggccatgagtaagttataatccatatttcatatcatgcaatgatctaagttaattaataatataacataaattgggagctcggttggaacacatgatttccaaaacataaggattaaaaaaacataaaatttgcttgacacctcaaattctatggatgaaaaatagagaaaaaccatgaatcaaaagagagataaatatttttttctaagagattggacctcatgtttaaaaaaatcctccaaaatccctatgcttgaggcaatcttaaggaatttcataggattttggaacaagtattccattgtttcacataaacatgtacgtaaaaaaattcatagaatttgaaccctatataattcatccaaaattgctttgctccaaattagccctaaaagaaaaaaacactagcacataactacagataatgttagataaaagattatgttggcgagaaaagtcacatttacagctactagcaatatatttgtacatcacaatggaccatacagccgaggataaagccaatgcccaggagtgtgaatcgagcaaaaggttccaatccaaccgtttgttttaaccaactatttctatttagttttctatcactcaataattttcatggttttcttccgtggagacgtgttacacacctaagggaaggaagacgactacgctttttcagcacgagagaaatgacccttgtgctatcataattccttccacttggatggaccagaaaatccaaatgaggaaaatgacaagggctatactgcaaatctgctcacctcctacctagagagacagagagagagagagtccctcagctttgctgcgttgttcttacttcctcccatggagtacaaaaggcaacaagcagaaaacgttgcgttcacaccaccaccaccaaggaggccaggacagcaagaccaggcctgggctgtagctagctagctagcttgtagagaaagagagagaaacactggagctttagagagagagagagagagcaagaagagctgaagaggaggaggaagagctagctatcctatggtgctagctgtagctagctccgacgactgaggtgaggagacgcaatggcggggagatgcgccggcggcggcgacggcggcggcgagggcatgctggcgcggctgcggagggcggcagccaggcggatcgggctctcctgcgcctccttcttctcccacgccgccacctccccttccccgcctcccaagaccgtatgcattctctctctacatttcatagattttcttttcttttctaacggttcagatataatttagcagcaatttgttcttaagaaagagtccagctacccaaaatgcctcattttttttctgcattttggggtgtttcttcccagttggtagatgttcaagatacactaagaagggaaaaaaatgaggctgtttttttttcttttctgtggttaattaagttttgggattttgttttcaccatcaatgtatcggtttctggttgttcttggctttcagtttcttgctatgttttgggactgggcattttttgtctctctactaccatctgcaggtgattttcaagttcctttccttctagcagtaaaactcaatgagctgtcactgcctgtccttttcacctcccacattgcaaccctgcttgattctctccttccatttcagatgttgtttcatcaaaagcaaaaaagaaaaaaaaaggtctcccattgccacatctccttgcatttttttccaaaagagaaaaatctcctcccctagtggcctgctgcattgctgttttgcattttccaacagaaagatatgtcctggtttgttttggtgatcttggcctacaaaattttgtggttaaagttacatacgtttgaacatttaaactttgcttctcgttttttatacttttcttttgggcattctagaaatgagtatcttgcatgcccttctattttatctgtattctgtactgaagttccaaccagaatgaggtgtgtactccttttgcatttccccccttttcttgagtttgcgttgtgaacagtgtgctaacagtggctgtgtgtggcctacctggtttatttgatactgatcattcatttattggaattattgttctaggagtagctctcatccatcccatcttgtactagtatcctgagaaaaaagaattgcaatagggggggggggggtaccattcttgtggttcggtccatgtttatggtcccttcatttttctcccagagatctactttggatctacaattctagacatatatagtagtagtagtagtagtttgatgttaaaagctgtgaacaagttgtattttgggtttatttatacttgagatattttttttttgttgttgtttcagttgttggtgaaagttgtgcattctctctggtcttcgtacattttccacgtagaccgtctgttgatggttgttgcgaattgggcacatatttccacggagcttttatgtcttcccttttcctcaattttttttttaaaaatgggcatttatatttctttatcctcccgaagttgtgttttcttggaattggttatcatctttacatattgtccacttatcggtgcattgtactaccttgctaacaaactctagattaatatctttcttcagtaacttaactgttattagtgttaatgtgtaggcactaggcagtactgttactgtatgagatcagtgtgtggggactgaattgtgtgtctagattttctcgcttaacagttaccaaacattgtcgatgcccatgtgcattttatcatatcattgataggtaaataggaggggaaagtaccaaaatacactggaggagacaatcttgtttttcatttactttttctgatgtagaagcagattattctactagtcaagaacagtaggtattttgcctattagctgtattgcaatgtagtaacagattgtggtgtgtatgcagatctcatgctcagcactgaatgcgcctgcagacagcactgatgaagaccaggaaaagctggaggagcccactagcacaagaatggctgacaaggtgccatccctatgtccattttcctccttttcatgttctggaccacaactgcatggatccactatggagttttctatatgtaaatgtgtttctctaaccaagtagtataattatgtttatatttaacctcctattaacttgagaataaatcagagttatgcttgactgccatcaggaattaacaactgagcaagaagacaggctaaaaagaagaattgggttaagcggttgattgcaataggaaatattattgtttatatagattcctcagcgttgaaggttgttgatgctctagatgattacctctgaaataacctattctggttagccaaagtgtattgtcaaatgttgaatcatgatgatctagccaatgtggttagcgttttgccatttccacgactacatgttttgttttgaagaaaaaacagtgacgctattgtaagcattttcttaaaaaagtatgtaccaatttatttagtgaaaatgatgggttgcatggccatccactagcatctaccattgggccatataagcgttatgtttttttgttagtttcaataagttgggagctttagtactttttggtggcaattggtgaacaattatgtggtctcccagataacatgataattgtttccctagtgccacataaaggtacaaacaataacaggtaaataccttacgacacattgcaaccaacatgtcaatgcatcagtattacagaaatcttgaggaagacatgttctttttttatttgtctaacagagaatttggaatgtcggggctattggccatgcatattatgcatgatgccttctgcatgaattaattcatatgtaagtcatgatgcatataaatataatcagcttgtttgtttcagtagtacaagaatagttctgcaaagattgaaatgtagtttgtgaagattagcttcgattggatgcatgtttttggaattttttttgtttgctaacagaccatgaaaaattcatacaatgaataattaaaaaacaaaatatgtccgcgtcgtaataatcgatgaatagttctctgtccaggaattcgctctataatgagtagtttccattgttttataataagtgtagtgattcttttatggtaagttatttgatatgcgattttactttatactctcatctgatgtgtattctgataaataataccattaattgtaatattttattcaattcatttgcagaatctctgtgcaatatgtctggagcccctcagcaccggcagcgttgatattgacaatggtgacaggccagcaatcttcacatcacaatgctcccactccttccacttcctatgcatcgcctccaacattcggcacggcaatgttacatgtcccatctgccgtgcacagtggtctcagctgccgcgtgacttgaaggtgccaccattgctgcagaacaaccagtctgacccaatcctccgcatccttgatgacaacatcgcgacatctcgtttcaacagaaggtcatccatccgtgctgcccggtacaacgacgatgatccggttgagccttacaccttgaccgagcatgtggatccatgccttcgcttcgctctgatcccatccccagtggcggctcaccatcatgctctcggacattacccttgtggccgtgtgatgccactgcagcagcattgccagtacagcagctcctccatgctctcaccgccacagattgcttcaccaagtgggcagaggcgcgcttacctctccgtcagtctcgcgccacagccagccatggacctagttctggttgccagccctaatgggccacatctcaggctcctgaagcaggcaatggcgctggctgtcttctccatgcgcgcaattgaccggttagccattgtcacaaatgccaccactgcaacccgcgccttccccttgcgccgaatgtcatcccatggaaagcgaatggcattgaaggtcattgaacacctctgctgtgttggtggtactgatcttgtaggggcattgcagaagggcctgaagatactagaggaccgggcgcaccagaacccaagcagttgcattcttcacctgtcagaccatccaatccgaagctgtttcggggtcgacatgaaccgtttcaacatcccggttcaccagttccatgtcggcctcggtttcggggtgcagaatggctttgtgatgcacgagtttgaggagctcttagcgcggttgcttggcggtgtcataagcgacacccagctcaggattggcgagcacggtggagtggtgaggctaggtgagctgaggggtggcgaagagaggaggatcccgcttgacctggtgtcggactgcggcttcatacttgttggctatagctatctggaaggtggaagggaggatcagttcaggacaggcgaagtcgctgtcggtttcgaagagaaaggcgataaccggtactgcggggtcagggatgccggtggtctgagtatcggcggtgagaggaggagcagctgctgcgccgagagatgggactaccttgatccgttcatggcgcggcgatgggcgaagcatttcaatgtgtatagggcctgagttaaaaagagggggagcttggggctttgaagtgatcagctcagcaagtctggtttaccagtttgacagcatatgattcttgttggctctttattttttttttcctctcttaacattcctgcaagcatctcatgatcatcagaggaaatgtttgcttttttggcttttgttgtggatcagggatccatttgtaagatgtctggttttgcatcagatgtgtgcaatgtgcacaaggctttctgttctcaatctgtatgtgtgaatcggactgtgaacaaaactcagcacaaagaatgaaatatggctgcattggagtgagttattttaaaaagaaagtgacatgctgtttttcaaagaaatttaacaaatatgatgcgttatactagcaatttgcaggtttactggtctctgatatttcattgtaattattgagctgtcatttcttaaatttgattcatatttttttaagaggtttggtttcatattttcatgctcccttgtactcttacaaaacattgatgggttaatcaatcatcttaatcgagttgcccgggcgatggacgatcgactcctttggattccggattagaaggcagttatcataatttgaggaatcaattactcaaaattacatagagaattgtggcatggaaaaaggttaaaaaaaagaggtgccacgttatattattttggatttaaaagaacgtatggtcataaaactttgcgcccatagcacctgaggctcagtgccacatgatgcaaacatgcagttgttttttccctacgtagacaacaaaacatataggatttctgaaatttactctaacaaaaatatgggtctcgactctcgagtcacaaagtacaatacaattcagttcaagcggccaggacattaataaaattgaagttacaatcaggacccaaactgctgtcagaaatgcagatcagaactcggaaatcaatctacaatgaatagttggtgacggtaatctgctaaccatcagttatgtgctttcaaagccaaatattcggaaaacacctgcaaaaaaacaataaccggtaagagggttaattgaagctatttttataattaataccacttccattttggtttaactttctctcttgttgtgtactgagcagttgcagaattatatactataaatgaaacgcaagtctgaaacaagtgtatctgaagaaaatgaattcactatcttgtagcaagtcaaatgccaagctagacatttctttcatttggccgaactaaaatgagtgagcagcagcaattgtaccttcatcagcctggtacttgttcttgtcgtctcctgcgtaagccaggaggttgtacttggggttccattcaacactattcatagctgccttgcatggaatctgatgaatcgatcgtccagtttgaacattggcctgatcgaaggatagaaatgtaaaagaattattatttttggtaacagctagcttaggatcatattagaattacagtatgttgaactactcacaatgtcaatgaagggatcttcgctagcatatgcaagaaactctccagtatgattgaagctaactgttcttacaggccacctggaaaaagaacaaaaagaaaagatgaagaaagtacatgtttctaagcatcttgcaactgaaggtatactctaattaatctttgtttctttgaatgactatttccaatatgaggtgtggagaaaatagcaaaattagctaaacataactttttgtccaaatattcatggcaatattttagatacattggagagaaaaaaaaaggtatggtttaaaagcagcgaaacatactcgagtttggtaaaggttttaatgcaaaggagctctttgacatcccaaagactgacaagtgaatctgcacttccaacagcaaaatacctggcatcaacacattctgtaagtatccttgtcaaaatcattttaagctccatttagggctcaaagaaacaaaatattcaccagataattgagaacaaatgtacaatactttggcatagctacactaatgcatgaaacatgtttgtataccactatatccatgcgaacaagaacatgatacttttccacaataaattttgttgaggttcatgtagcagctcaaatctccaaacattaacatgaagacttgcaatggtgtatagcaaataatccattcttttacatggagtagaaggcaacaagtggcaaactattttgcaccctttcttttacatgctagtaaaggtgcctgttagttgcaacgggagatgggggaaggacgtgctattcagtttttctatcccagttttttaccagtggggcgtttttatatgtgggtccacttcttttggagggctgtttttttttttctgcgggtaaacaaaacttcactcctgataggaagcatgcacagacgaacgaaacttgcctttcagagtagtagagaaacactgaattcagtgtcccatttatatttaggcatgggtcatcatagaatcacttatggctaggtgctatcacaggtgagattcacttaaaggtagcttggacagaaagttcttttttttacatataccagtatcactatcaactgtcaaaagaccgagatagaatacaacattagtaatacccaaaatatagtatgtcaaataacttcactcatgcctatgctttatattaccttgaaataaaaaaaatcgttaactacataaaacaactagcatcagtataaggcattaagagaattagagttcaaagcgaagtcaaacagcatatagagaacctaatgattatagca

SEQ ID NO: 40924 - DNA, 5646 bp, Oryza sativa
aaaatttacaaaactgcaacataagtaatgcagcaaatgaaattaaagtacatcgaatagttaggtaattcacactcagtagtcagtactaattcaaataccagcaggcaattttcctgttccagacaaagatgcacatgctgccgacttatgcccactctactttttctcaaaaggtatatgactatatgtgcatgttcattcagagcagcgaaagattccaaaaggaagaagaaaattgctagaagaatgtttcaacaattcaaaccttcaagtggaaagtacctcataattaaacttaaatttgtgaagggcttttagcttccgaacatccactattgtcaactcatcctcctgcaaatcatagtgacagctgttactacacttgtacaattttataaaactagaactcacaaagtaaacacattggtgtacgcgggaccttgcgaactaacttgtaaactttataaaaataggtttactacaattattataaaatttacacaccactccccagtccccatgctcaataacactttactaactttgcatagcaaaaaaagtaaataattccatctaatttaggatcaatatgtatatattcaagtgtgtccatactgagctatgttgtattgatacttatacagagagcatgtcaaacacaagaatgaacattgcaatttagatgctaatttgccaaataactcatcactcaatctaatataaatcagattatagttacacatttctctttggaaagaattttataaattcctttcaaaatattgtaaccctcttctggcatgatatatgcaaatcaaaaccagttccttagtcataaatgactaccgttcttgaagttaacagggataacagcctaggcaatacataccttgtttccaacagctatttgagtaccaccatgtttataagtgatattgatgttttctccactaagttcgacgacttgacattttccacctggaaaagaacacgtcaaacagtttgagaaatagcgggtcaaataaataatataattttaaaaggcaaactgcaggcccaaatcttgtagagttataaatagagaatcaaaagtatgatgtacaatcctatgaaaaaaatcgaagtacaactaaaaaaattctgaaactaactttcaggtagagtcactacacaaaagaataagacatcttgtctggtaacaacaagttcattgtaaatggaacatagggattgaacaaagtgacaaaaagggattcatcaatttcagagagaagctgagaatgctgaacacaactgtggatatcttagttctttaaccttcaaagatgaagggaaccacttactccgtgcatcccagaggcgaattgacttgtcagcagctgctgtagcaactgtatcaggatgcttcggatcccagcagagctgatctacacaatctgtgtggcctttcaattcaatgtctttaaccttggactgtgcaatataaaaaccctaatcagcacagtactgacttggtacttccagggaaatagaaaccatctggggttttttcccctcctacgttccaaccaaaaatgtcttagtgttctcaaaacaatataatttagcttagaatttattttcctcaaaaccgcaggagggctgcgcttcctttcattaagaagaagaaataagtacaactgagggatccaaaagaacccctagctaagaaatcattcacaatttcacattaaatagctcaaacatatgtctcagagacacaggctatggtatgcttaagtgtgattactgtctgagtttctataattttaaattatacagcgggagatatttccaattaatcatcatgcttatctttcaaatttatagaaatgttcataaaaaaagggtgacagttattcatagtgaatgacaataaatgcgtttatctaataattccataataacaatgaaggttattttgtttgcaatcaggaaaggagagaatgtttacatggccatggggatcgatactccatacacgtgcagtatgatcaatagagcctgaagcaagcttcatgcctaggcagttccatgctacagagtgcacctaacagtaaacaaaagatcagaattatacaaaatttaaggctgattatgtatgtaagatagataaaaaagaaggcaaaaagcgacagaaccagttaaatgctgcacctccatgtgtggaaggattatttagaaaaacaagaaacagaattcaagaaagaaacagagaaatatcgttgtactatgattctttctgcaagtaagatttttttttccctttgaattcttccctcagaggagtagcaactttacaaagtcagacaagaagtcccttttcgtgaaaccaaattccttcaaaaattaggagtaattatgaccaggaatcatatttgacaatgcgctcattcaccagctcccagaaggaaagcaaccaaccaaagcttcattcaatctcaacatggcttagccctagagcaaaagaatcagcatatatacggcatgaacgcgaggaatcaatcactatatcctgctctagaattagaaacaaaaccgtacgtgtgaaccaaagatggatgcattttcgtcctaatttttgcttgtaacatccggattttagggcttccccctcgcaggacttttgagggtttaggacctcatgagaaaaaaacttatccccgcgtaggattggtgaggggggaatcgaaaaggttaccttcttcttgtggccgaaatactccctcgacaccaggttcttcaggttcatccccggcgtcgagcttccgccaccgccgccccgccgtctgtcgtcttctttcccctccattgtccccgcggactggggcacgggtctggttttgctattccccactcaccgcgtcacgaggcgcaaggcggcggcggcggtggcggtggcggcggcggcgggcgcgagacggaggagggagagccggggacggcgtcggcggggaagaggagagggttttcgcagaaacgtccttctacttttttgtttattcatgccacaagttcatgcgttatccttaccatggagccatggacacatcctttggtttttgtttaattgaatccatgccattgtaaatataccgataaatgttattacaattcgtcttttttaattgtgacattgaaattttataaaattagaaccatgccactatagtaatattttccatccatcttcgtcttcttagattcatctttcccctctttttttttctcatctctctccaccacctctttggaggggacagccgctgcggctgttggcaactttttgtgacaagtcgacaattacgatcgcagcacctaaacgccttgcggtgatatggagtcgccaaccacctcgatctagccaaacggccaaatcaagatgggttttgtagaaaaacagctaaaccggctagcggagccgatttagagatcaaaaatcagcctctaagccgatttagatcgatatgaggataactaacctgtctcataggcaatacggaaggttttcaggacaaatctacaaagaggtgtcgcactctcgcagcggcggcggacggtttacggcgcaaaccgacaaagatggattaaaactagggtaaaatagaaaacatggtaaaagaacgattcaagtaaattgtattcgggggttttacaatgaaccggccttgtcccttaaataggggttggtcttaccctctacaggcccttctccatatccaactcgggatagaaaccaaaggaaacacgaaacctaccttcccaggcaaggaaacccgagacccgacgaaaacaaactcggactcggaccctgacggtttgaccgcccacatacctgcggtcagaccggccctactagacggtcagaccgcccacacacctgtggtctaaccggccctgtgaaggaaacccgtcactttccaaactttggcaattttcctctatttcgtccataggtgccaaatttgggtgtaaacacatgcccccctgccttttttgtaaacatacgtgaacctaaaagcatagaacatgttatgtcagggtgataatccaattaccgcccataggacttcctaagcatcttgccaaatgctcgggaaatatttcttcaagtatttcccattaattgctctctgaaaacaccgtcttgaagtgtcttcatctccttcaaagtctttaaacgcttgtcgatgacgtctttaaaattgtttcccatcaaggtcttgtaatcttcaaccgacaagtcgtcttgcttgaaataccgaagagagccaagatttaccccaactggcaaaacgacaatttcaacaatgttttattactcaactcggcttatccattagcctgagcgtagtaaagagaagaactcatcaacttaatagcataagattcggcaaaacttctcactccgtacaagtaatattctcgagcggcacggcttcggcccacttagtgaagtaatccattgcaactagcacgaaccaacgcccttttgatgacgaaggataaatttgaccaatgaaatccaaagctcaacctcagaacggccatactttaatgataggattcaacacagcggtaggcgctaattgaacattgccgatccgttaacaagcttcactccctctataacatttgaaacaatcatcaattattttcggccaatgaaaccacactctcctaagcaaccaatttatcttacgggccgattgatgaatttcacaaatcccttcatgtactactctcctagcaactttaaactgatcattatctaagtaatactccatctatttttcggcgatataatatttgagcgcttgccgccgaatcttctgatcaaccttaagtgtaggatcttcaaatatctaatcgaaggaattctccaagctatttctaactcatgggcacaaatgtccgaattcacaattaattcggccttttaatcaattgtaacgtgccccccagctctcggcccgctatcggtcagaccggccacgcaatgccggtcagaccaccctgtctgtccggtcagaccggccatgtagagccggtcagaccggccgtgcaatgccggttagaccatcctaggtctatgactttgccaatttcgtccaaacttttgaaatcaagcatcggcctttagtatataatttttcttcacataatagccaaatgcttggtgtatcaaattattggaccaaaattccttctctctagatatatgaaaaattataacattcaactaatatgtctagatgaatactaattcaattggcttttgaaacaataatcatcatggcatcacaacacttagccaattgaagtatgatcaataatgaatcaccaaagtcatatgtgccacatgcatagattccaataaactaaaaatgtaagtaatcggcttgagcatgtatgcaaaatattaataatgccaatgttcctaaatacaataactctagaacaaatcatgacactgaccattgacattagccgaattactaataggcaaaactttcatggtgcaataaatatgaaatctatatcttatatggtgatccataaaaagacatatgatttgctttaaataaatatcaaagagtcatg

SEQ ID NO: 40925 - DNA, 8689 bp, Oryza sativa
cgtataatataacattgaacacaataaacccataccttgccttagcatctaacaaacggcggctcaaagatgtgatgttgtatccatcgccgttcatcttctcttggttccctcataaacataataatgtcttgccccctaagcaaaatcggctttctcgactgcacgatttcgaaggcaagacgaacaccgcaccaacatccacagcatcatgtgaaggagacttatctctaatgaccgatgattcttctctcatgaaattggatttatcactactatgggaaatcaccggtctcttaacttttacttctttaggtctccacactcgcttaggtgtcgttcgaggatctaaattgttatatgttttgttctccacatcttcggcctccttttccttttgacctatggcctggagacgctgtagcctcctcttttgagagcgagataggccagaaggtatccacttcggctgtggttgttttccaggagctaagcaatgattcttcatatttttggtcgaagtggaagatcctatgttgttctcaattttcccactcttctccaatgctccccggtcagaccggccacaagccgtcagtcagaccggccagtaaggtcggtcagaccggccgtagactggcggttagaccggccagctgtctcggttagaccaccaatgttgatagtcacggcgtcggcttcgatctcctttgcttgcgtggtttccaccgtatctccagtaagtacatgaacatcttgagactcctctttgacagcaatgacccccggagctttggcttctttcctcacccacaccttcttcacctttttcacctttgatccaccgaaccgattcttttgtgggaaatagtcttgtcttgaattagatgaatgatttggcactgtcctaggtgattccttccatccttgacaatacggcataggtggttgatgcatccatggcatataatacaaaaaaggataaccatatagtgacattggatatggataccatggcatcacaaccggaggtttatatggagttggtatggttgatggctccgattgctttgatgtttgaccaaatctcttcctatgagatgatcttggtcttttcgaatcactagtttagttatcaaatcgttgaccagctaatcctttcttgtatttagccataagcatctcaaaagtgagcttcggctttttagtcttttgggaactagatgactcatcttttgtaaccttacgatcttcagcctttgcattattgatcctattcttgggccgaggatccccaatagcaacacttttccctttctttttgtcaacaccaataggactagtagggagagaactattaacaattccggtcttaggcataggtgtaaccgaaatagtttcacaagtgaccgatgaagtatcattcggtctttactccatcaagcttgcatctctgaaataatcatgaaactcatactccatttgtgaccatgtagaaattgaactaggagcaagcaaactataccatgtagatgcaaagtttgacaaagaaaggggaaacaacttcaacttaagcaaatcatcactaccggccttaccacattgatcaataaagcgaccgatatgctccattgtagtcatagcattctcatctgtgaatttcgtgaagttgggcacctcaaatccttgcaggtatgggaccgaatctacgtgtttaggatacagtctttgatatgtatgcatagctactttggattctatttcaccactatcccgcaagacattgtcatcatcttttccaacatccacatgaccgatttgtgactcggtcttaggtgataatgctatttcactttcgcttgtgatataacctgaaccgtcacttagttcggctatattttcaatgatgctattttctaagctagcaacacaatccgaaccattacttggttcggctattccatcgttgtctaaactagtaacacaatccgagccaacacttggtttggctataatggttgttgcattatcatccaagctagtaagacaattcggaccaacatttgattcggctatacttgtcacgacatcattgcacaaattattaacacaacccgaaccatcgcttggttcggctatacatgatattacactttcatctaaactagcttgtaagctattgtcatccactcggctttcctgagccaaagcttcatgcaacacatgatcaacatcaagaaatatttggccattcaatctctttttaatagaatcaagcaatccatcatatgcaatgttggccaaatctttgtcaattattttcaaactaaaacatcggcttttaatatctctgaacctttcaatataatcagcgatagattcattgtatttttacctaaccgatgttaaatcagacaacctaagctcagtgttaccagtgcaaaaatgatcatgaaatttttgttctaattgagcccaagtataaatagaatttgccggtaaagaagtaaaccatgtaaaagcagtaccggacaaagataaagaaaacaagcgcaatttaaaagtatcactattagcctcaccacattgcgctaaaaattgacctacatgctcccatatggtccaactatcctcagcactaaatttggtaaattcgggaactctataaccacgaggatatggcacattatcataataattaggatacgacttttggtaaatcttagcatgattcctaatttcaatcccgaatttctccctaataatctcactaattatttcctccatattatcaggcctatattgatttggtggtggatttggtggcctaataggttgtgtttgtggcgcaatatgattatattggtcttgcctagtatcgggaggatatcccctattagtatcattgtagacattagggatatgtggagtagcatgggtaacagtattaacaggtgatgaataataattaaaatcaatactgctagtcgtggtatgaaaacctggagaaattcccagggaaccggtctgaccggctatagatagcctggtctgaccggccaatcacccggtctgaccgacccatggcccggtctgatcggtggtcaatggtgcggtcagaccggctacaggaggcccgatctggccaaaatagggcacggtttgactggctatagtagatacggtctgaccggcataaggtgcggttagaccggtgtcacgaccggtcataccattagctaggttttccatatagccgattcctatttaatcggctgtataatcacccattgacccccatagcattataagcatattgtataggagcaaaactaaaagtagcatatgcatctacacaatgattattaaccttttgaatagcaaagtatgggttgggtgaatcggaggttacctttggtgaagctacaacttgaggtagcgggacgtttcctttcacgacgccttgatcggttctaatgtattgtgtagtaatattattgaacccgttccctctcgttatagttgatgaagaaattccttgattaaatccggccatatagctcatagccaaaaatcgttgacagaatatattaatatacagtcttagttttccttgtaatgctactgtacttagcaaaagattggagaaattgaaccttcacagaaataaccgatacagtaggaatcggctttgttgttgttgtttttttttttgttgtttttatgtgaacagaagtagatcggcttagatagcctgatctttttttagcacgtgcacagtaccagctttgatcaatcaaatctttctgttgccgtgtgaagcaaaaaggaaacaatgttgctaatccggccgctgctccctgtgtgaacacagtttaacgtctagccgtgaccgaacagaacaattaagcttgaagacaaaaccaatgtcggcgacaataataattacagtgtaagttaattccggctgtttagccgaaactaattcgatgattcgacgaaagagtaattattagattaaacgaaattcggccctagtatggccgattagatcgttccccagcggagtcgccaaaaattgtgttgataactttttgtgacaagtcgacaattacgatcgcagcacctaaacgccttgcggtgatatggagtcgccaaccacctcgatctagccaaatggccaaatcaagataggttttgtagaaaaacagctaaaccggttagcggagccgatttagagatcaaaaatcagcctctaagccgatttagatcgatatgaggataactaacctgtctcataggcaaaacggaaggttttcaggacaaatctacaaagaggtgtcgcactctcgcagcggcggcggacggtttacggcgcaaaccgacaaagatggattaaaactagggtaaaataaaaaacatagtaaaagaacgattcaagtgaattgtatttgggggttttacaatgaaccggccttgtcccttaaatagaggttggtcttgccctctacaggcccttctccacgtccaactcgggatagaaaccaaaggaaacacaaaacctaccttcccgggcaaagaaacccgagacccgatgaaaacaaactcggactcagaccttgacggtctgaccgcccacatacttgcggtcagaccggccctactagccggtcagaccgcccacacacctgtggtctgaccggccctgtgaaggaaacccgtcagttttcaaactttgataattttcctctatttcgtccataggtgctaaatttgggtgtaaacagcggccatctcctcctccccccacagccacagggagctgctgcgagaagcaacaatcatcatctatcaccagcaacaagttggcagatacgtagatcagggcacattaatcgtcaccagatcaggtaaacaaaaacaacagagaggaggggtgagggatcatgtcggctacaagagaagggaagaaccaaatatttttctccttttcctctttcaccaacgacgggatatgttctagccttagctcgtcgttgtcgtagacacaaccaacgtcgccgacgccgacgccgataggcggcaggttgaggtcaaactgaaacgtgagctgacacgacagtgaggcggtggcgtccgtgcagtcctcatcaaccatcgacgccgacaacccgcaatcattgtggcagtcaccatcaaggatctacgatggcgaaagccgtggaaggagcaccggtcgcggcctggtgccgaatgactcaatggtggagctaaggctggtggtggctggcctagctagcgatggcagcggagtagggtgggtaggtgaggtggtggtggtggtgctgatggtggtggagctggggctgggcgtgagggagggagagagtgaagttggtcttggccttgggacccggagcgcccgcgctgccacatcgtaggcccgcgcagcgtcgtaggcctatgtgtcttcctcggcggagtcataggtttccagccacacccgcgccttcttcaccgggtcacagatcaccgccatgtaccgcccccatggccgcttctgcaccccgcgaaaccgcgtgcacctcccgccggtggtggagagagatgaggaaagaaaaaaaaaagatgatggagaaagaagatgaatctgatgagtgggtcccatttgcagatgaggaagaagctggaggtggatggaaaatatgatgatagtggcacggttctaattttgtaaaattttaatgacacagctacgaatagataaattatagtggtatttatttaaatttgtatatttacaatggcatggatcatattaaccctttgttttttcaaagcaagaaccaaacatgagaaatatctgaaaatggttggaccaagaattgtcatagtccaccttaattagtacaggtggggactttaagtattaggcaaaaataaaagccacaaactatatacaactccatgatgtagatacatgtacaaaacactacaagcactggacactagtacctaaaaaacatgttaatgcattttttgaaatattttaactaagttaaagttgtttggaggtgtagccttaatatgtttcttggtgacatgctgatacctggcatgcgtcattacgatgtctttgcaaagtcatcaaatcatcttgaccatgacctcatgttctaccaaaccactatcagggaccttccaaaactgaactgcaagtccacaataagagctagctacgcctcccacaactttaaccatttactgaaaaaaagagatggcatagtagaaacagaagctaggctatgttggaacctgtgggttcctaacccacctctcttgcacgaaaaatgaggtagttcattagtacatgattaattaaatactagtgatttttttaaaaaaatagattaatatttttttaaaaaaatctttcatatataacattgttaaaaagcacaccgtttagcggttcaggaaaccgtggaaaacgaaaaagtagaagttgggaaatgggatgttcgaacacggcctaatccaagtttgagttgctcatggtaagggcaatagtagtgcgccatagttttttttttttgctggtcctcacataccacgtagactaagaaccatatttgctacatgctctacagtgcaggtcacttgtggtgggtctcagcactatctctccttcacttttcatcccctctccttcacttttcatcactttgcatgtttgccttttccagttttccctagcatagaggaagcaaggtggtagcgtcggattgtctctggggacaaagccaagcagagcggtggcggcatggccgaagcagcgacggtggctccacctctcctcctcctccgaccggtggcccaagcgggggacggcgcggcaggagctcgctggcgcgagggggggatggtgcagcgggagctcagcggggttaatctggcggcacggtcgaagctgtgatagcgccggtggggctccacctctcctcttcctcctccgaccggcagcccaagcaggggagggcgcggcaggagctcgccggcgcgtgagggggggacggcgcggtcctctccgtcgagctgccgttgctgtggtactcagtggcacggaacggcgacgacaacgaggttaggtcatcagatccaccacctcttcttcctcctccgccgccgccccgacaagctcgccagatctagcctcgggttcgctggatctagcgagcgacaccactttgtgggcaatgcacctgctcggggtggtagcctcatcggcaaccggcgccgcctcgaatgagatgtgggggcgcacattaggacacagcatctctcaatgcgccacgccacccgtgcctgcaacttctgacgaagaatgagtgacttgttttgaccccgtagtcttgacttgacaacgccacgcacgtagctggggaggaatctcctacgtggacggttggggcagaacgacacatcagtacactgtgaacgcccttacagctcaaccaccccccccaaataggaaactactgcttccccctcttatagttttttctaattaagaaaatttttttctcgattcccgttagtacgctttttaaactgttaaacggtgtattttgtgtgaaaactttctatatagaagttgctttaaaaatatcaaacaaactcatttttcaaatttataatattaaaaataaattaatcacactttaatggttttctcgttttgcatgtcctaacttaatattcatcttcattagattcaaacaggacttgtcctctttgcaacagctcggatttagatttttctttagggctgggtatttctgtttttatatatctatggatttagatctaccatctaccatcacattgataatatttgaataaattattttgtacccattttatgtgtaatttaaaattttatattactataatctaacctataaaattcaaatttaccgtggatccaagatctagagttgtatcaaataggaccttaaagaaataaaatgtaggaattttaggtatgggaaataaatcctatgaaagtccttttgaaacaaatgggttgatccctacccaaatccttaaaaatttctatgtaattatatactctagaggaatgttgaagaaaaataaatgtggttttacctcttgttttcttcttattgtggctagagttcatgcatttttatggagagaatcccttatacaccgctctaaattggccagttcctttatatgctactcaaaattggcttcttacttttatgccactggttcaagtttttcatccttttatgtcactcccagcacggtagcatttgttgacggtaagttagatgttagtttttttcgtaaatgaccaatatgccctctcaactaaataatatgtaaacttcaaaaattcataactaatttattttaaatcctttttgagtgaacaaaattttgtcagaactagtgaaaaatttgctttgtattaaaaatattgttggaaagctgcatgttttatgcttatattgaaaattcatttgtgatggtgatgactaaaattgtacttgataataaaaaaatcaattttcatatgttgtatctagtagctatcttggtactaaaatgctatacatatatcaaccaatttctctatcaaatgaaaaatacctatcat

SEQ ID NO: 40926 - DNA, 1091 bp, Oryza sativa
aaatcttttgttctaatttgaagttttgaacgggcaccagagtttgcaacattcaaatatttatgaagtagagtttattttgtcacataactaaatttttaattaagtgtagataggccaacgacatctaaatcaacatgatgcctattgtttttttctaatccttcgataaaactatctttatttatataaatatgctataggactatataaagtaggctcttagctaaatttaactcttattgcgtaaccatcaccattgacatgtccgggatcgatgatagggttattggcatactaagagtaggatcaatgttaccatccattgtataacgctccgcttttcgtgagacgttaaaaactagtttgagaaaaatcctatatgcgaaaattccgttcactgtgtgagagtctaagtcgtgccgtggatctcaattcaaatccgtccttgttccctgtcaccgccatcaaaaatcatccacctcaagatttcaacttccgaaatcaaacatcggaattcaatcccgtccttgaactccttgccaatatttctcccgattccgagaatgtcaaatccgtccttgaaatcctccctgtccatcgattgatctatccacttatctaacctatctatccatctatccatctacttatctgtctacctatcgatctacctacccagctgtctatctatctattgatctatctaactacctttgaatccttgccaaatattcgccctgactccaaaaataaccaaattcccattttgaattcattctccaaatccaaatctctctaaatcaatctttcagaaaaagtctattttgcctccctctggtttgtggaccgttttcctcctcggcccatcccctctcggctgctccttctcctcctcccctcgctcgtgcgttgcacacagccgagccgagagagagcgccgcgctcgctctcttcacttagctcgtcctctctctctccgtttctctctcccgtcgaagctcccccaccggcgccggttcccgccgccgccttttcgaatttcgctgtgcccttgcatagcgcgcgcgctcgctcgtgcatggccgacc

SEQ ID NO: 40927 - DNA, 3695 bp, Oryza sativa
cttgcaccccggagatactctcgccaccttgaatcgacctctcatcgccccgccacgatttccccttttgctcgccgccggccgccgccgtcgctatccgccgcccttgacctctcccggcgaaatccgagccgttggctcgcctcctctcgcgtctatcttcgctccggtggtctcccctccttccgccgtgcctcgcgccgctccgccgacgcgcgccgccgcccgccgtccatccggccggccttcgtcttcctcctctcgccattcgacgcagccgccacgtaggcaccacgtcggctaggccgagtcaacccgtcggcctccctcccccatcccggtgcgcgcggtccacggtgcgccagccgccgacgcgtgggcccgcctcttcccggtccatccggcgcatgcggcatgagccgagcctactaaccctagcaccgcaccccacgtgcactcctcccccaccgtgaaccaggtcgccgccaagtggcccccgtcctaggacccccacgcggtggatccggtccaccagaccgcctccctctccccacccaagccctaatgggccaatctcctttgggccgtgcctcacgctcggcctaaaaagtctatatttcctccctccaccaaatcaattctcatacacaaaagtccatctttcccccttgttggccccacatatcaatgagtaattaaagaatattcttgggaatactcttttccataaattcaatagatcatttatttattccaaaaattccataaaccatttctcctattccagaaattccaattaagcttccgaaattcatatcttctcaaccgttcattcgattgactccgttccacttcccataattccgtaaaattgagatctatttaatggcactattatttagtctaaatagggtctttttcttggtcttttgtctaggtttttgattgtttgcgtatagttacggttaccggattttcgtcgatcgtggatttctcgaagattcgtgaagatcagtgaagaccttcagcaaggcaagtcaccctttgatcaattgctcctataattgaaaaataattattattttgtttgcaacttgcattattagaatcacacacttaacttgcttggcctcggtttgcatgctaaaccgacggacctaccaagtagtcgcactacttcctgtaggctgacataccttgatcccttgtcgctccaccattgtggtactttggtatccgtgctctctgagcgcgtataccaattatcccacatacaccgttgtttgtcaaaaatttgggaaatgggtttgagaagccttgaaaacccgacatgtggtgtcggtgtgtttgaaaataaaatgaattgtgaaaactcgtgatgcgggggttgtgcctatgtggcactgtcctgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccagggcggggtcggacaaactgggttcctggtaaggcaaggacgagaagcttgctcacttaccgatcaaggtggttggagttgatttgtgaatgcctaaaatgtcctatatttatgtgaggatttgatccttctatgtggcatgaggtaaccctgggtcggcttgggaaaggctttgtcgcgaacttctgacaccggctagtgtctggggtaagttcgtgtcttgtgggtaaagtgtacccctctgcagaggttaactaactgttcgaacagccatgcctacggtcatgggcagatgtgaggtggttcccgttgcgtagatttgattacctgtgctttgtgaaaagtttttgtggtgtgggaatcgttaccagaattagcctatgtggcagatggatgacctgagtggttggaaacgaatctgtgtgattcgggatgtctgcgggcatcatagactaggcttcctgagtagaagcggattgttgtgctgctgggcagctggactctgggagtccgagaaaatgaaaaaggctctgggagccgattaatcaagtgaaatggctttgggagccgataagtaatgatctgacccgggaggtcggtacattaccatttgaattgttgataagtatctcttaagtcaaatcgagaggcaagtctcttttcgatccaaactcaaaaagaaataaatcacttagtgacttcaaaaatgatttcaaacaaaggatttgcaaaacaaccttgcctctcttccaagcttgcattaaacacctaaattcccatgacttgctgagtacgaaagtactcacccttgctctatataaatatatatatagttcctctgtcttgaagtgaagatgaagtgaagtgaagattagggtatcgtcctggtccccagccgtcgcctgtggtgttgggtgttagacttttttttccgctgctgctgctgttgttggtgtttcctcgtccgcgtcgtcggttgcattctcaggctgttctgagttgcaacctaagttaaggtaaataagtcctctatttattttaaggattgcaatgattcatatttgtcaccgtgggtaccagcgctgtgtcctgggactggtactgagatcgcggtttcgtaggaagcggtttgcgccgttttccctatgacatgctcctgtcaggtgccgttgtacggcggtaccagattggggtgtgacacattgatggctgaaaaatttgtcatatcatctagtgggctatggtatgtagttgtagctttttgctccttgggcaggccaaaatttgcatgcacagacagcttgttgtcctctctgttggaaatttgttcataattcggtatattttaatccaaaatattaagacaataaacatgacatttataatttgagtagatctagtgacagtgctagatgtgtacaacatgagcgtacttaatataaaataagcaccaacatagataaggcaacgcccaataacattgcgactgacagtagtagaaaattaagaacgaacggtaatagtaaattattataccccgagaatggccctccgctggagtttgaggtagtattgcctccgttggtgttgatgggtgcctccttctccttgtctccagtgttattgttgtcgctgatattcgacatattggcgaagacgatgcagaggaagacgaacaaaagcagtcacgcatagcgctccctaaaaacttgatcgcccacctacccgtgcaggttctcaagcagacggagttccggaggcacctgcttgttccgatcacccgtgcgtgcgggatgaacagaaccggggaaatggagagacaacgcaggaacataaggagagtatcgcctaggaacagcagcaggaggaagactcgatctttgagagcctctgccttgcattatatatagagagagatctccattaccacacaaataaatctcatttgttgtgaagattaccacaaaataaatctcatttgttgcgaagattaccacacaatgaatctctcatttgttgtggaggttacaacaaataaatctctcatttgttgtggatgttacaacacaatgaatctctcatttgttgtggaggttacaacaaataaatctctcatttgctttggaggttacaacacaatgaattt

SEQ ID NO: 40928 - DNA, 26332 bp, Oryza sativa
agttgaggttcttccacctaaattttcaaggcagtattattgtctctaacattacttgtgggctcttgagattttaattgaattaaattgggcctaccccatttattccaagactctcaccattcatcttgaacatctagaaccctaatcgttgtgcgcaagcaagagtctagcacaattgcaacaacttcatctagtcttggaggttgggaaacaaatcctctattgtagagctaatactgcacaggtgctgtagcgatcaaatcaagccatccgattagattaagcggctctgattctgtccttaaacaccgaaaatatttttgataatttggaaactaacaaactgattttaaggaggaaaagtcaagataaccttgatggagggaaaatcacgaatcctccagagtacttggcgccaaaataatacaggttctccttttgctttcttcctccttgggacttggtgccaaaaggagatacagaggtttcactttgccttgttctgtccagaaactttgatgatcaaataaagtaagccatcagtctccaacgaacaggtatgtatgccatgtcttgtaccctttttgtgatcatgtcctcacaaaaaaaaccaaaagcattgttgtgggattcttatgattggagtggatacactctacactcgtgtagtgctaaacagagtatacatacaaatctgaggccttatggcgaacgactcaaactccaaccatcataattcaaataggtaagatcaatttcattcaggggtcaacatagttttatcatctacatttttcttttctctgactatgttgttgatctcattactgaataggatcttaataatgaccacatagcaatccatatttaacactgtatttctttgttgtaaaaaaaaagagttgatccctgtttctttttacagcacaaatatgattcctagttggattcctcaatttggcgtgaaatttaaatctacaaaagaggcatgggaattttggacttattatggaggtcatactggttttgatgttaggataaattatgaaaataagagtaaagttgatggagtaattacttctgcaagatatgtttgttccaatgagggataccgggcaatagacaaaagagatcacaacaccaagcgtcctcgtgctgaaacaagaacaggttgcaaagctcggatcggaatcacagtagatagagaagtgggcgattattcagtatatgatttagttcttgaacataaccatgaactttaattgccttcaacatgccatttgatgccatcacaaagaaagatatcgtcattgcaagcatttgaaattgaaacaatggatgattcggcattggaccaaaagctgcacatgagcttgctagtcggcaagttggtggttcagtaaaccttggttacacacgtcgtggtctcaagaaccatttacaaaccaagcgtcaaagggagttgatgtatggcgaagccggaagtatgttgaagtactttcaggacaaagttgcagagaacacttcatttcattatgcccttcagttggattgtgaagaactaataacaaatatttttaggtctgatgctaagatgataatcgactatgctcagtttggagatgttgttacttttgacacaacatttgggacaaacaaagaatacaggtcctttggtgtctttgttggattcaaccattttagagagagtcatttttggagccgctcttttgtatgatgaaacatagggtgatggcatggagcataacatatttgatactacctggaattttgggttcaatgcaaatttggatgggagtagctagatgcctaggtatcaaattgagattaacaaatcaggccattgaacatttacttttgagaacatccattctttttttttttttgcaatgccacagaaaatttatgctatgcattcttctgtcagtttctgtcagtgtttagtactgaactatttgcacacatgaagttacctttgtacatgtttccattagagcattgtgtttaatcttcctgaaaccttttcatcatagcactattttgtagaaggtgtaaatgaacgatgcaacatttttagtgttacactttggaataagtgtaggcttcacagtgaggcgatgctctgcttatgatatttgtagaagatgtgaaatggcaggcatatcgtttgatgaacaacacatgacatatgtataaacagagtccgaagctttcatggccttagccatgtaactgtcaagtaagtggtgggcagattgagcagaatcagagccatccaatgtaatctgatagcttgatttgatcgctacagcacctgtgcagtattaactgtacagtagacgatccgtttcctggaggttgcgtacaaccgggattagtatagtcgcccgctcaagatatctctccttaagctctttgtttcaatatggtacttgctctaagaggcgtaataattttaaggatacctaaatagttgcaatatctatacttagtgaaattagtaactttcaatatataataataatatagatataatcatttttatgcattaattcatggcacattaagttctaacacctaaaaaacaaggaggaatatatactcctatgtaataaaataatatagttatcatagtcgagtgtatccatagcatagcgaaaatccaccgtattgcggttttggtgctagtgtcaacagtgtactcaggactattatattcttgtaactttaagtgatctatagacatgtcagcatgatggtgataataagataatcgatacatgcaacacgtttaaagattacatatggctatgtcacttatcttatttggttgattttgtaaaataagctacaaagaacataaaatttatatggatgttatatcttggaaaggctctatctaagaatgggttttccgagaaagcatgtgacaatagttatagttaattatcattcataacacgagttggtaatggtaaaggatgtcgactaaagttatatacttaaattttaaacttttggttagttaccgacgagtctatttcacaactatggaatccaacaaacatgtttgattatgttcaatcattgcaaatcatgtcatctgtcacacattagctaataacaaaaacaaattgcacctaactcacagcacaaaaattcgctagccgtgcaagatcatttctacttttccttacttttatttctcgttcagggcgaccggccgaaacgtgaaatttgcatatcaatcatttgtcattgtctatatatagatccaattctgatgacattgtgtggtccactcaagcacgtttccatctcccttgatgcaattcactaaacacaaaattcttttcctacttgtgctggtaacaaacaaagtttactagtaacaaatagccaaaccaacggtgaggagagcacaccatctctcactgcatagacacctgtcatccatacatccatctagctaattaacagcttaatcacttgataaacaactcactctgtttcaacatctagtgcttcacgtgatatcaatgtgacattacacctgtctattctcagccctccaacctaataaaccccgaaatacccctacatgattgatccttgatccataatcactcgcttaatattctaataaacagctggtctagattctaaaattacaacatctcaagatctagattgtttaaaagggtttttagcaaccgaagattctaagagaagttgcagctgcgaaaagcacctctaaacacacccaaagttttccaagaaaattcttaagggcattatggtcattcgacacacacatagtaccatctctgtggaagcccagaaagtgctctataaattcagacaaaaatcgtcctctgcacctgcacacatcatcactgggacaaccaaagaaaaagaaaaaaaaagagaaaaaaagagggaacttttcacggccgctgaagcctctgacactccactgtagtgtgtcagtactccggccacctctctcggccgttgctctcccatggcgatgatggcgatgggcgcggcgtcctgggccccgatcccggcgccggcgagggcggcggccgcattctatcccggccgcgatcttgcggcggcgaggcggcggcgtggggcggcggcgaggaggccgttcgtgttcacgccgcgtgccgtgtcggactcccggagctcgcagacgtgcctcgatccggacgccagcacggtacgccgcgatctcgccgccggtgcccaaaaaaattctactcttccagcgctcgcttttttctttgcgttcacgagggagaaaagttcggatccttttgggttgggaaaatcgaagggtcgttcttgggattcgatgtgttgcggttattttactcgacacatttggatgagcgaaatgtgtttgatatgtttcttgtggggattcctgcgagtgcgaagtgtttgtttttttagagtgttttggtgtcgatttctcggtgattctatcagctgttgcgttcagtactctctgtgattcaagaaacggtggaaagatgatggtgacagtatctctagtttagttgttggatgaaatattgacatatctttaacggtggaaaggtgattgttagtgagaaccccataataattaattagtggaggatctatcgtggtccatggcttgaatttaataattggctccagatctgttgtagtacttttgagtttataatttattagattctgtggtagaactagaagtacagaacttggaactcaagagcatttcatctgttatctatatatagtctgatgatgatttgtattattatttttacatccaatttttaatcctgcagagtgttcttgggatcatccttggaggtggtgctgggacaaggctgtatccgctgacaaagaagagggcgaagccggcggtgccgttgggtgctaattacaggctcatagatatcccggtcagcaactgtctgaacagcaatgtgtcgaagatctatgtcctgacacagttcaactccgcgtcgctcaatcgtcacctctcgagggcctatggaaacaacattggtggttacaagaacgaggggtttgttgaagttcttgctgcgcagcagagcccagagaatcctaactggtttcaggtatcttggttaatctgtattaacttgccaaattttttatagtagtactgtattagtttgaattgactcggtaagtggtaatttttgtactatgcaggtactggatgtttctgcttctgtgtattattgaatggtctcgtttagctgcaaagatgcatgaatgccagttaaagtttatactttatagggtacaaagaaaagaaggggatacataattaatatgaacatacaccctgttttacggaacaaaagaaatattagggttaatgtactcctgttgattcactcttccatattttctcacatttatagttaagtgaaactgttcactagtttagatgttccaatgatttctttggaattgcaaactagagttaacattgatagatgagctcttaggttaccaactttcatgttatatggtttctgtatgacaataccttaaggacgctgcctaatttattttgtttctttctgtctcagggtactgcagatgctgtgcgacaatacttatggctatttgaggaacacaatgttatggagtttctcattttggctggagatcacctgtaccgtatggactaccaaaagttcattcaggcccacagagaaacaaatgctgatataaccgttgctgcgctgcccatggatgaagaacgtgctacagcatttggccttatgaagattgatgatgaagggaggatcattgaatttgcagaaaagccaaaaggagagaagttgaaatcaatgatggtaattgatgagtcatccgttgagaccatatgcaacctgatctgttgaagcatacatttcagtgattgtctgcatgttttgatcttgcaggttgacactaccatacttggccttgatactgagagggcaaaggaattgccttacattgctagtatgggaatctatgtttttagcaaagatgtgatgcttaagcttctccgtcaaaatttccctgctgcaaatgactttggaagcgaggttattcctggagcaacagaaattggaatgagggtacgctatgctcttgaaacttgtagcatgtagggaatttttatccttctctcagttcatgctgtaggttttgtgaagtttggtatgtaaactgcagttacatcatttattgtgaaatgttacttctttacttaatttttactttgcatgtttgcttatgctgctaatgtatttgataggtgcaagcttacttatatgatggttactgggaagatattggtactatagaggcattctacaatgccaacttggggataaccaagaaacctgtgccagattttaggtaaggtttacattttgcatggtgaaaacaagttacttttaaaagggtgcatttctgctgaattttcttcctatttttgagcaaacattattgtgtgcagcttctatgaccgttctgccgcaatttatacgcaacctcgatacttgcctccatcaaaagttcttgatgctgatgtgacagacagtgttattggtgaaggttgtgttattagagtaagtatccttttcagatgaattatcatagcgcttccttctatgatctgtggatagtattagatcataacatattaggaccttgagttattacttgttagtcgaacatttctttttcattgcttcaaaacagagaccctaaatttgttgacatgcctttccccctttattttggctagcattgcacaatcaaccattctgtggttggactccggtcctgtatatctgaaggcgcagtgatagaggactctctgctaatgggtgcagactattatgaggtaaaataaaacaaaactatactatattatggtgtattggtgttgtgggaacttaattgtgctttttgttcagacggagacggacaagaaagccctttctgagactggtggcattcccattggtattggaaagaatgcacacatcagaaaagcaataattgacaagaatgctcgtattggagaaaatgttaaggtatttcatatatatttatacttttggttgtcaatctgatgaagtgtgccttctgtattaactgatcaactattcattacttgaaagaaaagagagggacaagcatatttgtttgaatacaaacttggtactttctcatgctttttgttaaaggtggccttttgcaaatgtgcatcttgcatcactggtttgaaagccctttatcattaaaaaatactactatgtcatcatactttttccccctaaattatctttcttttcaaatgctatatgtcttttcttgccatgggtttttgccttgttgagtatggatctttaattatttacttactaagcacaaactgaaaaaatccaggcaacccatatggatcgatttacatattgtttctctcacttttccagagatgaccagttgatactgaactgaacaaaatgatgtgcaatgtttattgcattaattaatgatcaatcttatatgatctgttgcttgtacagataatcaatgtcgacaatatccaagaagcttcaagggagactgatggatacttcatcaaaagtggcattgtcactgtgatcaaggacgccttaatccctagcggaacagtcatataaaggcaaccaatcaccactgtacataaggttctctcaaattctcatatttattctatttagagcgtttggacatcaccaattcaccatgaaatgggaagcgtcttttattttccctcttacaaacaatttctaccaaaattggatcgactgccttgcttaatgctagaatttgcttagtagctggtaagcctcatatttatgcttaaataagtgattcttttgttctgtaatgcaggttgggccttgcagcatatggtgatctgatctccagtgcacatcaagcaatcaacttttaacgctgtggtttattccatgctgccagttcaccaagctctgcatcaacttgcaaggatatcataaaaaaaataaaaaataaaaacaggtgccacttaaaggcaccattttactgttactagtatgagcaaccgctctagagcttagaggtgttgtaagtccgaaaaccgtgtctgaaatgtgggtattttgatgtgtataatctttgtccttttgcatgatcagatttaaatatcctgtgtttatttctacctcttctgcttagatgccatttctttttaatgcttgaatgttccatgcattgctgatgaaagaggagctaatttgtgtcatggattttgtccttgatattcacatatatcaaaccaaaatgctacataagcaacctagatctaagggatcgcctgaatatgatggtgtgatttagaggtttaagtgtggcctgcagtctcagattttggtatcttggtgcatgatgctgttgaccattagcatgcacttcagaaatcagaatttatattttccagtgtgtgatttgatctggcaggaactattcatgcccatattgaaaatagaaacatcaagatggatatgcaaaataacacaatactgattttctacagttgagctatcagtcaaatgaacatttgattgtaaatcattttatagtttgtttcgctaagccctctctttgttggatcaaatttacagatgttgaaagcagctaacatgtaggaatgacatgtcatgattattggctaggaagccactgcaatttgtacttattcatatccactagctggtcatatgcacggctgtgcagtgtttactgacatgaatggtagggttcttcccctcaaaacaaaataaaaatgaatagctgggttctgttcatatcacaaacagaacagaacagcaaacaaaacagcctacctaagatcagtaaccactactcactcatgattctgatccaattctactagatggactgatgtcatatgatgaacccaatgactaactgacaaaaatttcttgtctgatgaaggtaactttcagttcagattgaacagagggagctctgcatagaagggagccgacataaccttcagcacatccttcactgatgacatcgagcttatcgccgccttcaggatctccctcgagcatccgggcttcacaatgttcctcacctgggatatcagtttgacaagcttcaactacaggtactgaattttttttttagctcttatgaagttaacaggttcagattttgttgacaaaccttctccaagtagtcttgcagtagctcaatgtcacccaggtagtcttggtcttcgacagtcagtgtgattggcttaacatttgttccagatccatcaaattgaatgccccctggagttctgtagaaatcatctaataggaagctcgaggctttctctctcaggagcctagagtaatgagagaaacaagaattagtttatagttttcctctgccttataatctgaagagtcactgtaaaagatcaatgatattaacacaaaaaatgatgcatttatgtgtctacatattatgcagagttaatctaaactaattctatatcatcttactgttgcctcattaactaaaaacttttgtggcaatattattaacattttaccggaggaatcaacacatgatttttttatgacaagccactgaatgagattcatggatgtcagtgttcagtcttttgcctgaagcagcaaattaatagttttaaggctgttaactatggacttacgcataagccttcccttgcaggtcaactggagaaggatggataactggctttccagtaggaacagctccaggactgcgtgagtgcctcttcacactcatcattgcctggtaagatttagaaacagtgtatcacgtcacaaactcgaacattttaaatgagcataattaatgaaaacaatacagtcaactaaaaagcatactgttagaggaacggcagcgcatcgccatttgtttgttggttccttcagatttgttgcaaaagccatgtaaccattcagcccagctgctagtatgtgcatgcagatatgaccaagaacctgcattcttcaaggtttagagcctatagcatgtgtgtgtgtgtgtgtgtgtgtgtgtgtgtatatatatatatatatatatatatatatatatatatatatatatatcttttatttgtgacgaacatagttcaggtttactacttacataggcgtaatcacaatcgaagtttgatggtaaggatcctcgcgcttgatacccgaaaaagtggcaaacggagctgaatttccttccaatgtatttcccctctttctgagaatcaagcacaatcaaattaaaaaaaaaaagaactgaatactgaactgggcacataaagctcaagttttaactgaacttaccattcgcttgttcatttctgcttctactaaatgagctaagagttgctcagtatcaatctgaaaatttcaataaaaagtttgacatcaaaaattgcatttccatgaataactgactgctgagcattccagaaaacacaaacctgggacaattgtgctgagttatcggagtcttgatgtagcagcaactataacagaaagttccaaatcttcagaccacaatttttattaataaaataaattatgttagtaatttaatacaccaatacctctcttcttatgaaaggaggcaagtaattatacaaggcagtagcccatggagaaagttgagatggaatgttgttctcaggaactttattgctgtggagaatattaatttcctacaatacgcataaaggaaaccaataagatttcatagaaatgagatgtcactgcattttattgtagtaacaagtataaacctgaataagtgcaaacatttctggaatgctttcgattagtccctccgaaataagtaatacaccatggtacttctctgaaaaattatatccaatatattagattgtcacaaagttacctcatgtttctatttaattgatatatgcacaattcagtctttagtgagaattcatcaacttaagacagccaatgaattgtagagaccttgtgctgcccttgcttgcactccatcacatatcttgcttataatttccttcaaagtgagcttggaaaatgccacttcttcccctaaaataacctgcatgtgaaaatgtacaattataaaaataattctacaactgttcacttatgctagattttacgatgcatttgatcaaggcgacaaggcagaccatatttggttgtgattgaagtgcacactccaaggcaacatgagatgctttccaacccatcacacggacaaaatggtagtactgcagggaaattatataaattagataaataataagtgatcctaataagtccaatttattatgatagactataatagagtgtaccttcccagctgagattgcatcgaggcaaacattacttataagctgggaattcacctgaaaagacattttcatagaagacatttacattaaaaaaacatgtcatgatgtaacactttgtatcctttatttaatttttttgggggaatcgtacacttgtatccttcatttaattttttttggggaactgtagatactgtcttagctttaaattggaattttatttgctgcatagcctgcaagactcaccttgcacactgtatcaaacccaacagttgtctcaacaaactgattcttgagatcaccatttaatgaaacaggcacgcctacaacctgtcaaacaggataaagatctgaaaatgggagttatattccaatgtgaggatgtggaattaacaatgtgtatatacctttgtcttgcagttgtgattggcaaatgtttctgcaagctgagcagcatctgaattggaggtcacccctgaagacaagataacatcaagaattacacaagtccttaaggcagagaatgtttttgaaataaggttgattgcttggtccttattttcatgtaaccccaattttttcacagctctttattcactctagattgaaatggcatggaagtgctcatgtaaaatccattgtgatgtttttttttttcatcagcaaatttgctggtataacctattagtacctccaatgatgacgaggccatccaagtcaagatcacagcatgttgacattgcagcattcacttgctcagttgtgtggatttgatcaacagttctgccgagaaaatcaaaaccaccttcaagaaggtaaagactttcttgttatataggccataatatatttagaaagctagcaatcaagatcaataaatttaaaccttggtttctatatgctgaaagaacatcatctgtgatctccaatgtctgatttgcaaataggccttctgtgccacctatttagaaatacaaagttcttcatgagacttatttttatcatatctttttgcaggaaatcaatatatatatactaagccaataaatgtcacaacaagcaatccaataatgtaaatatcacactgcttcttgttagtccatttaaaatctagaaattgaaagtatgctcaattactcaccaataaatccaagcaaaacactttgtagattttgagttttcatagcatcatagatgccccatatcacattgtgcccccctggcgattgcctcccagagaacaccacaccaaccctagattcaagtaaatatcaagcctgagaattgtgtgttgatagatcaaatatcaagttttcaatgataaagaattgacactagttgctatcacactaattcggtgttcaagccaaacttgatttgttctgattttttttctcaactgaaaaatggatggggtttagcaccattctgaaaaaggaaaacgaacctgattggtggatgttcatcgttggcttgcgcatccatcttgttcggcttcaggaaatgtaccagaggctgaccaaaggtgttgggaaattcctgcacaaccatatttgcgcatgtcgggtcgatggtcgtcgtcgaatcgccaaactccactctgatggcctttccctgaacatgttggttgaaaaactttgagagaatacaaatacaaggacctaaatacaaagtgaacatactgtgttcaaaacttgcaacttttcataattagtgatgaaaaaaagtagcttgatgcagcttgcaagtggtgaggatgaaggagagcttgcaaacctcaaggcatggaggcagctccggctgatacagagccctcctctgctgcaacccggtgagctccctcggcttgccgaggtccgcgttcatggacatctcccttcttgctcttcttgctgcaaagaaagtacaaagtacaaacttactttgcaatttgttcttggtgcagttttttttttttctccttgtgttcttgcagccctttttgtagggagacaatggaagaagaagaagaaagtgagactttttggtgctcctgcagtttcttggccctctgatgacaccaacagaaatttgaccccagattccattgttgcatttgtctgtgtgtttgatgttcaagggtgcaactgtgtgaattgtgattggtcaagtggagtggccttctaggttgccaggatgcaggtgacctttttatttttattttttttaagaaaaataaaatcaacctgcctacacaaaaaaatatttgatacatctgaccataataagtatcacaacagaagtacagaaccctctcttgggctttgtttgtgaacatttatcgaaattccacacaattttagaggaattggtctatgtgttggactgttgatgctcaagagttttgtgtagagctgtgattggtcaggtggagtgaccatctagaaccaggtggtgagtgacatgtgcagtctgtgggccatccttggagaaatgttcggaggaaaaaaaacaaaagattaaatcacaaacaaaattaatcccagcaacataagtccaaacatgctatgtgccatcaacctttttttaaaaaaatcaaatcctaggatcgatttcacgcgtcaattaaagaactgattaaagtgggtgatcgatgctaaattcttgtctccttttgcaaaagccaaataattggggccatggagccatcatcaaaggctaaaattctgttctcccatttaattaaaatttaaacaaccattaattcgattcgtcggcgcattgcgttggtcagcatccacctgttggaaccctttcacgtcgccggcctcctggaaagaaagcaacaaaaccaaaccttgtttttgctctctcgccgtttcgtgcgttctctgtgggtggtttttcactcgtttcgccggcgtatgtgaagtcttctaactcggactttcgaagggacggttgatacaatagtgattcttctttcttctttttttttcaatacacagtacagacacatgcgctgatataaatgcgtgaacactcacttttataaacgcgcacaaacacattttacccctatgataacctccgaagactaggctggcgcatcttgatatcgacgaagttatcatgaatatcttgctgttgaagggtatgtctcttaccacttaaaacacagctagctgtaaacgagagtatccatgttaagtttatatcttggaccgagatatataaacacgttgcattacaaaagacctaactactccctccgtttcaggttataagatgttttaactttggtcaaagtcgactaagtttagataaatatagtactccacccgtcccaaaatataacaacttttagccatcaagatttgtcccaaaatataacagcttctccaccaatattctctttctaacctatcacaactctccaccatttactttcctcacctactttcactactcaaccaatcacaacccaccaccattcacttctacctactttcttaataaccgtgtccaactctaaaaatacttatattctgggacggatggagtaatatttacattaccaaattagttttattaaattaataattaaacatatttatataataaatttaactttgatactaaaacagtttaactgatcaaagtcaaaacatcttataacctgaaacagagggagtagttgatagctatgctcactttgctgatgatttttttttcttcacgctgaagaatctgtgttgcctgcatatggttagatttgaacaggaaagatgatcgcgcagaatctctgaaagcctcccattccgccattcgattgatgaatccaggacattcgtagctaggatcccacgggtttggacgatcgaggttgatacgatcgatcgtcgttgtcgcgggaacatttcgcatagctaggcgccgtcagaattgtcaggctacacgcctacacatagcccacataggctcagctccacattccatctgcagacaggcacagaggcttgctcaaaacttggcaggctggaaacaatttgcattgcaaacagtattatgttcctcctgaatcctgattagttactgtgttgcttatttttcatgtaatgcaaaatttgatgtgatgtctgttttttcattttgttagtatgtgaaagcaatagccaacccagaaaaaaatcatcagaagtcacatacatatcataacatatggagtatattactataattttgaactaataatatggtaataggctaaaacaactaaaaattaaaattctactcgggattcggagatccaggtagaataacgtaagaacgcccctgcctgaaagttctttcaacaataaatacattggattacatctctcggcaagacattccttggccatctttctttttctcttttttctttgtcacaacaaagcaaattggctttgccatctcattctaatgttccttttcgttttctgcaaattaactatctgagtttcagattatggcgtgtatcacgagctggaaaataatttatggctaatgaatttatatatattaattaggagtgcaggaatgctgggtgtgtttggttgcaagccacactatgccacagtttgccacgcctaaggttaggcaaatttaacaggtatttggttgtagccacagttgtggcaagattcccctccaacaaattgggtcccacgtgtcaatggctcaaaaaagtgtggcaagattcccttaggcttagtaagttgtggctaacaatttgatcaccccaccttaggcaaagtgtggcaacttttgttggcaagtaatggtaaagtgtggctgggaaccaaacagccccaggattgaacaagaccaaacaaagctaccgggggagggggtgttaatggtaggtaaaccaaaaacccaaaatcttttgcggaataaaagattttcctcgaacatagtagatgacgaacccctgttgccatcggtcgatccgctcccaagccgccgatcagactgccgtagcctcgccactcagactgcgcgcacacctgcagttagattaaaaccttggggagactaaaatcaaggaaaagcaaaagaaaactgaaaagaaaaactcagccagctcacccacaagccaaccacatgccgacggtaccaccacacatcactagggagaaaaccttgcaccaagctagctactgctatgcgagaccagtcgctgctaggcctacaacatcgcgacaccgctcaaagctgatagagccaaacaactgaaggacacaagcgctcgcaaatgacatcctgatattagattgcatagggagagggtgagagagtagaaagatcttcccatccccctatagacccacccgtcaacatagagccaagagcaccgcaaaccgcccaaccagcataagccttgctaggcagctaatcaccaaaagtgaggactcccgaacatcatcacaatttagagctttggaggaaaaatgtgagagagaagaaagatgcgctcttcccccacacagactcgccaccatcatgacaaccaagcaccgttgcagttgaggaccaacaattcaaagcgaaaaaggcataggtatctccacggacgacgcctccaaggaggttgcgacacgggagcatcaccatcacccgcccaaggactcttgagcgaggtttttcctcggggaaactcgtcagagaaggaaagagggcatacctcaacaccgcctccaaggaggactatgcatggatgcatctctccaaatatatttttaaaacaattttctcttctaaattatttatctgatatatgatctgctaacgagttcattgtaattaaatatttacaataagatctcatgtaattatattccgattgataaatatatatgttttaacaaataaaatttgatgtttcatacatctattgcacattttaagttttgattttgtaatatttttggatgagtgtggttggcgctcaacatttcatacaatggtttgttggtgttgcaaccaatatttattaaatgttgcatcctttaaaacaattgatgaactgagctgaaacatttaatccagggatgaaacaattttctccaacttacgaaacaacgactaacgcctagctctatccaaaattgtgccaaaatatttcttttctatgagtaattttattttatttttccttatttttgaagtttgaaatgttggttattacataggtaggtccgaatttttttaacaaagaagtatgagtgattctatattcgtcaaagggtgtatttgacactctcctttctcatcttctacactcttattttctacacacgtgtttccccaactgctaaatggtgtggcatttgtaaaaaagaaatcgatagaaaaatgttttaaaaattttatcaattcatttttcaatttttttagctaacttaattaatcatacgctaatgggctaccttgttttccatgcggggaatgagttgcgaaccaataggttcgaaccaagcctaagagtatctccaatagcctctccatctcactctccaagtcaaaatttagcaactttattttgaaagaaaatcgtactccaacagcctctccattccactctctaagccattcggatggccaaactccttccctcacttgccaaacttggccaacctatcccacttgccatccatgggtcccacaaccttctattcactttttctccgttcgggagcagagtggccaaaagggagaggtagtggctgacggcggaagcttgaggatggcgagatctccgatgaccatacggaggcacgggacctggtcccctcggagtggcaagccaatggcaagatctccgtaggcggcggcaccctgcaggagaatccgaagaagaagcaacgccctacaggaccaccgcctttgtttgttggcccagtgccgctaccgcccttgccggtgcgagcaagaggtcctgcaccacccatttggctgaatccacgtcgtcgccgtttgcccaaatctgcgtcaccgcttcgtcatcatcacgcccatgcacaacctcaccgcttatgcccgagacgacgaggatggtggtggcgacagtgaccattgccaccgcctacggtcccgcggggatttggccagtggcacgacagagaagaggagaggggggagagagagaggagagagagggtgaagaagcggtgaaatagtagagaggctaataggtgagacccacatttagattcgatagtgtaatagagagtctgttgaagtgaaatgcaaattagactttccatttggtttggcaagttggacaaatagtcatttgaagagtgagatttggagtttctgttgaagatgctctaagagctatgctctaaaacaggcaacatttataattaaaactgtcaaattcgtatgaaagttcaatattttttccccaaaagttgattcaaaattttgaaaatggatcgagattgtgttcctcggtttctaatatgcgaaaaaaatattactagcaccccgtacggaatgcaagaatttcagataatcttcggtcagagttagaggcaaaaacagaccaacagtttaatatcaaatactccctcatctcaggttataagacgttttaactttggttaaagtcaaactgctttaagtttaaccaagtatgttgaaaaatagtaacgttgtcaacccaggacaaatttattatgaaaatatatttaattattgatttgatgtaaccaatttagtattataaatattaatatatttgtctataaaattagtcaaacttaaaacagattgactttaaccaaactcaaaacgtaaaataacctaaaacgaaggtagtagcaaaaaaaaaaaagaaaaagttcacatgttttcgattgatgcctaaactaaacagagaggggtgagtatcctcttccatgcggtttcttccgttgcaacgcacagcacgtgcgagctaagtttgcatcttaaaaaacgcgcggaggcatggcccacgcaacgcgccaagccaccacatcacgttcgcgcccaagcgagggcggcgaccgatcgtcgaccatggcgcgccgccgcctcgccgcggcgacgacgaccgtgccggcgatcggcgtcctcatcctcctcctcgcattggcgccgtcgccggcgacggccacggtgcccgcccgccgcagcgccgtgtcctactacgcctcggtggagaaccgcctccctgccgcggccggcatggagctcgtctgccgcgcgctcggcccgggattcgacgtctacccggagctcagcgtggtgccgcgcggccgcgttccccgcggcggcgcgcgcgtcgccgaggtcctcatcgagccggggcccgagcgggtcgcttgggtgctctgcagctggggctacgaggggaactacctcgccaacctgaagctgttcgacaccgagtggccggaggcggcggcgtgccaggacccggcggcgagcggcggcgagctgtgccgcctcgtgttcgaggacgacgcggtgtccgtcgtggcgcccggcggcgagcggcgcgtcgtcggcgacctgccggtgaagcgctgccggcgacactggctgctgttcagcaccgggtgcacgtaccccgaccacccaaacccgtacgccggccggctcctccgcaacgccttggagttcttcgccgtctgaagaatctgacggactgatcagatttttttttgtaataaatttctgattagttttgttaggatttagatcagaagcatcccaaggtgtcgatgtttgcgagataaatcaaccaatttcgtatggattttggtgccttttttttgctggcaaatctggcattctccatgaatcttgcaatcatgcgcgcacgccgaaatcttgctacttcctccgtttcacaatgtaagtcattctaatatttcccacattcatactaatgctaatgaatctaaataagtatatatgcgtagattcattagcatcaatatgaatgtgggaaatgctataatgacttacattatgaaacggagggagtaccaatgaaacaagaaacgaacaacccgttgaattaatccaattgccaattcaaatttgctcaaaattttactacaccgtcacaaaatttcaagcgaataaaaattctatcagaaatatttttacgattctcgcaaaaaccagttcaattcttcgaagaacaacaaaaaaaattctctacatttcataggaaacctgaactgcagttcttcataaatcggccaagatggagcaatagaaacataggagatcgaggacactcatgttcaaaaattcaaaattcaaacactcgacatgtctcaaatttcaaactctgaaactgatgaaactcataataactctatcattagattactgtgaggtgtggtcctcgtgaccgtccaaaaaccgttggctattttgagcgctcttcccgccaaatttggctcggccgcgcgcgcccgccgccgccgcttccgctctcctctccatctctcccgccaccgccaccgcctcctcccatttcccgcacgagccaccaccacctccacctccgccgccaccgccgccgccgccgagcgattaactcctctcctcctcctgcacgtcgtcgtcgtcgtcgtctctctgcacgcgagaaaacgggagaggcggccggcgcggcgcgcggccactagtcatcccgccagggcgcgcgccatgtctctgcacgctcgcgtcgcgctcttcgccgccgcgctcgccgccgtcctcgccgcctccaccgccggcttcatctcaagtccgtcctcctcaccgtcgtcaaacgcaacatctggagatctgacgaacactatatgcatgtatgtgtgcagatgaggcggtgggcgcgtcgtcggcggcgagcggcggcgcggggcggagcttgctgcaggcgaagaaggattgcccggtgaacttcgaggaggcgaactacacggtgatcacgagcaggtgcaaggggccgatgtacccgccggcgctgtgctgccaggcgctcaaggacctggcgtgccccttcaccgcctacatcaacgacgcccagaccacctgcgccgcctccatgttcagctacatcaacctctacggcaagtacccgccgggcctcttcgccaacacctgcaaggagggcgccaatggcctcgagtgccccgaggacaccccccagatgaagcccggagaggacaaggccgcctcctccgccgccgccattgtcgccgccgtcgcgcggcccgtgctcgccgccgtgtccgcgttcttgatgcttatcgtgtcctgaatgatcgaccccatcgatcatatgtatatctgaaattaattaatttctgcactgcacagggtggtacgacgtaattaatctaattaattaattaattaacctgttatttccgctcttgcagttgcttgtggatgtggtagtcaaattcggagctcctgtaatccgaatgcatgtgtttatcattatatgctagagatcccagaagattgccaccattaacatgcatgttttaaaaattcatttccaatttcaatccatataagaaaccatatctatgtacctatctctatctctattctctctatctctattctctatcctcttaaaaaaataaaagatgcttccatcgtccgtaaaaaaaccggatgaaaaaaaaccaaatatgtccgataaaaaaaccgggcgaaaaaaccggaaaaagaaaagaaaaaaaaatctgtccgatctaaaaaggacaaaaaaaaaagaaaaagaaaaacgaatccgactccgtcaacacggtaaaaaagggcgaaaaaaataaaattaaaaaaaaaacaaattgtccgatcaaaaaccgggcgaaaaacaaaccgtgcgaaaaaaactgtggaaaaaaatgccggctgtaaaagaaactaaaaagacggaaaaaaagtctgatctgatgcaaccgaaaagaaaacaaacaccctaaaaaaagtcaaaataaacggaaaaaaacagaaaaacgctaaagtccgttcaggatgcaaaaaagaaaagaaaaagaaacaccgtccaaaaaaagtcaaaagaaaaggaaaaaataccatctgatctctattacctatctctactgttataaattaaggatgtttttaccggaagtttggtacgtcatccgtatttgaatcggtttcaattttatgttttggttttaatctatatatatatatatatatatatatatatatatatatatatatatatatatatatatatatatatatatatatatatatatctatatatttatatctatatctcttctctatctctatctctatctctactctctactacttaaaaaaataaaagatgattccttcgtctgtcaaaaaaaaatcgggcggaaaaaaccgagcgaaaaataccgggtgaaacaaaagtccgataaaaaaaagggagcgaaaaaaacgggagaaaaaagtccgatccaaaaaaccgagcgaaaaaacaaatcagtccgatcaaaaaaaatacggggcaaaaaaaaggaaaaaaacgaaacgaatcggtaaaaaaagggcgaaaaaaattttaaaaaactgtccgattccaaagaaaaagaaattatatatgacatggtaaaaaaatcgactggacgaaaaaaaccgaacgaaaaaaccaagcgaaaaaataaaaaaaatccgataaaaagaggggtgaaaaaaaaacaaatctgtccgataaaaaaaaggaaaaatagaaactaatccgactccgtcgccgcggtaaaaaaaagggcgaaaaaataaaaaatatctgattccaaagaaaaaggaattatatgtgactcgataaaaaaatcgaatcctatgaaaggtccgacactaataaagtggccaaaaaaccattcgtaaaaaaaatacaagagaaaaaaaataaaaaggacggaaaaaagagcggcggaaaaaagtctaatttctattcgtcgttttagtagttcttttatatatcttctttatctctaatctaatctaatctaaatatttaaaaagagaagtttctaccgtatattaaaaaagaaaaaaaattgcgcgagaaaataaaaacggtttaaaaaacgcatgaggaaaaaaatgccagaaaaaagcgcaaaagaaaacgcgctagaaaaaaaagttccgtagtcagtaaaaaaacacgcgagaaaaaaatatttccatcgtctgtaaaaataaaaaaagcatatgaggaaaaaactgctagaataaaagactaaattgatggatacttggtcggataggctccatcgattttttttccatctcctacacgacttttgtttcgtcatctattctcccgtaggggtggacaaaaagctcaggctcgcgagctcggctcgggcttggcttgagctcgcgaagctcggctcggctcgaagactaaacgagccaagcccgagctccctccacagctcgtttccaaaccgagccgagcccgagctagctcgcaagctgctcggtaggcttgtcaagcctatggaaaactgagttccctaagcgagcccaagcccattaacaattgtctggcccatgaaagagagaaaccctaagtcctgagctgagccgagcgcgagccgtggcccgtgagcgcctgacgccccagatccgatccctcccctaatccccttcctccgttcctcagccactggcgctggcggcgactggcaagaggagttgccggccgccgcatccatcccctccccagcgccagaccgccagcggcaggccggcagcgccgttcgaacttcgaagccccctctatgccgccgccgccggcccgccacctcccttcctgccgcctcgctccttgcgccgcctacctcccctactgtgggtctgtggctgcgtcggctccgtcctccctccccggcgacgccccctgtgccgtcggcccgccgcggcgccgcctcccttccctagttccctgcaccacctccggcctccgtccaccgtccccagtgccgctcgagccgagctcgacgccccctgcgtcgccggcgtccctgactcgacgccgtccatcatgacctcgccgagacgccatgtcgccaaccgatcgacgacaattcatgcatcacgccgcaacgacgagcctaggatgaagaggttcgtgatgtattttctcatttttgtgatgcatgtacatgtaggcatgtagctgtagattgttgtggtcagtggagtagcgtgtgtgtgtgtgtcagtgtcaaactgtcaagattcaattacagaaagaatgaggcaaataaatcaaaaatgttgtaccaatactatagtttgaggctttgagccatgtgttttgtgtagtatattattcaattacatgatgatttatcatttatgtaggcaaatggatggctcatggctggaacatgttgctgtggagtgtggagaaagtctaggagttggagatttggagagttccttttaatattttgcgaaataataattagatgttctataattattttgtgaatttgagaatggagactttggacttttggaatgtggtctactctaagttatgtactctctataagactataactatattactctatgcttctattatggtgtggtcatgactattaagattatgtgtgtcatgttggggcatgtcctgtgagtgtgaggctgtgaatgaatgatggagattgtggaattgtggtcttgtgaagttgtgatcttgtcagcttgtgaaatgtataatatgttgttgctgtcttgttgatcgtacatgttgatttggcttgctaattgattgctctattgttgaagtatttacttgctgctgtacatcacaagctggctcgagccggctcgagctttgaaacgagccgagccgagctgcactttttgctcgttcaactaatcaagccgagccaagccgagcctgtagttgagcaagctttcacgagctgagccgagccaactcggctcggctcgtttccacccctattctcccgtattggagaccctgcacatctttataggcaattatcatactattttgtgaagtatagctattattcttgataacatattatatggaaataatcttagaaaataaacatattttaattgttatttagagaagagtgcacagtgattaggatttgattggttgcaataatgagattaaaagaatattttagattatatgcatgttgtcacatgaataatctaattattttaggtaaaacaaacatcgtaaggttgccatcatcgaggttgggatattacatttaagatgttccaattttctgattttctgattgtcatatatggttatgcatgaaaaacatatattatcattatatttttttcacccgttgcaacgcacgggcatatttgctagtataataaaaaaatactacataataaggattctggtagaggattttcgtccgtcttagtccatcatccacatcgcatacacctcttcaaatcccaaaccatcacaaatcaaactcaaaaactaaatcccaatccaatcgaaatcatcacaaaatcatccggatagatcacaggatatgagaattcaattgaaatcacaaaataagtcacacagaagatgagagtagaagcagaaatgacaaaataaatcacaaaagagatgataggagagggaggggtgagtgggaggccgtcgttgctcctcgctgcctcaccggcatggaggtctcgagatcagggccagatcctaactcgccattgtgtcaggaagccaccgactcgctgctgcgccgg

SEQ ID NO: 40929 - DNA, 1807 bp, Oryza sativa
gggtggtggtgaggaagtgggcgtgcaactgggatctggttcatgtgcagtagctagtgtgactgcaagttaagcagtcacacaagcactactgggcttgaaatggatgactgtagcaagtattgtagcgctttactataaaaaatatatatatttctgaattcactatagcaagcgatttggaacattggatcaagaaatagagggctaattatatgtagttgctattgtgcagtcacaatagcaactgcactggacctcaatctgtgcagtggtggtggggtgggtgagagtggggcagtgggagcaactatggaggaggaggagatggtggtggaggaggtgtggggaatcggagataaggttgattggcttcgatcggttttttcataggcattagtttttaaaaaaccagcacctatagtataaatataagtgttggttcttaaaaaaattgggatcttaattatcggtgtcagttcttctgaaaagaccgacactaatattataggtgtcggtttttatttagacactaatattataggtgtcactagtccacgtagccagctcattcgacgggcgggctcacttacacataccatcacatttacactttttgtcatcgtttcgtgttaaagggttaactcaggaataatatggttggagggaagatgccctataagttggctccactattgctaaacaataaggtggtactaaacatacacacagctctcatggaccacacatgctatatcttaattaggccagaatgtcacataatgggttaggtcgagcggaaggaggtaggaagcaacggattaggctaggggccgggggttgaaaaggaatgaaggaatgctttcgacccaaaaccaatgaatgattttagttaattttttccaattaaagtgtatagtgataccaatgttttaattcgttgcttagctcttaatagctgttatagcattggaaaaagtcttgctcatttcaacgcacagacatttttagttaaactacaaaattagtgcatagtacaactttagagcagtgtagcacatgaactcaataaaattacaaaaggggattagtttggcttatatactaacaggatttccaaatgaataattactcaaccttcatttaagatctgttatagcatcggcgtcaagaatattctgcccgaatctgcattccacgatgagctagctggtcatcgccgtcgccgcacctatgccaaacttgggccccacctcacagtctcaccctcgtactcgtcgctgagcttgctccaccacccatctgacaaccacactgtcaccgacaagtgggccccgcagccattacctacaactgcccctcgctggaccaccgtgctcccggtccacccagcagctggcaagcgcgggcccagccaacgtcacagccaccaacacactgacatgttggtccacaaaatcagcggggcccacgtgtcattgagcatgcagactcggccggtgccagctcagctcggccgcgtcgctgcttaaaacctctctcccactctcacgctctcgccatcctcgagcactccgccgccgccgccgccgccgcctcgacgcatccgcttccccccacgcgagccgaagcttctagaaccttcgaggccgcggctcccacgggcggcaatgcagagcgcggcggccgtcgggctcctccggccatgcggcgccaccaccgccgccggcccgctccagctccgcaaccctagcccccggggcttcggcgtcggagtcgggcagccgctgctcccgccgagggggct

SEQ ID NO: 40930 - DNA, 13892 bp, Oryza sativa
agacgctgcagctcggcgcgctcttcgggctgtggtacctcttcaacatctacttcaacatctacaacaagcaggtgaggcggctttaactttgatccattgccgtcgccaattggcggagatttgggggagactaggatgtttcatttgggatttattacatgtgattctgttagtggtgaatggttcgctgatggcaatctgatcttggatcgggcattcgccttttagattcagcaaagatctactcgctccgttgagattgttgagcaaaagagggaactattttgaaattgattttatttgtcttgtgaatcacttctaattataaccttttttgcctccatatgctggtatatgtcgttttctgtaaatgtttctaacccacttactgaatgggtgcaagaatttgctcaagctcgtctagatcttggattagtacaaactcaaaatgtatattgtggaaagaagagcgatttagtttatttcgttgggcttttagagatgttcccccacgttacaccttttctatcaaacttttgtcacaactttctaaaaggtacatttgtggatagtttatgtttgtatctggtataagatgtcgaacgggtaatattgctaaaatcatgtcttctagtgagtgcagtagacaatttcccatgtcttctggtagaaatatagaatatagaaggaaaaagaacaaacatttcttcaaagttgtccagactcatatgtatccatgtcttatagtgagtatatccaatgttctaccaaaacaaattgtgctagggatggaagtttgttttcgttcattatatatggtgtcacttatggttaatctgttgaaatttcttgatctcctcattggcttcgtgtagataaaacaactttcctttattgttcctatgtgtgacaggttttgaaggtttttccataccccataaacatcacaaatgtccagtttgctgtcggcactgtcattgctctgttcatgtggattaccggtatccttaaaagaccaaagatctccggtgcgcaggtaattatatttctctataagatacatcgtgacaacattcgatacacatgtattgcactatgaagccaactattgtaactgtccttatttcagcttgctgctatccttcctctcgctatggtccacaccatgggcaatcttttcacgaacatgagccttggaaaggttgcagtgtcatttacacatactatcaaggctatggagcctttcttttcagttctgctttcagcacttttcctcggagaggtaattttttaatgttctgcactggtgcccagtgataactatgcaaccgcatataatcttagaaaaaccatctgtttcttggtttggttctcatacataatcactttgcagatgcctactccttttgttgtattgtctcttgttccaattgttggtggtgtggcattggcatctcttactgaagcttcatttaactggtaagggatatagctagctatttttgtcttcgctgtggaaactgcaaatataacataagcctgctgatagcagagctaacaaagtgctatatgcttgattcgtctgtaatttatatgatatcagggctggattttggagtgcaatggcctcaaatgtcaccttccagtcaaggaatgtgttgagcaagaagcttatggtgaagaaggaggtaactgaataattagagtgcggtcatcatagatattggcaactgaattgcagaattagtacaagtgtgtgtttctcttgaatagtctgctttagtaatattcatcagttattttaggatgtgtcacttcataatgttctgtttcaagataaaatttgtattttaacagagctttttatttatgtccacacttgcctatctgtggctttttccttgaacctctattgtttgtcaccatggctcttacataacttaattctaatgatcttctttcccaatttctgatcaggaatctctggacaacattaccctcttctcaatcattacagtgatgtcattcttcctcttggccccagtaaccttgctaacagagggtgtcaaagtcactccgacagttctgcagtctgctgtgagcaccttgatatttaattatagacaaattgctccttacatattgtttggtgcaatttttgactattttctttcttatgtagggtctgaacttaaaacagatatacacaaggtcactgattgctgcgttctgtttccatgcataccaacaggtcagccatctaattgattttctaaaaatagcttggccttttgaaatctctggatgcgcttgttcatttcagatagattctatgtgctgaatacattacagttgttacattgatgaatcatcatacatgtgcaaagcccatgtcttgctgatctcacataatttcttgaaggtgtcgtacatgatcctggcaagagtgtcccctgttactcactcggtgggtaactgtgtcaagcgagtggtggtcattgtgacatccgttctgttcttccgcacccctgtttcgcctatcaactctctgggtaagaatcattttctgttcacttctgtatcaaattgactgcatcgcacctcctttacatatccaaatatttgcgccctgcaggaaccggagtcgctcttgccggagttttcctgtactcacaattgaagcggcttaaacccaagcccaagactgcctgattgtgtcttggtatctatcgtgaagaaccgtagaagcattgccacacgccatcggaatgagtgccttagcttagaatgatccttggagaagctccatccagtgaactgatgctgctgtgtgtatcgtttgtagttgagttactagcgtgctaatcgtggcaaggtttttgtgtcttctttaccaccttatgcttgaacagtcaattattttgttgtatcaataaatttcgtgcaatataacgttatattatctctgtttctttatggaagtattactatccttgtattataaattaaaaagtaaatttcataaaactatagatatcttgatcaaactatcatttaagatgtatgcaaacccaaaactacagatttagtaatttatcataaaaccgcagatagattttatattgaaattatagtccctagtactaccattgtgttggagctataagtgttgtggttttgtgattaaattggtgctaaatttgtagctttgtgataattttgtgactgaacatgtagatttatggtacttcgtcttatcttaaatctgtaggatcataataaattcaatgctaaatctatagttttgtaaaatttactctaaattaaattattagagttggaccattgttgatgatgcgttggaaatgggaaaaatcttttaggtacactgttagagccctttgtaattgtttgtgtaagatcacttaacaatttgtccattgcaaagtttggagaaggcaaaaatcacttttaaagcaaagtctttatgtgacttatttttgaaccagggtggggactggggagggtgtttaagtataattttttgaaaaatagatggaatgcagacttagtgtatcgcttctgtcaacaacatgagggtgttttatttgaatacgtgccttccgtttttgtttgtgtagttggaattcggaactgctattggagtaggttgctgcccgattaattttggtcaatattttggttggatatgcatttatcggcctaactataagaaggtttatatagtcggctcgattgcagtttattaggccatttagaacgtaagaaaacttgctttgagttaaaattaccaatactcttactgaaattgtgtgtttgtatttgtttgttgttcgatattggccagggttgcagaggcagatttggagaatgcagttaggaaatactatgccagcaacagaggtgcaatgaagatggaagcataagtcagctcataaaccgagaatgagatttgaagccgagagatatctctccaaatattcttttaaaaagaaattatgagcatgttggggaagcaccagcggtgtagtgatggagtcgtgggtgcatgaattcactcactaggatttaaatcctggtgcccacaaatactacgcatatgcaagtggatttttaataggactttagtgagattaggaatgtgctgttagtttccgtctcttagagcatgtgttgggatatgcatttgtaggggtatgagtgtggtgttacgtatgtagtggtgtgtgtgcgtatgcgtctgccgtgtaattaaaaaaggaaaattatgagcgtgttggagatttaacacgagatattggagttgaaatcatacacttcttatcattgcacgcatctcgagatcaagttaaaatgttggtgtatgttaatgacaaacaagagaaggaaaaagagtgtcgtaaaggttctatttcggtggtggtttctttcggtcttattgttttcaaaaacttaaatcaaaattattccaagagatattaatggttaaagtttaaacgtgttaactcgtttatgatcccataacttcatatgtacttggcatactcaactcaacacaaatatgtaatccttgttacaacatcttcactcattgaaatttagtagtaattaaagaaaatccgcatctaataatagctgaataacaacaaaagaaaaacatgaagtgtagtacggtgcagtgagtaaattctactactacttgtgtcccatctcaatgtctccccggcgtcgtgcgccgtcgccgtcgccgtcgacgaagcgcttccagtaccagtggtcgctccagacggcggccatgtcctcgatggggacgcccttggtctccggcacgaagagcgcgacgaaggcggtcatggcggcgacccacccggcgaagaagaagaagagcacgaacctgaggcggcagagcagcggcaggaaggcctgcgcgacggcgaacgtcatggccatgttcaccgccaccgtgatgctctgccccgccggcctcacctccagcggcatcacctcgctcggcaccagccacgccaatggcccccatgaccacgcgaacgccgccacgtacacgcacatggccgccaccacagccgccgcgtaccccgccgggatcgccgccgtccccgaccaccccagcctcgccccgatcagcgcccccaccgccgcctggctcgctaccatctgcgcgccgccctccaggaacagcgcccgccgccccacccggtccacggcgagcacggacaccagcgtcgccgccatgttcacgccgccggtgatcaccgccgacatcagcgacgcgccgccgccgaaccccagcgtcctgaacagcaccggcgcgtagaacatgatcacgttgatgccggtcagctgctggaacagcgggatcgccaccgccatcaccagcggcggccggttgcggcggcgcaggatgtcgcgccacgggctcgccacggcgtgggacgcctcgccggcggcgaccaggtcgttgtactcgtcctccatgtccacgccctcgccgcgcacgcgctggagcatccgcctggcctcgccgcgcctcccgcgctccaggagggagttgggcgtctccgggaggaacagcgcgccggcggtcatgacggcggccgggaccgccgcgagcgccaggctgaggcgccacccccacccgccggcgatcctcgcggtgccgtagttgatgaggttggcggcgagcacgccggtggtgatcatcatctggaacccgttgttgagcatcccgcgcatcctcgccggcgccatctccgacaggtacaccggcacgctctggttggcgaacccgatgccgacgccgagcaggacgcggccgacgatgagcatcgccacgttcgccgccgcgccgttgagcgcgcacccggcgaggaacactagcccgccggcgaacatggaccacttgcgacccgccacgcgcgtcaccgtggcggcgccgagcgacgaggcgagcgcggcgaggtagagcgacgaggtgaacatggtcagcagctggctgtcgaacctgcagtactggttcccgccggccgccgcagccgccgccgactgcgcgcggtacaccgacgggaagaacctgctgaggaacgggtccatggaggtgacgccgccggagacgccgatgtcgtagccgaagatgaggccgccggtggccgccacgaggcacgccatggacacgaacatggtgagcccgcccgggtactcaggccggccggcgccgctcgccgccaccatcgcgccgccgcccggcatggcgagctacaagctagctagcgaggttttcttggtgtgaagcgatcgaattcgtaggacgtggttggttttgtgttgaggagacgaggcgcggaagagcgttgaatttatagcgatacggtcacttcgtctacttcgacttgcactacgtgtgtgcgtgtacaagtctgtctcggagaaggtattccgagtccatttcgtcgtatttcgtaatcgtattcgtattcggagacgcatttgcagacactccggtgtctcgatcgggctcggcctgaaaggtgtgcaagtgacccggttttttctcgctctgttgctgtatgacagtattctaaaatgtaaaggcctttttttttagaattacacagtacaatgcagacactcacaacgcacgcgcactcacccctatgaatcctatgagtatcttcgaagactggatcggcaaatcctggagagattgacaaagtcaccacatgcgcacgcgcactcacccccatgaaccttatgagtatcttcgaagactggatcggcaaatcctggagagattgacaaagtcaccacatgcgcctcgcttcgtctaccactgaaagcacagcgcctcgtctaccactgaaagcacagcgccgttaaatcctagaaaattcgctcccatggggagtcaattcgctcccatggggagtcgaacccaagacctcaggtgctaccgaggctcttgtaaccactaggctacaggccatttcgcaaaatgtaaaggcatttgtttgttttctaaaatatatttgtatgtaaaaattgtccacatacatctatctattatatactaaaagttcattaaacttcatataaacactcctaagccgccacatatctttctacaaacgctcttgattcaacacgtggcacttttaaataaggtggacccaccaatttttttatttaacaaaggacccactattttccttcattgcatttactttaataataaaagaaaaggccctgtacaggtacatgtgctgcaaactgcacatacgtacacccataaccggccggtgcatctcctcttttctattttcatgccttattagattgaaacatattttgttgtaaattttttcttgaacaactataacatctacatcatatatatagctaattttttttatccatgtatactattagatcatttataacaaaacttataattcaaatcccaaattaactgtatttaacaagtaaaagaaatacattgctttggaccagctattggccactcaacacacattttgaattggaaaaacacatagatttttaaaccatgtaattaacaacacgtagtttacactagacaatataaaacacataaaactaattaataagattaaaataataagaacttaattagaaaatacatattcccccgtcccaaaatataagatatttttgttggatgcatggacatggatttagattcgtagtaataggatatccaattcaaccaaaatcacttatattttgtgccactacaaatatgccattttagaaaaatgccactactattcacgatattgcggatggcgtcaaggatggtggcggcgacggcacccaagacctcccatcgtggatgcgatcgaggacagagatggcggtggcggctcccgagccctcccacgcggatggcgtcaaggatagcggcggctgcatgttccgagccctcccgcgtggatggcgttgaggacggctgctcccgagcctcctgctacagatggcagcggcggcgacggctcccaagcctcctgccgtggatagggccgatgatatcggcgacggctgtggctcccgaggccttcacggaggtggtcgatgacggcggcagtgacagtggtggtcgacgacagtggtggagagagaggaagaggaaagagaaaagatgggagggaggtgaagatgaaacagacacttaggtcccacgtgcagttggggctaacggagatttttgacagataatgtgatggagtgacatggttctaattttctcaaattccagtggcacgtagccaatatcgtgaatagtaatgttatttttctaaaatggcatatttgtagtggcatggattccattaacccttataaaatatcctcataatgcatgcacgcaaccgaccctcctcaccttctcttccttttcctttaatctttttaatctattttatagtagttgagataatatttgttatttatcataataaattctaaacaactataaattcaaaattacgcatacaatttttacatacatataatgtaatagttgagacatgattaaactggtgctgacatattttaaattataataaataaataaatgttttttgggtcgtatattgacccttttcatcatatatgacaaacaaatggcgacatatattattttatcatatatcacttttacaaacatacataactaaatttgctctacaattgaaaatgaagtttagaccatcatattatttaccattaaattatattttactatctgttttgaatatatttcaacttataaaataaaattatattttaggtcacattttgattcttttcatgtaatccaaacatacatgaaaattatataacaaatgacagtagaaagtatatcattatatatctgttatcagttgacaaatatttacgaccaaataggatgacaaaatccaaaaatgctattgaccaatgcccaatttcaacaaatgtcatcaacaattttatttataaatactctacacatactaattttatttatataattactctcttatttcaattttaaattcatttttccaagaacatagtaagcatatgaaaaaaggaggtagtagaagtaaatataaatttgtcataattggatacaattttcctcttaccatatatcttaattgaacgtttcttccattaaaatatcctaaattcaataaagatatctatagtacacaagaaaagctattacttaaagtttagaaactccaaaaataagttatactaaatattaaaaacacgtatagtacaaatgataggtccatgtgaatcaactccatttccacgatacgatattttctcataaactcaacattttacgaattcaaataattttagtgtagaatttatatgttgatatggtagttagaagaaaatcatgaccagcattcaaagcaatcctaaacaaatcatggacaaaaacagatttagaatataataaaaaaatattaccaaaaaatgacccacatgttaatattattcataaaaattcaagcaacattaaacaaggtgtcagcaatgtgcccgcgcatgtacgtgggctacctttctagtttttttttaaaaaatacgtgaatatatacatgtattatgaaatggagatgatacatttgaaactttcactatcgacgataaccgacggttatcggacatatatatagatgtgttgcaatatgtgaaataaaccggctaagttcaaccaaatttcaattttttatggtaaaaattgtttgaatttttccgcgatttgtcgggatcttatatagagcggataggttttgtccactcttagacataaatgaatatagatacaattgaagtgaacaatcttcaaatagtgtgaatacaaatttgaatatgaataatgtttcccgactacaaatttaagtacgatgtataagtcataaatagataaaaaaatatttacatatatttaggaattgttgctaggcgaatccctgccaaacaactatacatcatttatgccctcttaagtctgtgcgtccagtctacttcttcggtcctttaattatagtctggcttgccaacagtccaacattactcagtgctataagcatatttactaattagagtataaaacaacatgcatttatacaggtcatattgtattgttggactcaatgaacatagtttgatccattaaatgagctaattatgtgttaatcgtgatagtgtttgtcgcagtgagcgatttcgatgtgaaaatgctactacctaccaaatgttcgcacatggtatactcgcgcaaacacctacattttttttcttttttacatttgcatctttccttttttaaaaaaaaatacaccaaagctttatatacctagagttctaaaagtttgtacaacaacaagctaatatatatgtcgattcggatttaaagtttatgtacgaagtttacatatatgaagtctttttttattttagaaaagtgaatggctagatccacgtgtgatgggttgtgcctcttgtcacgcttgagcggtgctcattagacctccccatttaggcttattcaattcatatctatgttaaaattaatttatattggtttcatattgaatatacttatttacctatataaacaatagagcgaattacagcttggaacatattttatgttaaagtttcactttaaatcacctttaaaccaatcttttcactttggactgcataactttgtctcggttttttttccagtttagactatcccaaataacttctttagcacccatcaacaaccctaattaaatcggttttggtacaccgttaaacttctccatctacgtgcaaagccatatattcaccaaaatcaccaaatgaagggtaaacatgaataataaagagagttgggtgattcaaaccgaaaaaataaccacaagttacccaatccaaaataaaaaaaaaagttgatttaacggtggctcaaagtaaaaactttggcaataaaaatgggtcaaaactgtaatacaatattttaaaaaggaatatgaaaacaaatataatatcgacattatttcatccgtatatagtgtccgatttaacccgttttttttgacaaattgacccttttcaaaaacttaattcgaaactaacccctgccataaacttcaaccaaaactaggccatcggctcagcgccaatcgcattggcgctgaggttggccgtgtcagcgccaacgagactggcgctgacattgtgccaccgtggcggccgggccgatcccctagctgacgtggcagctacctcagcgccaaccgcttcggcgctgaggtgcccaacctcagtgccaagtaagttggcgctgaccttggctacttagagcccggccgaggtcgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaagtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcaataaatttatgttagacttgaatggagagatcgaatggcaaacatatatagatatagtattggggtcacatttcaaatctcttgaggtgtttgcatggaagaaatatggtaggatagggaagaaagaacttatagaccttaatgaaagtccactcatagaatcacccattagctgtcacgaactgtcggagaggtgtagtaggaaggaagaattgattgggaagacgtggaggggggcgagggagtaaatgatatggcggatgtggaggtcagggaagagaatgacccggtaagggaggaagtacatgctgaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctaaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcagcgattgtcgaggcagttgagcaaatatggcactatcggcctacgtatggcaaagcatggcgtgctaagcaagttgctatgaaggtcatttggggagattgggacgaggcgtatgttcgcttgcctacactgatgcgtgccatcaaagcaaagaaccctaccatgcatttccgtgttgaggctcatcccgagaagtccaggatggtggatggagtacagaggcgagtatttggacgtgcatattggatatttggccagtccatagaagcattcaagcacttgaggccggtgcacatattatgtttgtctattgatgcagcgcttgaagacccttcgagtcagaggtcacacggcgcacatactgttcgacgaccggtacgtcccgtacctacggcgggcgaagctcttggcgttcgtgaccatggcgcagcgaccggtgcctctgtacaacgccgctgctctgacggccct

SEQ ID NO: 40931 - DNA, 1607 bp, Oryza sativa
ggtacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggaagctaacgtatgtgacgcaggtttggatgtggatgatgcttccagttggtcggcccatgtggaggacccatcaggcttggccgcaccaggatgcagaccgacgtcccactgtagctcacctgtgggaatcggtcccatctccagtagtaggccgcaggaatttggcgtactaccactacacaaacgagatggactacctacagccagaacatgtaagctattcggggttctatcacacataaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaaacgccctacaggtaatcgttggaaagagatgaaactacggtgttttcttccaaaagcgataacttaacatggattat

SEQ ID NO: 40932 - DNA, 1370 bp, Oryza sativa
  unsure (1)..(1370): unsure at all n locations
gagataagctcttgtacaatagcagggtcagggacatctgcagcactgtcagcatggtcaaaaatattaagtctgttttgcagctcattggtggtgtcatatatgtatagctgggcgtactccgggcgccgtccaggagcaggaagcaaagaacctattctatgatgcacgacaccattgatacggaagacataagggccatgaccagtgtttatgctcatgtcaatgttagctccaagttatgtgaatgcaaataatgaattatactgcctgatgagtcgcatgaaagagctggaacgggcgccgccatcaaaacgaagcaatgattgtaggataggagggaaaggcctatgcacaggtaaggagatcttcccaccacggcaacacaaattgtatgcaatcctcttagccctatgcgaactctggctaacgactctttcttggtaccaaaaaagcgcaccacaatgattgcattgataatcaggaccaccatagtaagaacgttctgggtacgtagctgcaagaatggggcaactcataagcaagggagcatggatatatttgtccaacggtagatatagagtccaaaaacagtgagaaaagtagagcgaaggaaggttggcactaagttatcacctttaagaatctccatgtagtcctttggtatagaatatgagaacctcactgacggtgaatacatgatagcctctgtgcaaacagaacaagaacggggcaacggaaatagcaaataagaaacaaagagaaaggaaagcaataagaggatccacctagttgaccgcaaagaagggtttagataagcaggtgaacaacctttgcgtacaatgacacatgctttcctagctgcccgccgtttttccnnnnnnnnnnnnnnnnnnnnnnntggtactattggacagaaatggtctcctatggacaacataaataggcatggcaatcaatagcaagaaagaaaaaggttataggtagccgaacaacaaaacaaatagcaacatggaactaactggcagagtgggtaggatgaatgagggaaggcccatgactccctgtggaacactcagatgaggaggcagaatgagaaaatggaaacaaaataaatttgtgctggcacgaatgaatgagcaaacacatgaacataagcatatgaatatatgctccgagcatacaacgtcgcaacgagagaacaattgtagtgaaatatgagagaacaaatatgcaatgggtgaggaatggaactatacaatgagatagcgatgatcacttcgagcgtacatacctattgagaacgatgaaccacctgtgaacattgggcgttcatcacaagcacaggatgaggatggttcatctatcgc

SEQ ID NO: 40933 - DNA, 10314 bp, Oryza sativa
ttggcagcataacatgaggacgactcatctattgacgttcaaaactatgaattagtgaacaacagggaaaatgtgcgctaatagcctcgctggctatgagaacaccacatgcaactataataagatcagcaagtaccatatgcacgcttccgcgggcagatgcatagggatctcgaccactccatgcggcagctgtacagcaagaaaagaagccaacaaaacacagacacattgcagatacatatgaatgggcatgcaatgtaaaaacaaatcataaacgagagaggcatgaaccaccacagaaacatggaacaaaacacagatacagataagtaatgtctaaatactggcatagagcacgatatatcccatggacacagggtgggaaaccatgaagaacaaatccaggaggcaggttcaaacatagatacacctaaagatgtgttaaaaacaaacacaaaagacgaaagacataatgacatcgagagtttgcccgaaacacaccatggcataaggtctgacagaggaagaagaccatggccgcaaaaccaaagaaccacggggcaacataagtgagcaaaaaacatcctaaatacagaagagcagcttatcaccaatggatgtgtattaagcaggcataaaaatttttatccgatttatgtacctaagaagtggttacaatacaaacaaactacattcccaagaaagctttggctcaagctgcaatataactggtcggtttttggccattcagctttcagtaacaggacaggcccaaatctttacaactaagcgtttcacatttttttctctaaactttggatggcataagtaaatgttatttgaccctcccaagggccaaggcttcttcctactttgtaggacctttactctacaggaatactgaaccatgctctaaaaaaggaaaacaaaggaggggggctatcacactccttcttcacgagtgcaagaacatctcttgtgattcctagtgcacaaagctaacttcttggcatgctttaccacaccattttccttggggattaattttcttttctcctagccacctttcaaatttattctcggtgctatgtatatgtgctaatgaattcagaatttgtcatacagaggtgggatgcaaagaagcacttcgcatgatctctctattgtcgaatctaaaggggaaaaaaagaaaccccacatatatggaatcaaccgaacaggcatcccagcgactgaacaaactgatctatagagatcagaaacgaaaggaaacagaggcaacctatgaaagaatgtaacttagcaggatgaaaaaaaacgaattaacacaaatatatgaaggaatcagcgaattaacataaatatgtgaaggaactgtttcctgttaattgaagggggcaaaataaggatcagaaatcaacaaagcagatatctcgccgataaaatcacctcatcgcatacacaccgaataaaaggtggtaaccagtgcacgagagagcacaaaatacctttgcgagcagtagacgagggaggcaactccctcccccaagtgaaaacgccaacagagaatccccaatccagcagtgcagcctagaaagcagaaaacccaaaaatcagtgggcacacgcatgatcgaaagaaccctcgaaccacaacggcgcaatctagagcaaggcgtaggaggaaaacaacatagcacaagggaggatacgatcaacgacgataccgtgcggagaaaaaaagatgagctgaggaagagcaagaaagaatagaactagcgctctctgtagaagaaagggagggaaatggacaaaccatcgcctggccatggtcatggggctctccgcgtagtggagcagtgagcagcagccaatcccgtcaccgctgtacgccatagcagtccaccatcatagctcgagagtcgagacaggggcggatagagagaggagcggcccagcgactctgagcgctagagcctcgccgatggccgacacgcggtggcaccgattcacgaccaaagcggaggagctgaggaagatagcggctcggccaatgctaaccgggcccagcatacaggaagcacacgcgtcgcgagctgaatggcagacccaccgacagatgagcgcacagggaaacgacgagcgcacaaggccggcaaaccggactggcgatgggcaggaacaggccgtgttgggctagagaggcatttgggccatacaaccactaacctgcctaaccaccagatcacctattaaaaatcaacgtgtgcacaccgtattggctgccgtctgtccaaatcgctgggaagccggcaaatctagcacctttaagaaatttagtatttagtatactgaaaaaaaaagattattagcaaatcacgtacgaatttggcatggcctatgacgtatgtacacggccggccaggatccatttcatctgagcaaaatacatatatattgtggctaaacttcgtcaaaccttcctttatgcctaacaatatatctatatttgtaaggtatatctaaaggaacgatattaaacagcaactatctccagcttttggctcaaagatgggcataaacgaacattcgatcgataaagatgaattaatccgtcgttagctagctagcttaattcatttgaacatataagtgaagcatgcattcgccagaatttgcagctagtgatatgtagattcctcttcctttatgatattatatatgcatatagtgattgtgagattgagcctatcaaatgaagtgtttgtgtgtatgcttgattcgcaagatgatatgctatctccaccaacccttaattttacaccgttcgtacatcttttatttgaccggtttcagataatatctataaattagagagaaaaattcatatatatcaaccaccacaacggaccgacagagttagtttgtggaccaaaatgcctttaggataagccatgttttttctggtcgagtattcttttagagtgtagaggttaacggagacaaataagtttgtacgagattgagtaacaacaacgtccattgcagtttcaacgagatttttgaaagaatctcatgcggtactattatctggcactgatcgatgatgaaatccttgtgattcgatttgtcttttttccctcctgcctcagtttttactccgatttgacatgaggagttaggagtgccactggtatgagtgatgaaatacagagcggctgaaaggctaagaaactttcctggcatgttcatgtgtcatcaagagaatagccgaacaaatacatgcagtcacacaagatgcaaatatacatacagttactttagttactctagttggaagctgacgagagatagtaacgatgatgcctttcgaaagaccataactagtggctatatattctcctgaggatcctgtggcacaaatgtactcctgtagtagtattagtttttttttctttttctaagtgggtagtagtattcgattagttttaggtcttgtttgggggagttctcctagctgcagcttgctagaagctcccccaaacagtccacagcttctgagaatctgtagttacagattctgaaaaatgaactaaggagccagaagctggagaagctgggtttcagagcttttccagattctcagaagctggctaccaaacagctgtttcttagaatctaaagctccctcaaacatgcccttattagtgtagcagcagctagctccatgagtcagtcagtcagtaccttaataattttctcaagaacccgatgagtcccaaattgagataccggccggcacagccctgcaattcttctggattttgtgaattttcatcagatttatagttatccaaccaggcgctgttttagtgggttccagggtgtagagaaacaaacttttatggacagtttggcttgatggtcttcgctttatggtcatgttattgccaatttcatattcaccgccagaatgaaatggatgccatttttttgtaatacaagtggtgaagaatcacatagtcacctgctgatgcaatagctttgatctttcaagtttcaactcttgcatgccccaggaccaggttcaattctgacggtcaagtgggactgtggaggatacgggcgaccaaaggatttctaaccagtgctcaatttcatatacacaattttacaatcatatcaattgatttataccattataatctagtaaaatatatagtgcaaacctgaaaattactcttggatctaaaaataaacatactgagaggaaaagttttactcagggtgatatggacaaatatcgttttcaaattcaacgataatttttaggtttacacaacattatgaggtttgcactatatattttctcatatatttccccttataatttaggtccaccatgatttagtggtcaaaatttctatcttttttcattaatgtatgtataagtttacaggtctctccttttctcatatactgatagatattcagtcatccaatccacggtaactacacggcatatgtaccacccaccaaagctagctgatgcttctaccttatgcccaccttgttttgtccacacaaatataacaaaagtgatagttccttttcaaccactctttaataatataagtacgataaggaagaagtatagaacatcatcaacaaccactctttagcttcttccttcttttgccttctgcccaccttgtcttgtccaaacaaatgtaacaaaaatgtggcaagctaattcaacgttttacaagctcccagaaggaaggaaagaacatcaaccgtatatctgaacaaggagcaaacaccaatgctcgaattctcgccaccaaaggcattttgttcaatcatatcatgtgcattagagaatatagtaaaagataatcggtgttcattgtcaatgccgtagcatcgccatgacaactccaatcatagggcagccaaaaatgaacaaagggcagtaggtattgaaattgttgcacccagaaagaatagttcccaagtacaagacaaccagtatgacaagggtgcttcttaagcaggagttgcctgcctcctagaagaggcaatcagatctcgtaattccacgtgctctccgctattagctttggcgctttgctttggtcagacagatcaaatgacgctgcgacctgaagagagaagcataacatggtcaagatgaaaaacatggtcggtagctataagagtacaacctctacaaacatctatagtgaaaatagcatagcaagttgctttcaatgttcggaaggagctagtcagacagcacaccagtgccttgttgcggatttaagcagggttgcatgggtacctttttgaacaaaaagtactattgacattctttgttaaatgaactcaaacaagcaggcaacaaatcaatataactagccaaatatttgttctttgccatcaatagcacaatatggtcacagaattacgatattgcattgtggcacatatcatggtctctctgtgtgagactgagatataggaagatagtcttctttagataagttagaataaagtcagcacccttctgtaccagtatcagttaaggcatgtcatgaaggctgactcttaagccggcccaaaacccatccatatcattaagggttgttgatgcatgagctaacacatacaatgcatttatctgttaaactctccaatatttagtagtatatttagtgggatccatccctaatcaccgtttattggctatacaatacagttcaatctccctctaattcgcgtgaagagtcgactctgcatgtaacaacggctcaaagaataaagctttgttgggtgcattaactctcttccacctcagctggagtccaatgtggctgaggccatgagtcagctgagctggagaattgtagatgcccttacgaaccaatctacttcagctctttcccagggtttaatatgagggtctaaaacttggaccagaactgacaaatgtgaatacaaaatgacctttcaataaaaaatggtatgtaatatctaagtcacttttctgcaatggaactgacaagactataaagctaaccattttaaagttatattcgcctatgaaaagccaaaaggccatcttgacaacacatttatattggaggacctaggagatgttagaataatatacgttgtataaagtgaaaacagacggtctagatatttagatctctattcacttgatgcataaataagcacatagtatagagagctaccacagttttatggccaaaaatcttccacatacatccctgtgagatcaacaactcaatgttctttcaagtcaactcacccattttgcttcctcatgtttcttcaggctctatccccatccttccaatctagatcctactagaattatccatcctaaagtgaccctatgatatttgagaactattgctcacaaggaactctaaagaacaacattggcagcttaataaacagacaggcacttgttctctatgcaacaaaagaaggttttcataaactgatcatagcaaatccttcagaaccaccaagataaatcagacagccattgcaaaaccatagaaagtactgtgtgaaacatatagtgaagtagcatactgaaatataagaaaagagtcacgatggaaagaaaagaaaacatatacaaacatactgaaacatctttccaatgaatttcttcactaaaagttatatttttatacactaacattttcctctcaagttcctcacacgaaaagaatcacgatttgtttggatgagtacagaaaggttttaaaaagaaataatcgtgatcatgccccaactttcaaccctaattgtgattttaccctcactttttagggtttgcatatttacccctgtttcttcaaaacgaaatcaccgtttgacccaactatggatggcagttaggtgggtcccacaatattggattaaaaaatagaaatgaaaaagaaaaattaattaagaaaatattagattaccaatctgcccctagtaatagtatcataacattacatgttctcctcacccccactgctcccatccccaaatcgtagatagatcacgtggcggtggcaccgatggcagctccggcgagccggcttggcgcgcgacggagacgaaggctcctcgatgcggtgacgcgagcagcagcaggcggcggtggctcctcggcgtggcgaggcgagcagtaggcggagaggatggctcctcgacgcagtgatgcaagcaccaggcggtggcggtggctcttggcgtggtgaggcgagcagcaggcggagacggcggctcctcacacaacgacgcgagcagcaggcgacggcggcggcgactacccctcaacgcgagcaccaggcggcggctcctcagcgtgctggcaagcaacaggcgatggtggttgtctagttttccaggtagcaatgatattgagtttagatggccatgatggagtgatttcacacacaaagaagttgaagttgcaagcacgggctgacgggctgttttcagtgctataggtaattctgatatgctatcagccatgttggcacactgatattcagtgctataggtaattcagtaattctgtattcagtgctatagatagcaacgatattgagtttagatggccgctatgttgacacactggatgctgtatcattactctatctgcagtttaacacttcgcgtgcaactcccattgtcgattgttccttcatgagttcatgcatgcttgatgtttgcacagttttgctatgaattaaacagcgtgataatggttgaggcgtgctgctcccagatttgtttgtaatataaatgttgtgatcctgttagtgatgaaactggtgtgcaaaattttgtttgatttcggtaaaagtttgtaaaaatcagttcagatttgaatcatttcatgaaatgtcagttcaaaacagttacaagtttcatacacaaactaggggtaacttcacaagtgttgtccaaaggtagagggaaatatacaataggaagcaagggcaaaaatgtagttttacactcaacttaacaccgttaaattgatcatccaaactaggggtaaagctttgcttcgtttcaataaaacaggggcaaaaacgcaaaccctaaaagtgagggcaaaatcacaattggacttcaaaatgagggtaagaatgcaatagccccaaaaaagaaaactagatttggcttccaaagggaagtgagcatgagatgcatacatttctagcaatgatagaggaggatgtattcaaactatctttctgcattccccaagtccccagtccccaacaatttcgcaccacccatggtccatggatagatacgcacagccacttcactagttgatgatgttcgtacttgtgcagttgcacatcatcgagtggggagcaaaatggttacagtagtaaaatgggaataagcctgtacttagcgcagatttggattagtcctagactgacaacaagatgttcagttccatacctagcagcgatcctttcaatttttgtaattctgattcaaaactaaggtattgaaattgaacattggcaatcgaaacagagataattgaagatggcatggataggcaagggaagtaaggataaaagggaggtgaccttgaaggaggcaccgatcttggagtccctggtccagtcgagggcgaggagcttggtggaggcttggtaggtggccttgatggcatcccctccttgaaacttgcgggtgacggcgaagtcccaggcgttgttagcggtgtcgaagcagggctcgatggtggtgaggcggtcttggccgtgcgcgtaggagtacttgacgcggcatccggaggagccgagcgtgtgggagaggctgagcttgttggccggatcgaaggtgagggagccgtcgagggcggtgcgggcgggcagcttggcggggcccggggagagggtggtggagtgcgtgtaggtgaggctgacgcggcggtcgagcagcagcgcggagttcatgaattggaagcgcacatcctgcaggaagaggaggaggaggaaatggggatcgattgattgattgatagcgcgcggcgagaggaagaagaagaagaaatagtagtagaaccgtaccttggagtggggcttgaggtcgaggaggaaggagccgggcttctcgagggtgaggatgaggccctcgagggagggcccgcgggcgaaggcggcatcggtggcggaggccttgaagcggaggtcggcggcggagggggtgaaggcgagggtggcggcggccgtggccttgtcgccctcgtacctgcccttcaccgtcgccttcatcctcgcgagctctgatcactttcgcccagtcgccgccgccgcctatcctccttgcgcttctcctctcgttggaatcgtcgccgccgccgtcgtcctcgtattttcttgggtttcccatccacctccaccaaccaaccctcgcccgctgcggctaggctgctagaggaatgtccatgggccaccgttacggcccagaaaaaaaaaacttcatcggccccatatcaaacacaaagcccattaggccccaaacatcaacatatcgcgctctcactttttctcgctcctttttccacggtggcagtagctgagctgtgcctcgtttcctttgccatggaatgcaaggaagaagatgagagcagaagcaatcggagaacagaagaggaagaagacaacataaatcgaaccaacaacaataagaaatatgaagcatcagcagcagctataagcaaaattagatagtcccatcgatacactctctattgcattgcaaacagctactagtacaaatttagactgacgacaacagcagcaaattgctgcatccatcagatcaacacacttgttcacagcaaagcctagcacggttgtgaactcaagtagtactactagctagtggagtagtaattattgttgggtttgcaagcgaggcggcacgaacacacgatcgaacacgatctcatcgattcctgattcatgattgataaattgctgttgcagctggagtaatctggatcaggcgagcgagggggcgatccagacaggctccgcggcgagcgagtggccgccggagatggccaacccatccgcctccccgtcggccagggagtagacgccgatggcgtgcggcgcgatcaactccacctccctccgcgccatgtacacgcagttccccctgatcccggacccctccgtggcccgcgccgccaccgacaccaccgaccccacgaacagcgcctcccccgccg

SEQ ID NO: 40934 - DNA, 27886 bp, Oryza sativa
gatctcgcggtcgtcgtccaaggccatggcgagccaaccgcccatgtggccgcagcagcgggcggcgctgaggcgggcggggagggcgaaggggaggatctcggcgcggcggaggctgaagaaggcgagaggtccccgggggggcccagggcggcggaggaggaggcgcggggcctcgaaggcgaggtcggaggggaaggaggcacgggcgcaggtgcgccaggaggagcagacgaggcggacggtgacacgctccagggggctcatcagcttcatgattccttccaggagctccggcgggagatccgcccaccccacggacaaatccgcccgccgccggggatccatgtccgccccgccccctgcttctctctcttcccccctcccccttttcttcctctttcttcttcttcttttttaattatttttctgtcaatggccagtttatatttgtccttacacttcctccctaaaataactttgagtacctgtttgaaaaaaaaaacctaaatattttgcggggttcttgaccgttggatcactttgagattcgtgaagtgcccaaccctaaccactcattttctcgctcctcactccgaacgccgccacctctccgcccgatacccctcctccccaacaactaacatacaaatattgttatatgcctcaccaattatagaatacgccaacagtaccagcggggttcatcagacctcaccctccctccctatcctatttctcaagctgatgatggtgaggtgtccccatcccgttgtctttgacgactcctcaccatcaaagacaccactgcctcctagctcgttgtgctctgagctatcaacattggtcgttccaccgcccataaattactatcaagttcttgtattttacaaccatccttctaaaacttgaggaactctctcctctttcttctaccccgcctcaaccttaaccctatatcttaactggactgggcctcctaagatcaaagagctcaccggaatgtgaagaaaatgtcatggtgtacaaatctcagattgaattggatggtccaaaatatgtaagatgggactttgagtttctattgtagggagattaataattttggaaaactattgaccttattactttctctcttttatgttgtccccacggcacacaggacaagatctctctttgggttgtttaatttgattcatggttaaaatttgtcaatccaactacaatagcaaaagtacgagtaataacaaaaagcttgacgcaaatttaattggcatatgaatacgttagctccacgccttgagaaaaatattttctttttttaaaaaaaaatttctgcaacatcatcaagatcactgtttatttcttaaaatatttaatttgtaaataatctataacaataatttgttcaataatctaaatcaaattattgcctaaaaagtatgagtaagcacgatcatggaattcaatcatgcagacacggaaatacatttacatataacatgagacgtggccatattaggcatcaaaccaaacatcctcttatttttggcagccagggaagagacaaggtcatattaaggattaacaaacaatttggttttgtggattcataatgtaatttgatatttgatgagtagcaacgattatgagttgttggaggaagaaaccatgggagaatatatatgtttttattgggaataggatgaaaaggaatgatcggtcatctttggaatatagagagatgtttgatgaaatcaatgggaaattgcttttcctagaaagagtgagatgttcctcgctagggatttcatcttgggaataagttcactttgattcccttaactagtgatcgaatctgattcatatccctgaaccacaattacggatatctcgaccccccaactattaaaaccggtgcaatttaactcccttggcggttttagagggcggttttgctgacgtggtgtctacgtggcaatattgacctggtcttcgtccccattcggcgctgacgtgtcgattaggtggcattagaattaaaaaatatgtttgggggcccatttgtcattaaaaaaatatgtgtgggacccatagacatgtggccccacatctcatgctctctcttcttccttcttcctcccccctctctttctcttccccatcggcgagcgtgggacaggggccgtcggcaggcagtggtggtggcgggcgggagggtgggcgagcgagggtcgggtcccctttgcgagctcgcgacttcgattagacctctttcagtccccgatcaaccaagccaccaccacagtcgagcttctctcctcccagaaatcccaatccacacctcgctggcgcccaatcaccaccactgccgaaaccccccaaatccggtctctgccgatcaccattgcggagctcgagctgtgacttgccgctgcaatccatcccctccgtttcttcccatttctcccctccctctccttcttttccctcttcctcttccacggcagagaggccaggactcggggagggcggcagtggcggatgaggtccgcgcggccctcgcacgctgtgtccagggcgggctcagggtgggagcaccgaaaggcagtgacgaggagtgacctcccccatctcttttgtggtcggggcggctaggctatcagaggcagcgagggagcggaaggcacagaaggacgaaggcggtggctgccgctcttccaaacgacgttctaccactgctgttgccgccgttttgcttctccgactcgatgcttcttcgtcttctccaacgaaggcggctacacgaagccgggaaggttggacggcgacaagaggttgggagggcggtgacggcaaagtgggaacaacgccagccgactcctcttttcctcaaggagtcagctccttgttcccgccatggcatcctcgatggcgaccaccctctacgtcaattcggtcgtcgacgatgacgtttagtcgcacagctccgccgccaagctgtgccgctcgtcgccggctaccgccatgaccccatccatccatctgacgccgcgaacacagccgtgtcgttcggcccgaccaccgcgggtgccacacattgagctcatctggggcgggagcggcgacagctggggaatcgagccgctgccatttccgcatctccgtcgcgccttccgtcgtctccgccgctcaccgtcgtctctagccctcgcctcccaccgcgggaaagagagagagtgagaggaaagagagagaagggagcgacgaggagagggaggaggaagatcagagagcatgagatgtggggcccacatgttagtgggtcccacacatatttttgtgaatgacaaataggccccacacataaattttaattctaatgccacctacgcgccgcgttagcaccatgtggaacgaagaacaggtcaataccgccacgtaggcgccatgtcagcgaaaccgccctccaaaaccaccgagggagtcaaattacactgattttaatagttgggggttcgagatatccggtattgtggttgaggggtacgaattagattcggtcactagttaagggagtcaaaatgaactttctcctttcatcttgtggaggaaagcaatatatatggcctagtggatgaaaagatggctcattggcccattgggaagggaaggcaggagcccatacatattccaatttttctgggctgtcagtgcataaggttagtccaataaggaataagtctatttgacccccttagctcttgctcctgattggatcacctccctcaagcgtaataaaccaggtataatgcctcccctttaattaacgtattatagtcatctttggagttatactagcaaatatgcccgtgcgttgcaacgggtgaaaaaacgtaatgataatatacgtttttcatgcataaccacgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcgcgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcagattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaattttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggatagttttctttttatttttttaaactctttttaccgcgtcgatgtagtcggattcgtttcggtattttttccttttttttcctttttttttgtcggacatatttgttttttttccgcccggttttttttcactaggtttttttatcggacttttcttttttttttcgctcggtttttttctcccgttttttgacggacgacagaagcacctagagaagtgttttttttcttttctccaatccaatacagatcggatctcttccagggaaatcagattttttttctccagggaatcggactcttttttttcgctttttttattcattaaacggtttgtctctcggacttttttttcccttttaagggatcgggtgtttttttgccagggacaggtgtttttttcgcccggtttttttttcacttttttttggatcggacttttttttcgtccggtttttatgatcggacaaacttggttttttctgcccggtttttttttcacccggtttttttgacggacgatggaagcacctcttattttttaagtagtatatagtagagtagtagataataaccacaacatcatgcgttcttatatatgggcttgtttgattgcatccatttaaaaatactccctagcaagccaaaattttagcaaagtaagagttttgacaatgttacttcaaagcttttagttagctttgccaacatattggaattatgttcttcttcttcttcttcttcttcttcttcttcttcttcttcttcttcttcttttgttttttgcaacaaaccaaaatgaacaccgaagtcagtcgccattagcatttttttttggtatggtttcatacttttattgagtgttaaatcaaacacacgatatgatatatctcatcactagtctcatttgttttttcgagtataaataattataaatgtttacatggtaaacaaggttttttttcatgaaataatgaatcgtaagagaaataatcaagtgaatgaaagagatgatgaaggagcatgcatgcaggaatcctatgtataggaaggtaggaggacatgcatgcatctttttggttggcagcaggcagaggcaggcatggcattggcatcggcatctagagccgcatggatgatccagatccagtccagagaaagaaaaaaccaaaaggaaaaaggaaggtcaatgccatcctcagctgtgttcaatccgtacctccccggccaccaccggccaaaccaaaacataggccagccacccgcacccacagacccagaccaagcttttgcgtgcgtggtacgggtaaacgacggttactactaaatactattatctttaatttaagaaaactattttgtgtaactaatgggtaattaactgcacaacatatagaaggtatgataatttgtgtgattaactagttttagatgggtacccaacgcgttgtttgcgggagaagtgtgtgataaaatagtatatatgagttgtaaaattttatttcttggttactatatatttttttaccttaatcaattatccaaaggttataaatgattaggttgtatggtgtgacttttggagagaaaatatacaatttgcatttttgatgaatcattcaaaggctaaaaacaattaaggtgatgcatatcataactacacttagggtgagtttgagagataggggattgagaagattggaaagatacgcaaaacgagatgagccattagcgcatgattaattgagtataaactattttaaatttcaaaaatggattaatatgattttttaaaacaactttcctatagaaaatttttgcaaaaaacgcatcgtttagtagtttgggaagcgtgcgcgcggaaaacgagttgttttctcaccctatctcacacaaacgaacacagccttagtgaagatcaactttatagatatatagatttcttacatactatacgattttctattgtgtgcttatatattataccttgatcaaatatccaaaaggttataaatgattgggttgtatagtgtggcttttggggaaaaaagatgcaatttgtacccttgatgaatggtccaaagactaaaaatagttgaagtgatatggcttcatgaaagaggagggaattagaattagcattttctttacagagggaaaaatagtaaccttatctcctcctcctccctcctcattcacgatgtgcttgggatgagaaagcttgtgctgatgccgcgtgctccgcttcccacacaacaccttggccttgccggtgttggtgatgcctactagaccggcctcctcccgcccttccccctttgtccgatgttcttcttctccaaatacaatgatgtgaagcccctaccctgtcggtccttcctcatcgccggtggctcctatcataaccagtctcatttgctgtcgtctttcgatgccaaccctgcctgccaccacctctagccccatggctccgacagtgccaccgctgtcctccattgctcgctggccactacccaccactgctctgaccgtcgccactactgcccctctaagcctagggaaaacccccttcccctctttcttaaccccccctcccaccttaaccaccctcttgaaacctaatccaatccatggcaatcatcaaaagggcatcagagaagaagaagagctcacaattaatcactgaaagaatattgctatcatttttttcaaacgtgcaaaagccttgcacatcgatatattaatagggggaaaggagattttacaaccacgactagctgatgcaggtcatggggggttacaggagagatggcgggcacactagattaactaggaaagacaaccaaattcctgaaaacaaaaaaagagaaagagcttgtatctaaacgccaagaagaacttttaggggactagataacgccacaacccaaagctttccttattgaacgatacgatgaacaccaccatctccaccatgaaaagtatctccttgaaaacacgagcatttcttttcaaccacaagtgccatgtaacaaggaggacaagggagtcgaaccctttcctgttgtaatcccctgcagctgcgggcaagaatactcccaccaaacctggttgctattgcaattatcatcgttgttgattagttaccccttcttccttacccctccctttattcatagcaggtatcggagaagaggaagagcttccaatcactgaaagaactacccctggctgttggatgcccagacaagcgatttcaatcacctaaaggctagcaaaaatacccttagttgcttcctctcatgcatcccaatggccatgcatgggcacaatcacacggctattaaacaatgtggtgcttgctaatgcagtaaagccagctgctggtgcttgttgcacagggccagaaaagcaaagctacagaggccatggatctccgggccatatggtctccactggcagttgctctgaccaaaagccactgttgcatgcatgccaaacacagctaccgcagtactccactgcactgctctgcaggacgacctgacccagatctgaccatgcattgccttgcatatagcagcacatagatccatcatatccagagatgagaccacacgatgagactacacgacgacgctgcctatttcccatccaaaacaaacaaatctagtagatgaaatataatattctctctatttataaaaaatccaattctaaaaattaatctaaaattagaccaataaagtatatatgctagcattatgaatctgaacccatactagttttgattatttttccgcaaacttaaccatctcaagcgtaaccccatactccctccatcttagaatgggtccaattttttatcgtcttctttttatcctaaaattattttgaagtattcactgcatcagaatttgtaaaatagaggataaatatattgataatagaaaaagagagcaataactacattgggattaataaagtgggattcccagactttttaattttatattgatatgcagggcagaagaaaaattaacttattttgagattgagaaagcagggtaagtattttaaaagttatacttgtctctatcagttactcctatctcttaattagtatttaaatttctctgtctattatcgatctgaaccacactgccctcaacaatctctcgatacaataaaacacattatgacttctttttttacattcttgatccaaccatctctcaatggataaaacacattatactttttttacatccttaatctctccaatacaatctagaaatacttacttccatcattttaaaatatacgaattttaattttatgtgttttagaaatatatttgtgaaaagagggagcagtatatatatgaatatatatactgtgttactactactctactcctaattatatcagatccatctatccattacgacggtttaacaattttcagccttaattagacgatcgatgatttggtactgccttccaccattaattccatattgttgagacctttcaaagggattgaaaccaaattaggtgcggaataaattcacatctattttggtgtaaaatgaattaatgttctcaatccaatctaatttctttctctaccggattaactgaaaatagcatagtttcagctcaaattaaccagctatatatatacgtaccattgtgttgttatatttaggtggtgttattttttaaggaagatgaagataagttaggatacgtaaaacaagaaaaatattagcgcctgactaattgagctttaattattataaagcaacttctttgggatccgtacgggaagtacatacgtatcaatttaattataatacgctatacatccgtaaagaaaacttcattctttacaggaatctgcacaagtgataacacgtgtagataaatgtgaaaactttgaggtagtagccagtagactactccatgcggtcgtcaatgcatgcatggatgatctttttgttcaggtgtcacttggtacagtgcacctagcttacctagcacctcgaagctagctaggctttctgttcagttactactacatttagcctcgaaagaaaaatcaacttttatacgctaatttagtgatgtatatgttcaaatttatatacctaaattgatctattttgagacggagggagtaaccattacacctagctaatcttctgttcaatgcgcgtattcctaaccattcattttaatttggtcaaaactattaatcatctttgtgcatcattaattcactgtaaaatacttcatgcaaaatgcaatatatattggagtatttaataaataaccaagctaggaacttaatcaaatttactatatacggctatgtatatactttatatagatatgtacttgtctttcattctagactaaaacgaaataattacgaaaatgaagcctactggtggagattaattgagtgcataattatggagaataatgtgatggtctgaaggagggcaacaatattcttcgttgagagcctgagaatgacattttgacaagtataggtacaactcacctcaccggtcaattatattgcaaccatgcattatactatatggcaccatgcgttgaataattaagctacatgttccacgaaagtgctacacatttgtctgtgaaaagtgaaaacaaccaaatattgacttttagcttagtgctatatatatactatgtgatgttcacattatttcctgatagatagttaaaagtgtgatatatatatatatatatatatatatatatatatatatatatatatatatatatatatatatatatatataaataaatgttaaccagcacgcggtattggctttcagaatggcaattaccattaaaaaccacctccatttattaataggtatttttctaagggaacgtaattaataatttccaccataaaaatgtttggtttcctttgatacgctttaggttttgtcatatattgatgctacctatttcaactttgtgcccccaagcatttttagaatcctacgtccaccactaacattactttggtcacagtgcgctttctattggattttattgtgactatgaatttgcagatggttgacactggtgcgcgagtgtggtgtgcgtacggttaaatgtagactatttgaaagaacataaatccatttttcaaaataaaccaagcacctgtttgtagtgctacagtaaactcataaaagggacaaaattgaattttaatgaatgcatggactggcctgctatatattccctccatctacttttgatagtcatatttccaaatctgaaaaatttatttttgataggcatatttcaatccaacaacctatcatcttaatgactttctcagaattaatgtgtgactctctattcttccacacaagattggctgtgtcagggttacgggttaggcataccctttacctttcgatatacgttacatatcggcatggcatacccacgcgcatacggatacttcccgcgtacactaaggaaatccttcacgaagtctacgaatgggaagagtcttactcggataacactaggtcatcaatgtatcgtatagggtctgttatctccgagttctacttggaaaccgtctaacctgcgatataaaagggactccccggggaggacctagggcattgaatctcagagccaacacaaccctcacagcctacgaagtcggagcccgcaaggagccaagtcgccggggatctagtcgaaccaactcgaccacgatctcgccggatccgtcaagttccattgttccctttgtaacctgtgttttccactatataatcccacatcaactggattagggctattacctaccaaggggtctgaaccagtataatcctcgtcttttgtctgcttgatgtcgtattacgtagatccttgtaccaacgtaccccaataccctctatatccggtctacgggtaccacccgtcgacagtggcgcgccaggtaggggcccttggtactcaaggttctactactatgtcatccagcctcgtcgacaacagcgtcaacaccaacctcagccaagtattccctgcttcaacgatgctggtgtggacccaagttagcgaaatcgtcttcccggtttacaccacgacgccgatctcaaccggtccgccaatgactggaaacgagaacgcagtggctacaaaccaaggcgactccatgtcgaaaaatcctcccgccgaggcggagaacggagtatcgacgacatccgagctcaagaaggattctaatgtggccaaaccttgtcgttccgacatgaaccgcgagccgacgaagatgacttccgaagcgacaaggtcctggtgtcctatccacaaaaccaggaaacacactttgcaagcctgctgggttttcctcaacgtccgcgctgaaatttgcgcctacaaagagcgtggaattcagcgtatttctccaactcgtgctgtctattgtcctattcacaagacaaagaatgacgagctttcaagctgcaaggtcttttccagcgccatgaagcgccatcccctaaggtccaacagtcacacatccccatctgggataaagacaaggaacgaggagcgacgccaacttcagatcgatttgttggggtaatcgatatcgatcctcacgaaccatcagtcttgcaccttcacaagcgcgcctcgggaggtattggctatcgatgatgtcggcatatcagcgtgcaccaatgcagaagcggagaatcaattgaccactccagctcagcacatcagagccgtcaacgctatactgagggaaaccccctacgatcccgttctgaacgacaatctcgcgcgttggacagaacgactacgggaatcagtgaccaacctcagtaacgcgttcgaagaggccgctgccgcagcacacccagagcagccaccaactggcgatgccaacggtgaaaaccctgaacggagggaattgcctcagcgagctacccctccacctcgtggcactggcgatctccgagatcacatcaacggccgccgagaggcacgacgcacatgagacaatgagaatcgttcccgacgtcatgtctcttcacggtgccatgataacgaagatcgaggagaccgctcaaacgaggaccgagaccgtgataaccgccacaaccaccacgatcacaacgatcgcgaacggcgggtgccaaacgatactgatcgaggacgtcgccataacgacgacgatgatggagactggcgccaagacaacagcgggagacgacgacaggattctccagatccaagccgacatcctcgtaatcgtacgccagaaccaaacgacccatcatcatcgtcatcatcctcgtcttcctcatcatcagacagacatccatgaaggacacacgatcgccgacaacccaccgcccccagcgctgggtgtagggctttcagtcgttccctacgtgatgtccgatggcctgagagattccgaccccgagcaatagagaaatacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggcagcagttcgtcgccaacttccaaggaacctacaagcgccacgcgatcgaagacgacctacacgcgttgacacagaacccgggtgaatccttgagggaatatgttcagcgcttcaacgagtgcagaaatacaatccccaaaatcaccgacgcttctgtaattcgtgccttcaaatccggtgttagagatcgctatactacccaggagttggcgacaagacgcatcacaaccaatcggagattgttcgagattgttgagcgatgcgcccacgcagatgatgcgctaagacgcaagaacgataagccgaagaccgggggagagaagaaatcagccactgacgcacctgagtcaagcaagaagaagaatcgcaaaaatgggaaaaggaaagctcaagcggaagtcctcgcagcagaatacgcgaaccctcccaagcgcccagaccacaaagtagcgacacaaagaaagcatggtgccccatacacaagacggacatacatgttttggaagattgctttgttttcaaaaaatcgctcgagaagcacattgcatctgaaaaaggcaaacgagtacgcgtggtcgaaaaggacgtggaggcggctccccaggaatcagactcagcatatccagaccctgacctccacgtttcacacatcttcggagattccacaacatactcctcgaagcgagagtataagaaagtggaacgcgaagtctgttcgacatggttgggggctgcacccaagatgaagtggtctgaacagaagatagagttctcggaagaagaccaccccaagaccgccgtcattccaggaatatatccgatcgtggtcgaacccactattcggaacatcaaggtcgcacgagtcctcatcgacggtggcagctcaatcaaccttcttttcaccagcactctggacgcgatgggaattccacaaagcgagttgacaccaaccgatcaaccctttcatggaattactccccaatcctcgtccagaccattgggcaagattacgttgcctgtgacttttggccaatccaacaacttccgaacagagcagatcacctttgatgtcgctgaattcgatacagcttacaacgccatcatcgggagaactgcacttgcgaagtttatggccgcatctcactacgcgtatcaagtgctcaagatgccgggaccgaagggaacaatcactattcaagggaacacaaagctggcggtgcaatgcgacaaacggagcctcgacatagttgagcaaacgcccagcccacccgccacgactgagccacccaagaaagtgagcaaaacaaacaagacgccgaaaccggacggcgcaatcaagatcgttccactctccagtgccaaccccgacaagatcgtcgagatcggggcgacactaaccgagaaataggaactcgtactcatcaccttcctccgcgacaatgctgacgtgttcgcttggcagccgtccgacatgtcgggggtccccagggagataattgagcacaaactcatggtgcgacctgatgccaagccagtaaagcaaagactgcggagatttgcaccagaccgaaaacaagccatacgagaagagctcgacaaacttctcaaagctggcttcatcaaagaagtacttcatccagagtggctagccaatccagtcatggtgcggaaggccaacggaaaatggagaatgtgcgtcgacttcaccgacctcaataaggcatgccccaaggatcacttccctcttcctcgaatagatcaactggtggactcaacagccggctgtgagctgttgagctttatcgacgcttactctggctaccaccaaatcagcatggcaaaagaggacgaagagaagacatcattcatcacgccgttcagggtattttgctatgttaagatgccgttcggactgataaccgcaggaaataccttccagcacacggtccagggcgcacttagcgaccagctcggcagcaatgtcgaggcatatgtcgacgacatcgtcgtcaagaccaaaacatttgactcattgattgacgatctgtgggaaacgttcgacaacctccgacgatatcgcctcatgctcaatccagagaagtgcacgttcggagcaccgtcgggaaagctgctcggtttcctcatctctggcagaggaatagaagcaaatcctgagaagatcaaggcaatcgagaacatgaagtcacccacaagactcaaggaagtacagaagctaaccggatgcatggcagcattgagcaggttcgtcgctaagatgggagaacgaggacaacctttcttcgctctgctgaagaagcaagacaaatttgtatggacacaggaagccgaaaaggcattcgttgcactcaagcgctacctatcaaacccccctgtacttgttgccccccaacctaatgaataattattcctctatattgccgccacgccatattccgttagcaccatcatcgttgtcgagagagagaaagtacaacgaccagtctactacgtcagcgaagctctccacgatgcaaagacaagatatccacagatccaaaagctactttacgcggtcatcatgacatcaaggaagctacgccactactttcaagcccacagagtcacagttgtctcctcctttcctctcggtgaagtcgtgagaaacaaatacgttgtcggttgcattgcgaaatgggtagtcgagctgagccagtttgatgtccactttgcgccacgaacagccatcaagtcccaggtactcgccgactttgtagccgattggactatgcctgataacaaatcagacaaccaagtcgataacgaaacgtggacaatggcgttcgatggtgcactcaacagctaaggagcaggggcaggatttatcttgacgtctccttccggagatcaattcaagcacgcaatccacctcaacttcagggcgaccaataacacagccgaatacgagggactactcgccgggataagagctgcagccgcacttggggtcaagcgactaatcgtgaaaggggactccgagctagtcacgaaccaggtgcacaaagattataaatgctctaaccccgagttatctaagtatatcacagaagtcaggaagctagggaaaaggttcgatgggatcgaagtccgacacgtctaccgcaaagacaacatcgagccagatgacctagcacgacgtgcgtccagacgagaaccgctcgagcccggcacttttctggacatcctgacgaagccatcagtgaaagaggttagcggcgaagttagcccggacacccccgacattagctcggaggccacaaaggcagaacgcgccgttgccgatatcgagaccacagacgactggcgcatcccactaatcaaattcatcaacagcgaggagctgcccaaggacgatacagaggccgagaaaataacccgtaaagcaaagatctactgtatggtcggcgacgatctatacaagaaagcgccaaacggggtacttctcaaatgcgtctcgtccgacgacggcagacacctcctccttgatatacatgaaggcatttgtgggtcacacgccgccggtcggacattggtcgggaaagcttttcgacaagggtttttctggccaaccgtccttaaagatgcatgcgacatggtccagcgatgtgaagcctgtcaattccacagtaaacacacaaagctacccgtgcaagcgctccagactatccctcttacgtggccgttctcgtgctgggggctagatatactcggaccattcccacgaggacagggtggctacccacgggggaaatcaaggctgacaacgccatcaaattcatcaaggggatattttgcagatacggactaccgcaccgcatcataaccgacaacggctcccagttcatcagcgctgacttccaggattactgcatcgggctgggagtcaagatatgcttcgcctcgttctctcaccctcaaagcaacagacaagtcgagagggcaaacgatatagtactacaagggatcaaaacccgcgtctacgacaggctcatgtcacatgacaaaaaatgggtcgaagaactcccatcagtactatgggtcgtacacaccactccgacgacgtccaactaggaaacacccttcttcctcgtgtacggctcggaggccatactccctagcgagctacgacatcagagtacacgagtacagaagcattccgatgaggaccaggaggagcaacgaaacgtcaatgtaaatctactcgaggaacatcgcgaacgagttgccattcgagcagccagctatcaacaggccctccgccgttaccacgagaagcgcatccgagcacgcatactttcgatcggcgactacgtcctccgacgggttcaaagccaagcagggcgaaacaaactctcacccaaatgggaaggaccttacacgatcacacaagtcttgcggccaggcgcattcaaaattgcagacggcgagggtcgcaagttagcaaattcttggaacattgaccaactacgtaaattctatgtatgagtcaataccatccgtacctgtaagacaccttacagtatcaataaagcctattcttaggcccatattagaatcaaagtgttcccgcccgatgatcccttaccctgatgacacctagcgttgaaacctatccttatgtccctttacgccgtcttgacaaggcctccgaggaacccaagggatcttcggctggggacgcccagagccgataaggccttgtcagatcctgtagagacgaaagaccatgtaagatctggtcatgtaagagttctcgccatgcatattaaccaagccgcgaaatcggaaattaactttccaacttcacggctgggggctaggatcagagcttattcaaccaaggcaggtcaaaggtccaagagccttatcctccgagaaaatccctcagacgacaaggctgggggctagggagagtgtacgactcaaacgactgattaaagtcgtgaactgagaacacactcttacacatgacatccggagtaagaaagatttgttaaagatagatttcttttctattttacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtctatctctgccggagtcctccgagaacgagcaaagccctcacggagaaaatcgaggtccaggcgcgggcgatgatctcgtagacaagccaacacgtgccctccggcatatcggctcgatcgacgacattcctgcttcaaggcctcgtcgatacacttgccgacgccatcaagttgagcacaggctccgttcagccacgagatgtacccagccgcggactcctcgggatccccacgaggtactcgaagctctctacaaaccttggccatggatgtgcagcaactcttcaagtacgagttgaaccacacctcgcgacctcggagcgtttccacagcctgctttttcttcactacaaccatagttctctcgagttccgctacttcaaattttgtcttccaatattggatacgacgatcttggccagcaagagcactctcgagatctgctcagtgtgggaacgactaagtcaggctacacgcctcttccgagaacataggtgatctagtcagaggcgcaaaaagggatgaatggatcactaacctaaggaagtggtcgccatctccgtccccgaggcaagggtttggtctacattgtcgggcgatgcatgttggtcaaacgtgagagccggaataatcgccggtgactcgggttgcccatgctgctggacatcctcgtcatcaacatctctacaagggacaaaaagctttcaagatcaacatgcaagagtaagctagaataataactgctcgcacaaaggcggttaagatccagttttacacagcatatctagggagtacaagaggccccactcttcaaaaagggggagaacagattcccccaggtcaccgacttcttccatcatctccttacgcgtgttgctagccgccccctgatccaagatctcgcgcagatcgagttcaggatgcgccagctttacacacgcaaggacgtggcacgccccggtgtagatcccgttcgatgtctcctccccgatcctagccgcatgcttggaggggatctcctccatcgccgccgccagctccgcaagagaagatgtcaacgagaactcgtcgggattcgccgggatagtagacttaatgccacactccccggcgagctggtgcagaccagtataggtgacccgcaatgagccacggattttcgacagattgttcccaagctctgacatgcggtgctcgagcccctgccgttgtcgctcgttgccggccaccaactccctcatcttcttgaggtcctcacgagcctccgacaactcgtgtgccaatcggtcagcccgcttgtttgccgacgacgccgccgaccttgcctccacaatctcgtgaccgatgccgcgagcaccagcctcgaggaggcgccccatctcaacctagagctcctcccaggtgaggacggtagccggtggaccacggccagccgcgggatcgttgactgggccgcttggtgtcacctcgcggcccccgggtgcgagcatgacatccgacgaggccgcagcgggcgacgtgccggaggtccctccggacttgtcttgcccagccttcgcccgcgccgccctatgagacgggcatggttcagacaacactcgaataaaatcacagaaacttaagttcatcaacttacttctcgccaaccgtcacaaggcgttgtcgtcgtggaggcgggagagacgtgtccgaggcctgaaaaatggtcgatgcgaagtaaggcgaaattcttctggctgtacgatttgacgacaggatagcttaccgagggggttgatgccttgcgacgatgtccgctcacagaggagaacttcctcccctttgtcggaacattgccaccacttgtagtagcagcagcagcatcagacgcctccttggcgaccttctctttcagagacgccgccacctgatggtccgcgagcggctcgatgatgtcagtcagatgaagggcctacgcttaatcaagtcacgatgtgatctcggaaggaaaacgtagaatgcctatcgggtacacttacattgatggcagcatcacgttcagccgcacctttctcacaaaagggaacggggatggtactcgccgttgtcggaccactgatcatcacttggccaacacgacgttccacagctttgctgttcagacctgtgaatcgagaccaaattttgataaatcaagaggaacacgaacatgagcatgtctggataaatgcgagaaagataccccgaggagaaacccgggtcgcatcctccggtccggaataatcaaaggctggatgtgcccgagcctggagcggctggatccgcctaccaacgaagtctgcagcgacttcataccccgacaagcctcgtactcggagatcgtcgataatgtcgataaacgactggagagagggggtcaaagggggctttgcggtccaagacgaaatcttgtccggttgttctttgggaacaacgaagacagggtccgaatctttgatctgaaggtagaaccacctagtccgccatttgttgcgagaagaagggcactggaaggggatataacgcgacttcaggccatcccgaagtcggaacccgacgcaaccagacaccctgttggactccatccaacgcagctcgtagtagaagcgaaagagatcaagaaagggctctaccccaatgtaggcctcacaaagatgagaaaagatgctaaggaaggcgatagagttggggttcaaatggagaagagaaagaccgtagaagttcaaaaccaagagaagaaattcggaaggcacaaggagaaaaccgcagagaatatagtcttcgatcgcaaccatgcgacctaagacgggctggggattagtacctcctgcttccctttccatggttccgcgaccaggaagggcgccgtcttcctgaagcttcttcagtgacacactggtggaggatgatttgccgagatccatcgttgatcggagatcgccagagaaagggctcaggtcgatgaactagggtttcttgtggcagcggagaagacgaagagcgcttacaggcgggatgttttcttcacaataggcggacttcaaaatggatccccaaaattcctttaaatagacacacttccgacggtacgacttccaaggaaaggggagagatgcccgccggagatttctggatccgttacgcgcggcagttttttggacttcagtttaaattcactcgtgaccgttgggcttcacacggtgttctcgactacgtcctgtctctatggtcctcacaccgggaacgacaacagtctcgacacaacaagtcgcgaatggttacacgagttcatttaagcagaagtcgggggctactgtcagggttatgggttaggcataccctttacccttcgatatatgttacatatcggcatggcatacccacgcgcatacggatacttcccgcgtacactaaggaaatcattcacgaagtctacggatgggaagagtcttactcggacaagactgggtcatcaatgtatcgtatagggtctgttatctccgagttctacttggaaaccgcctgacctgcgatataaaagggaccccccagggaggacctggggcatcgaatctcagagccaacacgaccctcacagcctacgaagtcggagcccgcaaggagccaagtcgccggggatctagtcgaaccaactcgaccacgatctcgccggatccgtcaagttccattgttccctttgtaacttgtgttttccactatataatcccacatcaactagattatggctattacctaccaaggggtctgaaccagtataatcctcgtcttttgtctgcttgatgtcgtattacgtagattcttgtaccaacgtaccccaataccctctatatccggtctacgggtaccacccgttgacaggctgcatgtgcatcgagaaatgtaaatattaatgaatcgcttgtttacgaggaatgactagtggcatgtttaaatggatgataagtagaattacttatccttggtctatgtgccaagatgaaatatgactatcaaaagtagatagagggagtatttaattgatagtactgtgtacatataggagtttatctttttgaggggcaaggcaaaaaagggtaggatgtagagtttgatcggccaaccggcctatttaaccagtctcgttatcatggagacaacaggcactttacgctgttgctgcgcacttgatcgatatgcatttatagtttgtactcactatcttttagaacttaatatatataaatgtgtcatattatcatccactaataattatgattagagtattttaaatttcatagaaacatggcatatcattcataattttgttgtacttttaaacctcagtatataagcaatgtcaaatcatcatctccacatcatttttacattatttaaatacatacatttatcatttctataatatataacctatatttatccatatatcgtaacaagtgcgaggtatcaactagtaatttttcaacttcttgtgtcgatcaagcgagcaagtgataaattaaagagggtggaccagcatgcatatatttatataaataggaactagcatttatatttcgatgttaatgcatagcaacacagttagactggatagacattaggtaaagtcttcaaattaatgtaactttcactaaaaaaatgattttccatggcaatttcctttcatttttttcagatggactaaaaatagtcttgacagtgaaaaacacgttcacttttactagcggacgacataagcatcggctagtgaaaatcgatttttactggcgtgcgtttaagacgtccgtttgtgaaaatcaattttagaaaaatatgcatttgtacctaactttttcctaaaaagtcaaatgaaaataaaatttataccaaacttgtagatctagtattcgttataagattcaagatctattttacaacatttcagatatatgatttaaataacctttgatggacacatgatctgtaccaaagttatagagctctacgaaatctacaactttgtagttcatgaatttttttatttgaaatcatttagagagacaaataagtattttaagtttcgaacaatgaaaatcaaaacaatagcattctgaataagtgcttcatggtgagatggtaatgtaatacatatgcgtagagagaggtctttgagtttgaatcctatacaaaccacatacctgcgaatttaatctgaaaagttgcctaaattatcaattaggatgcttagttgtgttatatgcctagtaaaaatcaaaatattttttgattttatttttgctgattttcactagatgtcggatgcagtcagtaaagatcgttgatttggactaacttctaattgcttgctgaacgtctagccgctaggaaatataggttttagccgccagaaaaaaatgttttttatagtgtctgacccataatactctctccatctcattttaacctcagccatggttttccgcgcccaaatttgatcgtccgtcttatttaaattttttttaaaaaaattaaaaacataagtcacgagaaaagtaatattcatgtttttatcatctcataaaaaatattaattataaaaaattttcaaataagatggacgatcaaagttggacacgaaaactcatgattgcacttaaagcaaggttaatagtatagccaactactagctccaaatcatctatagccaatttaatagctaattcatacaatagttgcttactatactattaatacctggtcccatctgtcatacacgtacacattatgtcttgaaatccgtgctgcagctggctacatatctatagcccgctgctcttctatcttctcttttatctttttaaaatatgtttatagttagcttataatatgctattatacctgctcttaaaatgggactgagggagtatatttataaaaccattaacattatactaatataatatgaagaaacgtgaggcaaatgaaacaatagtactactactagctagtacacgtactgcatgcagcagtgttggtcgttggttccatatatttcttggcatgcaacgatcgaatccgatccgagaaaaagctactactgtcctgtgctgtctgcagctttgttcacttgtcacatcgattgatcgtcccagctgccgacctcgcgatctgcaatttacacagtacagcgatggatcgatgcattcatcgatcgatcaaaccgttaattacctacagaaccaacgtaccagaaggcttgctagctagctgcagcttaattaattcactgtattactacatgtgtgttactttctcgatcagcttcttgcttcgtacgtgcttccatctccaccacaaatttctctgctatatatagcttgctttctgcggctgcatccaccggagaaaacgacgtatatatacagccagccgacttaattagttttcggtcaatagttctataagctagtaatatataatatctcatttaatcctaatactatacatatgttgatgtactacatatatactgcctccatctcgtataatagctacttctaacatttaaattttgcctcaaaatatatacattacctagctacttctccaactatattatctcaaccaataatcacagcatctctcatcatctaattattccacctactttctttattatctcaaccgatcatgatcattaatttcacggtgttccttaacctctctaaaaaaaattcaaaagtattactgtagtgctatactctctttttttttagtaatataattgtttttgttacatcaaggctttgactaataactattttgcagtttctaaaaacaacaatcgttttacatttatttcacgttttcatatccattggttatttgtaaaattttcttaataggaataaaattcatcctttcatttaatatatcacttgccctttcaaactcagtcacattagatagaaattacgaataataaatttggcaccctaccttatttattgatatgaatatgagcacaccaaccttattcttaaatttgtaccatgtgtgaaatcaaacttaaacatattttaaacattggtacttcacaaaaaaaaatgtgctgtagatttaaataaaagattgcacatttacttttcggggtgtgcgtgtgtgcgcgatcagatttgaacctctgtatttatggcttggtatgtgatttgacaatttgaatttagagtattaaatataattggcatgttatattttaaatttgtatggcataaatatgtgatatcattttaggaattacgacgcttaccttattaaacgttatgaattttaatgacactttaaagaatattaattctttccttattatgagatcctacccagaacaaggtaatataccattggattctagtctaatggacagtgaaaacatttggagcaccttaaaaaaaattccattgtttttttatataaaaacaattattgtaagtaagcaattttaacatgtatctttaattttgtgttaaatatatatatcttgctagagtaattattgtcaaagtcttgccctaacaaaacaaaataatacacaatatattttttaacgaaaggagcatatagaatggctaacgcatgccacactgggaatatggaagaattaatccgatttgggatgaattgattattctcgatcgtccctaagaaattccagtaccggcatatatatagtggcattcgttcttgtataccaaacaagtaattattaacttgcaattcaatcaacaaaagattctggtacataattaattgacacatttaactaaagaaaaataacagcccccaagtccaacttttgaatgatgtgtaattgccctcgagaacatttttatatcgataaattagttatagctaggtctcgatgaaatgctagcttaattcagcttgcatatatagaagcataaccacacttacttaaattatcttgcttggaccaaccaacaaaacaataagagggttgagggttgaaagtttttttttcagaaaaaaatattacatacatgaattatctacccaatccatgtatatatatatatatatatatatatattctcaaagatggggggctgtacaatatctatatatatgtctatatgagcatattaaagcattaaagcattttctttttggggtaaacctcgagaaggaggacagggagttcatgttttatattaggaagaaaaaggagttggcctagtttatcatgggccaaaaaaccaaacaaccatacgattaattgatgaaaaatcggcaaataaaaacccaactctatcagcacataatactggtggaaaaaccatttttggtcggtcggccaaaatacacaatattcccggttgcaataaaaaccgggactaaagatatctttagtcccggttcaaaaggttagagttttttttttatctttagtcccggttggtattaccaaccggaacaaaagatctatttttagtcccggttggtaacaccaaccggaacaaaagatccctattatctttagtcaccaacaccaaccgggactaaagatctatttacagtcccggttggtgttaccaaccggaataaaagatcggcatgcgcaacatgggcggcggagagtacgaggccagatcgaggaggaggaggagcagttaatatattctatctcctcactggccttatctcttcctccatatctcttcctccatatctcttcctcttcctcctcctctccttttaa

SEQ ID NO: 40935 - DNA, 6178 bp, Oryza sativa
caccaaccgtgactaaaaatagatttttactcccggttttttcacccacaatctttagtcccggattgatagtcccggtttgaaaaccgggactacaggggggttacgaaccgggagtaaagccccgttctccaccagtgtaagccaaccctagaaactacaaaccaccataaaaccaagcaaagcaaaaaattaaaccaccacattaaagcattttcttcatcttatttttcaccagactaattcattcatttttctcatgtgcaaagtatgaaaacttgcagcagatggaatataactacctcccaaattaagtactactaatggggactgcatgcagttcatatatgtacatattagtagctagaatatgcccgtattttgttacggattaaaaagagaatcatatggtacggtattacatattcacgtgggaaaaatatatagacgatatacaataatatatccacttctctatctagttgaatcaagctgtttctagtagtcttcttattgtagagtacatttgagaacctgcatgtcattgataggggcggtggttgccaccatgcaccattgccttcttttaaagtggtataggtatttcaaatatccgaacatgaaagcacaaatatatgtacacgtttttttttaactaattaacctcccatgcgagattttgtgcagaaagaactagatttaaaagtagaacgtactgtatttaatatacatctctatctgtttacatgtatacatctataactatcttgatcgatctatcccgttataatctaatctagacctagagacggagacggagacggcgaaggggccaactcggcctccccttgtcttcaaattttacattgaattttatagctagctcgaggaaattttgaagaaaaaaactaacactattgccccctccaacatagattttttagtgtttccagcccacttagcatgacaaccaaatgatgcaaattaatatagatccttttatcctatcaatgtgataatttttaagccatccagaaaaagatgtggtacgtgactcctttttgccatctatctcttcttaatatagcacgcatgtactaatgacataaattagctaatatattgcacatatatatggatcagtcgatacaggataccaatcaaaagcatctagagggatatggatattttatttatcttcttgtaaatacagtatacctcagcgtgatacatataagcgtaagtacacgcctatatctctgacaatctttaatttggtcactaataatcgcacaggcgaccatcatatcatatatatgtaaattttgcatagtcatgatgtattaattgtacgtgctagaattcaatttcctctgatctcctctctcgaatattgaagttctgatatatatatatataggtactgcatggtttaattattagaacttgtgccactgatgatcatagctgcttacccctggcctgctggtggtggagtacacctgcatgtttgcattgatcatagtaggattatcaggctccaactcctccagctctgcaaagacctcatcagctgctgaaggttggatgccaagtccagcgccggcgccctccgtcgtcatcatcatgttggcctgttggccaccgagcacgacgtcggcgtagagattgaatggggaggaggaagaagacgatgagcttgtgatcagtgcaggctgcagctggttggtctgctgctgctgctgttgcttgtggcggctgctggaggcagtagcatgagtactgtgatgagaacgggcatatccggcgagcacattacgttgcatcggccatgggtggttgtgctccgccgcgtaggtgatcaccagcatgttggggtcgctgcggctgcgctccacctgcttcctcgccatacatccctttgagctgctgcatctgtagtaacccctgcatcatcaccgcccacaaaatcaactcatcagtgaattattattttttaattaatttcctgatcaaccgcatatatataaaattattgtgcctagatatatatatacccttagaatgcagtgtatgaatggtttgatcaaatttgaagatggcacagtaatgtcaaactgagtccactaagccagaataattgttaattcatcgagaaatttaattaattgtgagtaaattaagcttatcgatccctgtacttgaagtttcatttttaccttttaaattaatttgaaaacggcaaacatagctattttgttccaatttttgcctcaaaagtaaaagcaacttaatttgtggcagtcttgcaatatctactatttcaacaattaataatgtttgatttacgcaatttgcaattgggagtattagtttctcacaaatgacactacattgggtcataattgtgatgaatcacttattagatccccatgtatatatggaagaattcattgatgatagatttacattttagggattgcttgggcataggtgtatatataaccttcagacggtacaatgttgaaactccgacacaatctgaagtgattatatacgtttgattaatccatacatatccatccaaacccttattaggtcgttcaagtgccattggaagtttgaaacccaacactacacaaataattaatcaataatagacaagcatattgtctattatgatgctgtcgaattatttttctaaaagaaatgttttgtatacttgatttggatcattggagatttggtatattaaatgtgtattgtgcagtaaattaattttgggttctattcacgttggttggctttggctgataagttatacaaaagtaaacgaagcaaccgaaaataattttaggttaggccttttatatactatttataccattagtggtaaaaagccaaggttggaaataagtttaaaataaaaaaggaggataatttaaaattaactttaaaataaatgagtaaatgaccttttatcaccaaagtttcactttgaactaccctttaaaacatcttttctctttggactagattagtttgcctttgtttcactttgaaccatcccaaaaacttttctcgagcacataaatgactttaaccacatcaacacccataaaccgctaacttcctggctcacatgtagactattattcacaagattagagggtagatgcactagaaaagtgacttggggtggtccaaactgcaacaaagataatcttacctagtctaaagtgaaaatattagctagagggtagcccaaaaagtgaaactttggtaataaaagatggaccaaagtgcaattaactcaatttaaattgtgtcaatgacttataagccaacaagcaaataatggggaacttcatgtaatctagctaagtaataaacccaaagttgtggcttactaacaaaaaatgttgtttgaattgaaaattggggggggggggggggtgtacagatatatatgtacttccttattccatatgtaagccatttaaaacttatgtgcaagaattaaaaaaaaatagctcaagcgacttttgttaccctttatttatattgttttggaaaatattggtagtttatttatgagaaaaatataatttatttggcaagagaaaccataaatataagtttttttacaccgaaaccataaatataagttgaaattaaaagatgcctgcaaattttgaaacaacatacttttagagtttaaaaaaggctaagatggcttacacttggactcataggggatcagtatatatatatttcaaaagttgtttaattatgacaaaccaattgaaattgtctaaacaagaaatatggaagctgcttgttttttagttaattagcttataaaaaaggatggccatgattttgatgcttttgcccagagatacagtacctgcagagatatgagcaataaatattaatgaacttacataatataaaatgaatataattaatacctagagggaacataatataactaagcagtaagcacacaataggaatgaacgaaacatatatatctgatgagatatctcttgattccaataaacttcgtataaattggatcggtcattaagtataaaaatatttatgcagaaagtgattaattgtttatcaagaatgggaggaataggaatgattgaaagatatttgatgagatcttgatgcaaataaacttcatgtatgaatcgggtcattaggtacaagatatatatgaacagatcgattaagtgagcgcgtgttaaaaaaaaaaagaggggaagaaacagatgaaaatgtggccggtttaccgtggataaggagagcctttgatgggtttctggccgtacttcctccatgcccatagatcagacgggatcacctctcctccacctccacggctactcgtcgctggcggcgccgggatgcacaccactttcttcacctcattcttcctgtagtatatatgccaaaggatgcaagcaagtaattaattaattgcttgaaaataaactaacactaaatagttaagacttttgattaattggaaatcgattgatgtaagtattcctcgctcattagagaaacgtgaaaagcaaattaggaggaactgaagtcaagtatgatttagttccaaacctgtcaaagagttatgtgtacatgtacagttgctagatatgagcattaatactgaaaacggccatatgcgaggagtaaaactctgagaagagtaagatcgagttaatattaatttggcgatatgggtagggggtgcaagcatcaaatgccaatccatgaaatcctgctagcttgcttaaaggtgatgaagtcagaattaatgacgactcatatatatataatctgtcagtatatgtaatggatcgaaaggaatgctgaaaatgagagccaaagatatctgcacacacacacatgcatgaactaataaaaagatcaaagtgataaaaagaagcggtaacacaaagccgggatcgatcagagggatgcaaatcatcaattgaaggaaggaccaagatgtgtatacattaaggaagaagaggagtgatcgaaatatgaatccaattaattagagaactaattaataatgttaagagctagctagcatgccaaaccttttcatcatttgatgatgagcagacggcgtcagtggcgagatcctgatggcttcttctccatcatcggcagcgcctgcgcctccgccgcccatcaccacgtcgccgccgccacagagggcgtgctgggagatctggagagcaagcggccgcggcatcccgtagccggcgtcgccgggtgtgaggtggtggtatgagtcgacgaccgtggatggcggccccgccgtctcgaacggcacaggtgcgtcggtgtaagcgatggtggtagggcgccgaagctctccgtggtggtggtggtggtaagggatggtgatctggggggcgggatagtattggtgaggcgcctgaggcatgggaggaggaggaagaggatgcagaggtgaggggtgatggtgaggggtggagacgaggaatgcgcgtgcattggcacgggccacgacgtcggcgaggtcgccagcagcagcagcttgagcagtggcggcgttggcagcctcctcctccatcatatccatagtggcgtgctcgctctttctagtttctgtctgatgcttaattagctgctgctgctgttgctgctgcctattcagtattcactagtagctagtactggtacacacactcccactcccgtccagccttgcctgcaggagcactagtagtgcacgcactcacagtgctactggccggctactaccagctcgattgatctctgaatctctctctttttctctctctcacatgcatgcatgatagcatatgagcatgagagagcagagagttcgattgctcgatcgatgatcggtatgtatatgagtgggatgcatgcagagtcagatcgatcgatactagatatcgagaacgatcgaggtagcaaaggaaaggaagatatatagctgctaggtggcaaacgcgtcgtgttttgagtcggtcgtcgcagagaccatggatcgatcagctgatagtatttatttggccaccacacaagctacaagctacagcgcgaagcaactgttcgccccacacaccaactgtagatggatgcatcccccccc

SEQ ID NO: 40936 - DNA, 31309 bp, Oryza sativa
cagcaagtcagatatatgcggcaaccaacaagctagctgctctcgctcgatcgatgatggccacaccaccatatgcgcattcttcgtcctctgctactacctgtagcctgtagcttccttttattttcccctcctcttcttctctccttgcaatatatatttgctcctccgatccgtatcggtatgcatgagagagagagagaagctagatagcttgcttagctagaggaaaacgacgaggggacagagacatggtggcacttatgatagagagagaagagagggagagggagagtgagccgggcatgcagagatgcagatgcagtaggccatgcaacctgcctttgccttcatttgttggctcgcctgtttctttcgctacatgatatctcactttcatcccccttctttcagcaccttttgttttccatcatttcggttgcgtctcttgccaattaacttaattaggacactgctttccacattgatgcgtgcatatatatattattattatttatattatattcctatttttatacttaattatttattgacctgttactgtctaataatgtgtgcatcggtagtgttgtggttttctatacttagggcgattccattacaaaatctattatattattaaaggaataaaaaaggagcctccacgttcgttcttatggtctagaaattctcacattaatcggagaaaaagaaaaatcagagtccatatagaaatacaatttagaaatagttgaaattcggaattaaaaaataaggaatattagaagaggagactagagtccatatagaaatacaatttagaaatagttgaaattcagaattaaaaataaggaatattagaagaggagactagagtccatatagaaatacaattaggaaataatagaaattcggaattaaaaatactggatggcagtacagacagtcccttaaaaataagaaatattagaagtagagtgtatagagtccatataggaatttaaaactaactaaaatttgaaataaaaaagtgcctccacgttcactctcatgacgtagaaattctcatattaatcggagaaaaataaaaagaagagtccatatagaaatacaatttagaaatagctgaaattcagaattaaaaaataagaaatattagaagaggagactagagtcaatatagaaatacaatttagaaatagttaaaattcgaaattaaaaaataaggaatattagaagaggagactagagtccatatagaaatacaattagaaaataactgaaattcggaattaaaaataaggaatattagaagtagagtatagagtccaaatagaaatacaattaagaaaaaaatagaaattcggaattaaaaaattaggaatattagaattagagtatagagttcatataggaatttaaaactaacttaaaattcagaattaaaaagagcctccacgttcgctctcatgacctagaaattcttacattaatcggaaaaaaaataaaaatcagagtccatatagaaatataatttagaaatagctgaaattcggaattaaaaaataaggaatattagaagagaagactagagtccatatagaaatacaatttagaaatagttgaaattcggaattaaaaaataaggaatattagaagaggagactagagtccatatagaaatacaattaggaaataactaaaatttgaaattaaaaaattaggaatattagaagtagagtatagagtctttatagaaatacaattaggaaataatagaaattcggaatgaaaaataaggaatattataagtaaagtatagaaatacaattaagaaaaaaaaatagaaattcggaattaaaaaataaggaatattagaagtagagtatagagtctatataggaatttaaaactaactaaaattcggaataaacataataaaatgaaaagtagtgtttagagtccatataaaaatataatttacaaataactaaaattagaaattaagaaaaacatgagaagaagagtttaaagtcaatataggaatacaatttagaagtaactgaaatttgaaattaaaaattaaatattattgaaagatgagtttagagtccacatagaaatataattagaaataataaaaattcagaattaaaaaaagaaatattaaaagataagtctatagtccatataggaatatatataatttacaaataactaaaatttgatattaaaaataattaataactaacacgtatataaaatacaatatgaatattacacattagttgtttcgtaaagttattgcaaaatttaaaattatgttgtcattgtaatatattttaataatataatgagaaaacatatatgctattatacgagagaaaatataatgatgctaacagcgcaatctgcgtgggccaccatgctagttacaattaattaaggttctcgacatttatcaatagtcggttttttagtttttgaaaataatccattatatatttatatatgtgcaccattaacatgatggtgcaaacgtgattgcatgagtccgcccactaagaatcatatattgtgtttgtgtgtatacatacacacacacacacctgtctatccttagttggtcaagaggctggacatattagttatagaacttcttttgaaaaaaaattattgcacatgtgtatatacgtttctttttggacttcaattttaacacaagaactctattatatacaatatataaaagtaaatgatcactacaggaaaaattcactattgccacgaaaatgttgcaaccacatatgagttctggcagtatatatagtttatactattaccaatatttttttggttttgccgtagtgaacgtatcttattgcaatgtttattttgtggcaatataaatatttgttaccataaaattaaaattgtagcaacaacctaattaaaacaacgggttatattacgtaccacagctaataacgattttagaattgaagcaatacatatctattgccatgattttggctctaatgcactaattttttcgtgccaaaagatcaatttcctagtagttgaaaaaccttgttttttataataaccttaaataataaaatacattaaatacaatagatatcattgggactaattaagagaatcactacaaaagttttcctaaacttatgtcatgaaaagtatactgaatatgccagactatatatataagtccaaataagcactgaacatatatgcacagagaaaggaccgttctcaatatattgattactgtaagtctctagtgtcactagcctaaccaattaaagatgagtatgcacaggtgcatttttggctttaatttactagcattattgttgtgccactttctctttagttttagtgaatttaacatgtagtacgtgcactcaatcagaattttacaacatgctttagtcgcgctaattaacctgtactgacattccgtcacaaaaacattgacttgctagaataactatagggcatgcatgcatgtggttttttttatatataaaaaatggtatgcatgatttacttgcatttgttattattagtgttgtcctagtatattgttggtacaatatggtcggacccattaactggcgagggcgtgcggaaggtctcaaccctgcaggttattagcatgcattattattggcatccaatgatatctacaatcttcacatatgatctttacacggttagaaaattattttttttgcacaatttttgctgtcgattgattagatgagataaaaactacaccagaaaattatgatccattgatgagcttactgaagctaaggatgcattgtatgtcaaaattactgaaggatatgactacttgattctacataccatggttttgatcctagttttatttaaaattaaaactaatagctcctttgtactgaattaagtaattttggaagaaaagcagaggaactcaatccaaaggaaaaaaaatcctatgtgcacacgtttggtttgtaggactgcattaaagtaattaatactccagattttggcggaattctagcatgaagtctaactttaggtttgcaaattcctttcggacttccgatgcattctctctctttctctctgcattatttctctaccaaatcaaaatgtgaacttaattaaatatgatgtgtttttcttgtggtacattcaaacatttcggtagtattgttttctatagaatttatcatggtgtgagttgtgacattttaattccgtgttttcctattcttgtactttaagaatctagtttgcgtttcaaatgagctctaaaatagttatgtgtaggtttagttgatgcagacaacatcatgtactagtagcaacgagcaagttaattttttctttgtgatttagggaattaattaattactccatatgtttcatatcgtaagactttctagcattgtccacatttatatagatgttaataaatctagacacatggacaatcctataaaatcttacattgtgaaaacggatggaggaactactccctccttccctaaatgtttgacaccgttaacttttttaaatatgtttgaccattcgttttattcaaaaacttttgtgatatgtgtgaaactatatgtatacataaaagtatatttaacaataaatcaaatgatagaaaaagaattaacaattacttaaattttttgaataagacgaacggtcaaacatttttaaaaaagtcaatggcattaaatattttggaatggaggtagtaattaatagtgcggtcaacgagtggtaagttactatatcaggctggctcgatctggatcgcatgcatggacaccaagtcactgtgacatgatccatcgagctagctagctgatgtgatggatcaagcgacaaagcaactttggacggtaggagagggtacgcacgtacgttcaatttgattaatttattagccgataaatatttttctttgtattttttttatatttttctttatatatagggagagagatatatatatagagatcgatatcttaccacaatgcatgcatgatactatcttatattatatcttgatcgatcagcagctagctggtccatccattggtccacaactccacacacacatatcgatctcaatatcttttatctctctctttaatttctagttattactgtgcgcttggctgcacacatagcagcatgcagcaggcagcttttcttacacttcccacaaaagcaaacaaaatcccagagcatcctactgtgcccatcccagggaaatgtacgtactgtgccagagccacacttccacattattctcgatctctacaatgaaatgcttctcaatttaaagccgatcgattgattggaattttttaccttcttgaagcgcttgttagtttgattgaattaatcattattccgaggaacacgggttagtaacgacgagaagcacggtggtccacgttaggtgagcacaattaatgacttttcaagtccttgggtgtgctgtcataactgctttattggtaaggagtgttgctattttctttttacagaacacttgttcatgtagttgtgcgattagctctaagtccctatcctatctcgatgagtctctagctagttcacattatgcgttggcatgcttccttaaagcctagtcataatttcgatttctcacgtggctctcttatattaaggtagaacgaaatttctgaacgatatattaacccacataaattaataaataaggaaacatgtcctactaaataactcgttgaagtaatttcaagcagatgcatgctagcaaattaactcaggcaaattgtgttgcatggctgtagctagattgagggaagtagctagctatagctagcctacaacatatatatcgtcttagcttgcctcgtcttggcggcaccaagattcaattcaacggcagctcaggaaaatgggccaggcaccaatagttccactgaaggatgtgcagtgtggacctaattacctaaccttgctgtagttaagttgcaaaagcacattcactgattgatgagcttggatctttagctaaggtacctggagttgtgtgtgttgagaatatagaaatataatgatttaatatattccataaataaatcatgacattacagatgtatactagcattaatgtatcattagatttacacatgtaaactaagcagtaaaacatgaacagatcaaatatacgcaacatgtcgaacacgtaccgaggtggcggaaagaccggttgctcggcaggaactactcgcggttgcgagcgtcgacgaaggcgcgcagcacgcgagcggagaggaaggcgagccgtcgtggacgaacagtgagcagtcgcgcgaagcgcttcccaaaaaccttattgccgccttctcccggtgcaggacgtcgaaggcagaggttcctgagacctgctctcccgatcgcaggtgcacgccagcgagcggggtggagtagtctacgagcgacggcgcagcacagaggaggaggcaaaccctagattgatttcgtgtgttttgcgtgaaggcggcggctcagtttatatagagataggtcgcttgatcagggcgcccgcacgatctccactccgcgtaaccgaaccggataagtcgcgcgtaacttatccggactccacgccgttttcacgcagcggatttttcggaatgtttccaaaacaaaacaaatccgaattttcctacagcaaaacaaaactgcaaaaggaggctgcatctgtgcaagggtgaggagccaattttgcggaccattcgacgcgtatgtcgtgcacgcgcgccgcctgccctgcccctgccctaccaggccaggtgaggcgaggcgaggcgagcgagcgcgtgttccccctcttctctccaccacacatgcttcaagaagctaggagggcatcctcccttttaaggaggtccccctctcctagaataagcaaggtggtactaaactccacatgcatgccatcccatgaggtgggcttttgtgatttttcaaagaattaatcttcgaatgggccttagcccatctattaattctaacaatcccccaccaaatctcaaaatcccactaagatttgccttttccaatgtacttttatataccagcggttcgatggagaccgatcaaggttgaacatccacctagaactccaagctacacttactcacaacttgaacaatggactacgtcttgaattacaagtcttatgcaagcaagtttcactcagagtcttatctggtactagaccgtctgtagactacccctcgggtggagcgtataagtcatactcctaggtctttaataagcttcctaaaagattcacccaaaatcttcatagactgcgaccaacagtcaagcttacaaaggtgagttctttcaagaatgctctgcaagacagcatcttcgctaattaaagccaacagaactcattaaggcatagccaacctgccttccagctcatgagagtacatgcatcttcacttagaggaccaacacatgtcttttctgcacactttgtcctcactcgtgtgcacccgggaaattcttcccggtcggtcacccatcccaaattgctccaggccaagcacgcttaaccctggagttctttggagattggcttccggaaaagaagttgcaacttgttgatatgagtattctattaatcctattaagccctaggaaaagaagttgcaacttgttgatatgagtattctattaatcctattaagccctaggccgggatgttacaccctcacccccttaagagagatcgacgcccccgtcgatcaaccctaggctaggaacgtcctctcttggccacgtccatgtgtccagtgccagcgcagcacgcttaaccctggagttctttggagattggcttccggaaaagaagttgcaacttgttgatatgagtattctattaatcctattaagccctaggccgggatgttacatatagattggtactctcctctagtttactaatggtttgttcttcccaggttctaattcacgggatttccgatcacatagactgggttaccaccatagtataactcacatgggtctcaaacccatctccttcgatgcattatctatcatatttcgtgatagtcccttcgtgaaaggatctgctaggtttctagctgtttggatgtaatccaacgctataactccagagtttctcaatttactgacagacttcaatcgtcttttcacatgtctagacgatttcatattatccttagaactattcactttgacaattaccgtttgattgtcacagttcataagtgacggagctcgtggcccctcaccgggagaccgcgcaggcccccctttgccggttcggccgggggcttagggtgagatctcaagctctctctgtatgtggaaagatcgcttgctaggaagaaacgcgagacacggcgatctatacaggttcgggccgctgcgaagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcacacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccacgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaaaaagaaacggcttcgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccaccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaatggctggcggacagcctgtcccttcgcgaggtggcgcaggaggagcaggcgcgccgcaatcttgaatgcgtccgcgccgagagagccgcactggaacagcgggctgctgacctcgaggctcgggaaaaggagctggacgcgagggcgcatatcggtggggcggccgcaggcgaaagcgacttagccgcccgcctcgcagctgccgaacacaccgtcgccgatatgcagcgagcgctggactcctccaccggggaggccgaggcccttcgcttggcgggcgagattgggcccggcatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttcccccccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcgttggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggtaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgatcccccccgtcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttctaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgaccgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcagtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgtacgtaggcgtccatctgtgggtcagagcaccggtactccttacagacttggttaacaaccagctgagagtcgcctaacaccaggaggcggcggatccccagcccggctgccactctgagtccggcaaggagtccctcgtactctgccatattattggtcgctcgaaagtcgaggcggaccaggtatctgaggacgtctccgtttggagaggtcaacgtgacccccgcaccagcgccctggagagacagagaaccgtcgaactgcatcacccagtgggtggtgcgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcattcttcgtccaagtggcctctcggggcgcactcgccttctgtgccgatgtcctcggggtcggaggatgacaggagcggccttcccacagtggcctcggggccgtcctgggggtcgggggctcctggcgtcgtcggacaagcgggtaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcatccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgctcagcttcctccgtccaagtaaacggccccgagcgcttgaggagcttaaacaagggtagcgccttctctcccagccttgatatgaaacgacttagggcggccatgcaaccggcgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgccagatctgaaagtaaagtttcttggttgcgcgtttttacaaccaaatcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccacgcgaatctgatggtaaccagagtatgcgtctagaaaacacaaaaggtcgcaccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcgaaagtgagggcaacctccgaccaccgcgcctggcgcgtcgcctcatgagtaggggccgcggccagaagctctcgcctcatggccttaaaactccggcgagaaacgtgagcacacgctcccccgtcgacagtggcaatggtggccccgggttcctggaaacctaggtcatcatcaccgtcatcaatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttatgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtccttacgtccatgtggaggtgacactctggacgaggaggcgccctccgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctggagcgcgccctgaggcgtgctgccgtcaccgtagacgaggaggcgacgctccccatctcgccgttctcctgcaccacccgcgactagcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcgcctttgcttgctcggccattaggcagaacaagggaaacttggcgcacacggaagagtatgagagctcagaaaacacacgctgagccccctacctggcgcgccagatgacggagctcgtggcccctcaccgggagaccgcgcaggcccccctttgccggttcggccgggggcttagggtgagatctcaagctctctctgtatgtggaaagatcgcttgctaggaagaaacgcgagacacggcgatctatacaggttcgggccgctgcgaagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaataaggatagccggcactggtttttcaacaataagcagatccattaatagatcacgcagccattctgcctcaacagtagcagtatccagtgccgtcagttctgcttccatggttgacctcgtcaaaatagtctgtttgcaagacctccacgaaacagtaccaccacccagtgtgaagacatatccactagtggctttgatctcatccacatcagagatccagttagaatcactatatccctccagtactgcaggatacccagaatagtgaagccccaattccatagtacatttcagataacgcattactcgctcaagcgcatgccagtgatcatctcccggattagaggtaaaccggctcaacttgctcacagcaaaggagatatcaggcctagttgcactagccaggtacatcagcgagccaatgatttgggagtattccagttgattcctaataattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtccatttgataaacaagaagaccatgtgaggctgctagggaaagtagcacacgaattgtggtcaatctagcaacaggtgagtaagtgtcaaagaaatcttcaccttctttctgagtataacccttagcaacaagccgagccttgtacttttcaatagtaccgtcaggcctgagcttcttcttgaacacccacttgcaccccacaggtttacacccatagggtcgctctgtcacctcctaagtcccgttagcgataatggaatccatttcactacggacagcctccttccagtagtctgcatcaggagatgcttatgcttctgaaattgacttaggagtgtcatccacgaggtacacagtgaaatcatcaccaaaaatacttaaccgtcctttgtcttttgctccttcgaggagcttcactgtcatcctccttagtaaaatgttcatgtgtatgttcagtttgttctggtggtgtgattgaactgggaattatttcagagggttggctagagctactatgtgtatccttcattgggaaaaagctctcaaagaaggtaacatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcacccccatgtgcgcaagtaagaaagtgatggttttctcccaatccatatctcatatggtgttttgtccttatttctattaggaactctgtttaacacatgattcgaggtcaacaatgcctcccccaccatgccttaggtaatcccgcggtgtccaacatggcattcaccaagtcggtcagtgtgcggttcttccttttagcaaccccattagactagggagaatagggaggcgtcctctcatgtataatgccatgttcctcacagaataagtcaaactcgtttgagaaaaaactctccaccacgatcagacctaagtctttttatctttctgtcaagttgattttcaacttctgccttacaaattttaaaatagtatagagcctcgtctttcgttttcaacaagtacacatagcaaaatctagtagcatcatcaatcaacgtcatgaaatatcgttttctacccttcgtcaacaccccattcatttcatagagatctgagtgtaggagttctagaggtgccaagtttctctcctcagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccatacattagcctcatcatccacactgccacaaatatggttcacagacttattgcagaaatcagaaagggaaaagcggaacagacctccgcactcataacctttaccaataaaatatccatgttaaaacacgactactttattagactcaaaaaccaacttaaatccgtctctagtcagacgggagccactaacaagattcttgtcgatagaagggacatgctgcacattcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcaaacttagaggtctgccctgcaggtgtcttcatccccttgcgttgtggacactttctggccagatggccaggttgaccacacacaaagcaactcctctcatcctgattaggattgttgttgttgttcttcttcttgaagttggtggtcttctaagctttgtatttccccttgctcttgtcctaggccttgtgcacaactttggcagtggactgcccaccatcgcccttagacgcggcatctttttcctgagctttctcctcaacatcaagagatgctatcaacccctcaaaggagtattcctgtctcttgtgtttgagtgcagtaccgaaatctctccaagatggaggtagtttcgcaataatacacccggccacaaatttgtcgggtaagacacacttaaggagttcgatttccttagccatggtttgtatctcatgagcctgttcgactacagaatggttgtcagacatcttgtagtcatgaaactgctccatgatatacagatcattgctagcatcagtagcaccgaatttagtattcagtgcatcccacaactccttagcgtcggtcatatacatatacacctcgaccagacaatcgccaagcacgctaagaatgcatcccacaaagagagtagtggcctcatcgaattctttctgctgatcagcattaagaacgcccataggcttgccagtactcacccagaagcatttcatagctgtcagccacagagtgaccctgatctgccatctcttaaagtgcacaccggtaaatttatctggcctcagtgcatcggcaaaaccagccatagtaaaatcacagtgcgtataataaggtttttggattgttgagaatatagacatataatgatttaatatattctataaataaatcatgacattacagatgtatactagcattaacgcatcattagatctacacatgtaaactaagcagtaaaacatgaacagatcaaatatgcgcaacatgtcgaacacgtaccgaggtggcggaaagaccgattgctcggcaggaactactcgcggttgcgagcgtcgacgaaggcgcgtagcacgcaagcggagaggaaggcgagccgtcgcggacgaacagggagcagtcgcgcgaagtgcttcccaaaaaccttattgccgccttctcccggtgcaagacgtcgaaggcagaggttccagagacctgctctcccgatcgcaggtgcacgacggcgagcgggatggagtagtctacgagtgacggcgcagcacagaggaggaggcaaaccctagattgatttcgtgtgttttgcgtgaaggcggcggctcggtttatatagagataggtcgcttgatcagggcgcccgcacgatctccactccgcacaaacgaaccggataagtcacgcgtaacttatccggactccacgccattttcacgcaccggatttttcggagtgtttccaaaacaaaacaaatccgaattttcctgcagcaaaacaaaactgcaaaaggaggctgcatctgcgcaagggtgaggagccaattttgcggaccattcgacgcgtacgtcgtgcacgcgcgccacctgccctgccaggctaggcgaggcgagcgagcgcgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttctaaagaattaatcttcgaatgggccttagcccatatattaattccaacagtgtgtgtgtgggcgcgcgctaggccccctttgattcaaaggaaattcatagaaattttagaggatttcattcctatagaaatttttcctatatagccctctgaatcaaaggaatagatcttatagaatcctatgaaattcctatggagtgcctaatgccatgcaagttttggaggaattttaacatgaggtagaaccttatggaaactttccttcgagtctttatctctcctctaattcctatgtttttcctgcggtccaatcaaacaataatttctatgtttttcctgtgttttgctatctctattttacacttacgttcctatcaaaatccaacgtttttcctattcctatgttttcttattcatgcgattcaagggggccctaccgaaaccctcctgccactaagagagtgtttgtgagtaggggaaaagaaaagattgagaagataagctagcgcataattaattgagtattaattcttttaaattttaaaaattaattgatatgagtttttaaagcaacttctctaaagtaatttttgcaaattaagcactatttaatagttcggaaaacgtgagcaggaaaaatgaggtaaatctcaatctactagaacgaacacaacctaaatattactcccataattaatcaatcaagattattttcattcttaatttacttaaaaaccttatacaattaataagtagggttaattgatgagtatgtacgtcttgctcagtatttttcaaagaaaggatatgtttgatagagctccaaataaaaaatggatatggagttgtgaagctaggaaaaggtcgtgatttacttttccatgtatttttcccagtagattcacctacaccgctctttaaaaatattaaaaatttaatggtgtttagtttggctttagcttcactagacaatgattcaggggatgggtcctgttaaatagcccgaaaacatccaaaacagaaaataatattgtcttaactacatagaagtaaggagtgaaatacatggccggtccttaaacttgtggggtggtgtcacttagatccgtgaacttgaaaattgcacgtttagttccgtgaacttagtttaatgaaccacacctggtccaatcatcctttgaccacgtttgaccgccaacgtggcatgccacataggcaacacttttgtgctcagccccctccacatatatcttcgtacataactttccctaatcagtgcatttcaacccaaatcccctaaaatatccctaaatcggctaaggtttcgacggtgaggttagtggaaggaggtcgagaggtagtggctgtggcggactcgacggtgagattagcggcaggaggcagcgtggtgcagcggggttagcggtggcacagtgcggtcggattagcggccggaggtagtgcaatgccgcttgcacactaggcatccccatggattctccaagctcgtccttgtcttgaagtcgtcggaagaaggtgttgttgaccaagtgcccgttgtgtaaggataatgtcattttggagcgcagagcaatggcaattgataatcaggaccacattttctatacatacaaggagaaaattgagagtgaagaacaatttaaggattttttttgggggggggggattttggtgtcactgaatagctacaaggagatatatgcgacgtgttgtgatgtggagggagttgagagcaaaagtgttgcctacgtggcatgccacgttggcggtcaaacatagtcaaaggatgtttcgaccggggtggtacattaaaccaagttcacggacctaaacgtgcaattttcaagtttacagacctaagtgacaccaccacacaagtttagggaccggccatgtattttactcgagaagtaagtgtaagtagtgttacgatccctttcggagccacaaatacctcatttcacgactcaaacgtttgtcctagaatgacattaattttaggtatgaggtctgcattcgccctctttgtgttatcctcatttctcttctcttagatagagaacacaccatcacctacctcaaaccgtcaggcgtaaacatcattaattagttagagcttaggcatgtcaaaaatctaggcgagcatatcaaagcacaggagaaccattaattcttaatgaaaggcatattcgcacattcgacccattctaatacgcattagactaacttaaaaaaaatcttttagaacgaagaaagtataggattgtaaagtataggatcgtataggatcgtaaagggttgaggtgaggggctcccccacttttcacaaccaatgcgggattattcaacaatctttccctttacacattagtgtctctcaacccttcaccgttttcctatggtccctcaggtatacaggtcccgcaggcacacggtccatcaggactttacacgtatgtccctcgagccagagatgttaaactagccaggctctgatacccattataggatcgtaaatggtctttctcaccctaaaaggtagcgaggggctcacccacttatatattgtcccttaatttttcacaaccaatatgaatctattcaacggagaccaaacagtactttgaaagtatgtagacgcatatactagaaattccgattttaataatcggtcgtctattagcaagggccccctggttttccccctcacgagcactgcacaatttcctgtagaaactatagcgatattgttgcaaacatatgtccagtaattcttttatcacaatgtatacagagctttactatcatttccatatatgtccgtagcagccatcatccctagattatatatatatatatatatcaaggaagatatatatataaagccatgttggtaaaaacaaaacaatgcaagatgcatacatatatttatggtggggatcgagtacatggcatggcactgttctaccatcatgtgtatgagacaacacgaaagtctgcagtgctaagttaataatgcatggccacaatctacacaccatgcgtacgtggggatcctttttgctaaaaatacaccatggggatcgactactgtttctacaggatcagaggacgtttttcatcttaatttttcaaaaataaaataaaatgaaaggatgtacaaggacaacttcgtctctatgcacacgcaacacgtactactattgagaaagtaattaacacttagcgctgtcggctcatttcatacgctagctagctagttagtgttttttttaaaaaaaaataatgtgaaagtcctgccatatccgctgcatcacaaatttaaagaatataatcccgacattattcatataacaatatattattaaagaaaatcctgttattaaatttgtatccatgattggcaaaaattgcatgaccattatctctaaataacggcatatatatcttacattctttgctagttcccttcacacctttgcaacacggcctagctagctagaaccgcaaaagaccaatatgcatggtcacctataaaaagtacttgcatatataatctaacataagatttatcaaaaacaaattcatttcgattttactgcaaacccccaacataatgcagatggcacaactaacaatactgacttcaaagctttaatttactgatctcgatcgcacaagcgtagtgagggcagtgatatgacgagtagccccgtactaatttcacattggatctgatgactaatactccgatccgtattagtttagttaagagagtggtggcttttcagtttaagccttcagtcttttaaaattaatttatttttctaagagaaatttttatttaacttctctgaccacaattatatagtacaacaatctaaaaagttttgggtgtcaggcatgcagcgcggccagcagctagctggcaaagtggcagagtttgatttgttaccactgatgactgatccgctcatgcatcatgcatgcatgcatatggagtatgtttgtttgtatatatatcatatcgatcctgaagagatctaccatatatctgacagatccaagcaatcatggatctcgatcgatcggtagatgcatgaacaacgacttccataagccaaacaacttgcgaagccgatcgatatatcattttgaaggactgtccacttgacttcattcacaatatatgttgagctatcttgtgttgattggcaggcagggacacaagctaggcaagcggatcgacctaggatgggctggaatttctttctttctatgagatggtccggcccaacaattaatccttccatctgctctgcataagtgggctggcttactatagtatagtgggactgaaaaaggaaaaagaaaaacgaaaaaattcgatccatagcaactaaacaacctggtaaaaaatatactcgcattaagtttcctgcttcaactagaagcatagaccaccggtttttcttcgatacgtagcactttcatcacattttaagctaacggtgttagattagagtaaagaaatttatcctcgaattattttacccttcgttttcctcttacatgaccaggtcatcgaccaagctgctatgccttgcatccctcgctctgtgcaccgtcgagcaagtagcagccgtcgtcaccccattgagtctctcagcccttgtgttgataggttgcacacgtcaagccagtcttttccgctaacgaccattctgctctacctttgcagccctcgctctatgcaccgtcgaccaagcagtcgctgttgtcacccgctgagcctctcagccctcgtgcatgttgataggttgcacacggtcaagctagtcattgccgctaatgaccaagccgtagcgccttgcagccctcgcgcaataagcaacccatgagcagtagtcgctgtgctttgctgtcacgctcggtcaagctacttgcaagctggcgctgcagttgtagccccaccgcgcctcacaagcagtagtcatcgttgtcaaccaagccgttagagattgatgccccgggagcggtgccaacggtttcgagcacgaaagcaccacccagaggcgagagggaggagctgaggtccatggggctgcaggtggagaccgatgataggggcgagagcatcggtgttggtgacgagggtcgtagatccagccgtctgtgtagacataaatgatagagaggaggtgtcgagattggcaggcggagacgtagctggcgagggcaaagaggacttggtggctaacatggaacttttggcgacggaggacgaggacgatatgtaacaccctcgtcacatttaccatttatacatgtaagttgggatgaaaagcaaaaaagactatttgctcttgcttctctctatatagcatcgtaacgagggtgttacatatcgaagaaaaactagtgacacttgctgccttctagcgaagaggggaggaatttttatgctatttttttttcttttttaccgactgttttgagagtgctaggggtgtgaaaaagaaaaggaggcgataaggttgggaaaggaggaggaaacggacgccacgtcacaagatgagagagagagagagagggtcgcatcacatcacatcacatgatgctgctggggctgcaactgaagtccacggcccccttgtgcaagaaagaggaaagaaaattccaaaattgcttcacgcacccccccacccacacaccacgcgtcctccaccgtccgatctccaccgcccacagcccacaccacggtgggaacgggaacgcggcctcccctattcggcgcagttgctatacgtaccccagcctcgtacacaacgcctttcccctcccctcct

SEQ ID NO: 40937 - DNA, 17316 bp, Oryza sativa
tgttgattggggctctagactgcacgggcatatgcatccaatatcttcttctaggcacaattaatttaatttcttgtgtgactctaggatctaacctcgattggtggatgttaactgctagttccctgtgttgctagtatgttctcttcatccttcactcattacatgtcatctaaaaggtacatgtttcatgtttcggcggtttagggagcgttcttatactaaaaatcatcatacatgccctaataaaaattatatcttcccccccccccccattactgcacctattgtactgctggtgccataaataaaccaaatccgcattcatcacttgctaaacaaaccattgcaaactgagtttgatttactcaatgttatggatggtgcttatctaattggcataacaagctttgtgcgtcagggttcatcggtcatcatccagctactatattcacaactcgtgtgatggatgtgcttacgtgctttccagtgccatgggatcgtattgtggccttcatcttggtttctccaccaatgtccgtggggaggaaccatggccaacaatggaattatgttcttcttgttgctggagcaccgttatcttcttctcctattattttctgttgccgccttcttctgtgccaaccagccacaccagcagaagttgtgcttcgactgatggtggcgggaagcacaattaattgtgcccttcatttcagagcatgccgaaaaatctccttcccctcttcagatttatacttactgccaacaatgatgagtaccatacatgctaatcgtatagctcctttaatagcgagttactaacaaaggagtttaattttatgccctccatgggggcttatttttaaacgaattgattttatagttaacgttcgcatcactcaaccaggatgtatgctttaagaaatataacatgattgccatgtaaaacgcctgatgcactattatcatatttcttgatgagttgggtcctgaagaaacatttttttcagttaaaatagccatccatcaaactttttttttgttaaagaaaataaactatggctgacaagatttccatgttcttaattgctttcagtctggagtgctttctgatctctaagactagtgttctcgtaggctaggtggtcacagtagtttaacatgatgtccatctagtataacaggactcgtattttttttctataattgatgctaagatttatatatcttctcttatcttttgttttagttagtcaacattttagccttacaagcatagtttgtcgtatcctttttggaaaataaacggcctatacttttctgttgatatctgaggaggtgtatggcctgcgtcaaatttattcacctgtggtacaaaggttttagctagaatctcgtgggttggctatgaatgatatgtgcaagaatatataattgttccagacataaattaaatattgcctgtctcttgtactctttatatatacatctttatgccatctttattcctttttttttcctcttggtctcaggtgtatttcacttactcttttggatagcatggcttatatcggaactacctctatgctaacattgtctaggtctcattagctagattaacttaactgttttcacttagtggtgttagtctgtaaagaaaatgaatacccagtcttagttgagtcttttgtaaaaaaaaaaaatggaaccaaagaatgcaattgcactggatgaacatgtgctggattctactatccgcaagaggaagcgtgtgggtgctactcactgtgctgaggccaatgacgcccccaacctctctcagaatggtccaaaacagaatctcgctttatttcctgattcgactggacataagaagtccaagatgatgtgctctgccgatgacattctggagaggtacaataacttcaagataagcgggatgcctgttcgtgtgatgtctcaccaacatggtggatggagagacttcccagaggatgttgtcaattcggtacagcagagcttccagttgaagaggccaattactagtgcagtattccagaacaggcacatcctgttggacttcatgcagatggtttgtttagattctgtgatggccataagcaagccaattgcttggatcgatgatcatggtaaatgcttctctccggattcatgtgctggagtaataccatctgaacctctgcagcatggaaaaaatgagttcttgaaaagttttcatgatctaagcagtagttatgaagctcatgaacatgatgggatgtctgcagctgaaagctcaagttcagcgtcttttgatgcagtgctttctgatgttcaggaggtcaataatgtagtggaggacaaacagaaggtactcaatgaaagtggtgaagtttctggggaaaataaaaagggccatttaagccatatgaatgaaactgctgatggggccatgcaagctcctcgtaataatcaaagtgtccagcgtgctgattcagctgttcggaatttgttgtttcaaggatcaggccatctatttactgaaaaagacatcatcggtatttatagaaccccaatgctagatcaacttgggaggtcccgttatagtcttttccagaaggaggtacaagtcacaaaaaatcaacggggaaatgcaaatgagcgttatgcatggcttgcttgcactaagggtactatggaggagatgatgatgaatggtgctttggaaatagcaaaacctctgcagggtccaatgtatggtgttggggctcatcttgctccagcaaactcctccaatatctggtaaataccttttgtttctgatttatttgttctatgtgctcttacgcctctggtgttactgcttttgttttggatgtatagtagcctatgtcttacttgaagtttgtccacagtgttggtttatctgatattgacgaaaatggaatcataaggatgatgttgtgccgtgttataatggggaatgttgaggtggttttccctggatcaaatcaatgccagccaaccagtgaaagttttgacagtggtgtggatgatctccaaaggccaaagcattacatcatatgggatgctaatgtgcataagcacatttatgctgaatatgctgttattatcaaagtaccttacatgaacaatggtactataccatgttttttcccctctcttttttaccttgtgtcgttattttccatttgccctagataacttattttatattactgtatgctatttggttacaggagatactgcatccaatatctctgagataagaaattctggtgcactagacaatccaaccaaggtatgcatattatggtttagctggtgtgctgttgttcactgaagcataattcagttctgtcatgtagtacgttttgcgggaaaattgaatttgtctcacctaggcttaatgatctattatgtagtgtagtggaaagggtgaatggatgcttagacttgaaggcgtgttttgtgcttctcgttatgggatttgctcactttattagcgaaatttccagttggcgtttaaataggttcccatttattactgtttccgcagttagtgttctttaacccgaaaaacataaagatgacaattactatatctctttatattttggttatggcctatggcagatccttattgaattccactcttgtatttcttgacttgatggtgatggaatttcatatttttcttcatttttgttgttgattagtaccttttaatgtctgatcatatatggtagtggtgtaggatgggggcgggaagatcaaagaactttgcttagttatgtgtttccttcttgctgatgctctttggatgtaaatgaaatttactgaaatggattcaggttctgttggcccaattcctctgcttttcataatttgcagaaactaatccggttgatttttctaaaagaaaaactggttcacaattgaatgattgataattggcacttaatgggcgagcttagttgaccttgattttgatgacagttttaggaaaaatttcatcttgttaatttgttgcttgcttgttgtgagcaggatgacagtctacagaccattgcgtcttcaggtgatgaacaacaagcatgtatgcttgggcgtgctccaagtccaaggtctcctagttcaccttggatgcccttttcaatgctttttgctgctatttccgctaaagtaccccgttcggacatggatctggtgcataaatattatgaagaattcaaggttatttgtccttcctttggagattttcagctacatgcaatatttgtttgctggcatgctaattatggtatggtttttgatgttaaaatagaggagaaagataagcaggcctgacctagtgaagcagctgagacagattgttggtgacaagcttttggtttctacagtagtgagacttcagcagaaggtacttcttttttactgtgctaactctttgtatacagttcacttaggatttgaagtcctccatcctcactcaatgtgaagcctgctgtgtatatttgaggaagcgtggtacatggaattatgcaatcagctaattgatttttttccccaaaggaccacatatcatgcttagtatgcagcatggaatccgtagcattgtttcataccgtctaatgtttgagtttaccatttactaatttccactatattattcaaacatatgtttttacttactattgatacctgccgcagttgccacccatggcagcaactgaacaagcgccaagagcacctggaaggggaggaggtgctagtccgtaattaaaaatgacagtttgccgacataacaagctgtggaggagtcgggttgagcaaagagagctcaaggaaatgtgtgtaaaacgtttgtgccgtaatgcacagactttagctcttgacaaacaaaactagtctaaacttccttgttgacaacatgttgtttggttgtataaccatgcatggtattctcgactaccggctgtagtgttgttctttttcgccgtcaaatgtagctgcggcttgaattcatcaatatctcctgtggatatttcgttcccgtttcttgcagcttgtgtacaccattgccttcattctgatcctggggtggcctcgcttgaacttagtaatgctaggtagtagttgcagcatgttccatgaaatggaagcaacaacttgagccttgatctaggtttacaaaaccgctcggttatcgtggttatcatatgtggtgagctttttagtttttgaaaccacgatatacctaccacgctgttgtcatggtaaccgtgaggtgaggtaatcttgtttggttaaccctagctagccttgatcatgtacctaccacagccttggtcatgcacctaccacgcaagcagaaatctttgacaaaaacttgtatgggctgatctgatgctacccacatccattgtttgcgttttggcttattagctgcaactagaatttaaattttaaaacttgattttaagttaatttaaggttttctttaacgcagtttatattctattagtattaggctttttagattatatacttagactattgaaacagattatttactataccattcgaaaaatacatattcttatttttttttactatttgttttgagttatttgttaagtttatatattaaaatatttaatttatctatacaatttagtagataatttacaactacaatctgatgaataatctgttttaaaccgagtcaaatcactaaggatattatataagagttttatgtataaattatttttagttgcttcgtttattttttctttgactttgtcagctgtaaaacaagcgttccagaagacagaaaattagttatatatatatatatatatataaaattcaaggctgttttatatactccctgtgtttcaaaataagtgtagttttgcactattcatattcaacattggaccgttcgttttatttaaaaaaaattataattagtatttttattgttattagatgataaaacataaataatattggtttcaataggactccttacgagcgttctttctatctactattatctaaaaatagtcaagttattaatgactagacgaaaccaaaaaataaccccttatgtacgaaattatagaagatcccctttaagatcaaacaattccatcgaattgagtatgactgtatgtgtgatagcatctactatatcaggaatatcaatgaaccccattcttgcaattgctcaggataccctcttttagctgctaggtctatttcttagttcaagatccctcttaataactggaataaaagaattagtagatctgttccgcccaaaatgggaatgggcgctagggttatgaacttataatcatggaatcgactcgatcatcagattataagttcattccataccggaccagaccgtgcacattcttattataagaagtggtcattcgagcctatggaaataggatactctgtttacatagaaatccccacgtccttacattctatttaggattaggaataggtgtaatcagacctgcttttgacatatctattctatccttatttgggtaccatatgcacctctttgggcttctattgaatcgagaaattggattgtatatctttttgattttgatacatataaggtgtcctacggataatgcaaatcgaagctatttgatgtctgactcaggcctatatgaccgatcgaaatactccaagactccacctttgtcatatattccatatatcacattagatagatatcatattcatggaatacgattcactttcaagatatcacattagatagatatcatattcatggaatatgattcactttcaagatgcattgatggtgaaatggtagacacgcgagactcaaaatctcgtgctaaagagcgtggaggttcgagtcctcttcaaggcataatacggagaatgccattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgagaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttctattcgttctttgagcaaaaagataaagatcggatagattcgaaccgcaattgcaaaggtaatcactactatgccagcctaaatcatgatcttcaccaacttggatttggttctctcgcgaaaatcgcgagttgcagatatgagaacctttatgtgtgactattttttttaattttttcataattttttcaaataaaacggacggttaaatgttggatacggatatccacggctgcacttattttagaacagaggtagtataattcaaagtttataaattatcacctgatcaaatgatatgtctgttaatggatagaaccgaacaaccagtccacatgcgcatccgcaaccaactaacaaaatgtgaattatatattctcaacttgagcatgtcaggggaatgtttttgtgctggagcacctagctagtactgtatataatttcggtgagctgatcaaatttagaggtggatttggctgaattattgaacatatatatttcgtcaaaaaacatataaatttatatcgatccttatatatatgcatatatgtaagtatgggacaacctagagcttacaatgctagtactagtctgcaggtatacctaaccctaaccaatcagctaatcaggtcgatggttgcaccgtcacatccgttattatacagccaccgtacgtacgtatgcaaactcctactacatgcctgcgcatgtgaaatgccagcatatatacactggcctctactactgtacgaccgtcaattgttgcctcagctgcattttataggtgtatgcatgtactgctgtacagggggtgtttaaatccagggtgtaaaatttagacgtgtcacatcgggtattatatagtatagagtgtcgtatgggttgttcggacactaataaaaaaactaattgcagaatctataagtaaatagcgagacgaatttattaagcataattaatccgtcattagtaaatgtttactgtagcaccacattatcaaatcatagagcaattaggcttaaaagattcaactcgtaaattagtcacaatctgtgtaattagttattttttagcctatatttaatactttatgtaggtgttcaaacattcgatttgatagggtataaaatttttgtggggaactaaacagggccatagtcatatatttatgctggcttctacttcctccttcaatttatatatcctctttacattgatgccatacatatgatctcttcatctgccgagccatttgaagtggatatacatattgacatggaataaataatttatatgctcgctcgccgagaaggaaactgaaacatatatttgttagttaatctgagccttggatgagcattaattcatacatgtataccgaaggaagaactacatgaaggaagagttgtgactaatatttatagactgaactaaccgcacatgcagcttaatgataaacaagcactagcttagctagctagctgcattacaatccgtgtatgattagtttgtttcatacatacatacacatataaatgaggggaaaaataaaatctgttcataattttgtcctctcattagaaggcttaattgctggctggttatttggctaacgaacccacatgccatatgaataagtggtttaatttttatctgattgcgcaggttgcaaccaaatgctcctagattaattatcaccaacagataaggtgaggccagcgggataaattaactacttgtgaggttgggtatgttgagtcttcagaagtcgttatattttgagataaaagttaaacttcagcggtatttaatttatattttggaacgggcgagtaattactttgtggatatatatgcttaagctaagttaatttgtagggtcgggcgtacgtggatggataagattataagagagggacctgagctgatgctgcagatgataggggccacgaaaatgaaatgtgatacatatatagcagaggggagagactatgtatctagctgcagcctgcaggtttatatcaacctagctctggagaagcagacagagagacagacatacaggcatcatccttgatcccatgttacacgggggtctctctgtccgaaacctgaatgtccttgcattgcgttgcattgcattggggccttctgaactactactctaattaatcatgtcgtccacatgcatgtgcttggctgaatgagcagctgcagcttgttaattagtactccagtttgctaacccggccgtcaacggatatgggagattattatcccttgccatgttcagacaacagatatgtttcgtagccgtgacatagaaactactagttcaaactgcagatatatatggataacaactctgaaatcgtaatcaatcgccttgcatggctgctatggcagtgggtcaatgcaagcaagaaagaaagattaattaacttgtatgtgtagtattcgcacagccgttccaaacaccacctaattagttgttaataattaataatgtactgaactatcaagcaaattaagctagttccatgagtgagtaggagtacgtcagtacgtggcccgtgacggtaggtaaggttccctttctttccttgtcaatcgatcaatctgctttcccttcctttcatccagggaattcaaggatccaagaatatgtacactttgctagcacttgcctttaatccatcagtccaactaattcatcacacagttcagttattagggaattatataagccaccaccacaaattaattggttcacaatatgtgtccagctaattaagatcaggtaccgctaattaagatcaggtacccaagtatagcatatgtttagtccaaattaaattaactagttcatgaggactacagcaagtaggtagcttaccaactctatgggtgaaattaaacatatgatctttttgtgtgttttgagtgttagttttcgactatcatgtctgcttgcatatatagatttttatcgatcaaattttgtgatgagcagagcagtcactgccgtgctagctaataactaacctgtgcgtagtgtgtatacgtattttctcataaatgatttgagatgaaaagaaaaagcagaggagaggagctagctaattaagcttgaattatatagataagtgcagtacacgtaagtacgtgacagggagcgatggagagacgaaagacggcgactgcacaacagatgaattgatggagtatgtatttaaaagcctcgctggcgatcgatcgattatattgactgaagagtaatctctgatggatcgatttttgaatcccaaaattaaacgatatgatatgatagagacatagcctgtatccaagttattcagttatacaactactaactcctgctgaacaaacctcatgaaaacttttaagccaaacaagtaattaatcatgcatctcatgagctcacaaatattatatgacgcaaccaaagctagcgtagctagctactcttgaagtggaggaaggaagaatatacatgtgcatatgtatgtatggtatgataaacttgactaattataccattggatcattgttaaccagaaatggtataaagaagacgcatatttttctttctcttgcgacggtgggcatgacagagacgcagcatatatagatggatggcatccgaccaactccaattggcgacgtcgtcttccttctctttccgcccgccacttcataccgccctctactcttgttgcttagctacctagctagctagctttcctctccactccatccacccacgcacctcaatcgatcgatcctccatggcggcggcggtgctggcggtgctgtgggcgtgcatgatgatgatgagcctagctccggcgagcttggcggcgtcggggttcgaggaggtgccgacgatcgcgttcgacgaggggttctcgccgctgttcggggaggacaacatggtgaagtcggccgacgggcgcacggtgagcatcaccctcaaccgctacaccggctccggcttcatctcctccgactactaccaccatggcttcttcagcgcctccatcaagctccccaaggaccacaccgccggcgtagtcgtcgccttctacgtacgtattactagcattcattctagctcggtgatcgatcaaaccatgcatgaattgatcacgatatatgtattgattgctggtgatgcatgcagctgtctaatggagatgtgttcgagaagacgcacgacgagctggacttcgagttcttgggcaacaggtacaggcacgagtggaagatgcagacgaacgtgtacggcaatggcagcacggaccgtgggcgggaggagaggtatctgatgccgttcgacccaaccgccgacgcccaccgcttctccatcctctggcactcccgcctcatcgtcttctacgtcgacggcgtccccatccgcgaggtcccgcgcaccgccgccatgggcgccgactacccctccaagcccatggcgctctacgtcaccatctgggacggctccacctgggccaccgacaacggcaagtacaaggtcaactacaagcgcgggcccttcaccgccgtcttctccgacctcgtcctccgcggctgcaccgcccgctccgacatccgcctcgccaccaccgccgacgaccaggacaggtgcgccgcggcggaggaggacctcatggagagcgacgagtactcctcgaccatggccatgacggcgaggaagcggatggcgatgcggcggttcaggcagcggcagatgctctacaccgtgtgctacgacaccaacaggtacccggagccgttcccggagtgcgacgtcaacatggcggagcggcagatgtactggcagtggggggagtccaaggtggttcgcccccgcgtccgaccacgacccggccgccgctccaagcgccgcccctcgccggaggccacggccatcccgccgcccgtgctcgtctccttgcagcaagctgactagtctttgattagaatattctattctatgatgaggctctagctccatcataattctttgattaattttgcttccttcacatgcgtacatcgatcatactgtaattagtaccccctgatgatagagattaatttattgttactgctgcttcttcacgacgaacagttataaccgtggtcttaattaaccattaactataaatctatcaataggtaatcctttgttggtttatcctatttgatgtcgatctggctatctgatcattggtacaagtatgttgttagttggattgatgcttaattagttagtgatggtgcgatgatggattgatgagaagaaagcagctgcatatacagaggtactccagttgcttatttggtcacaattgaattacgtgctactactaattaattgcggtggttaagtgtgcatgtgggagttgagagtgagccgcgcgcaggcagtctgcagtacgttcgatccaactcagatcagataatcgaaatgcgtacttgttgtggttgatgaatgatgatcgtattcgtatagatatagctaatatattccagccagctctgccctgtaaagttaagtagaggagataatgatgatgatgatgcaaattcatcccatcattattggcagtattaagctataattaggcagctgatgctgcaatgcataatgcttgttccaacttctccatccatcgtctgcatgcgctggtgctttgctgtcttccatttccacctccttttccctcaaccttttgtttttgtttggctctgcctcaggctcagctgggttggtattatgcgcaccgaaagcaagcattgcaagggcattgattcaattaaagacaactaattatacattaatccccaggaccgtgcatattattccatcgcttcccttcatcccaaatactacattacatatgtgttgtactatactataatgatgattccataatgataataatgttgataggtactctacatggggtttgtaatctctgtcccagcaggcaggcattccccttttgacaaaaatctgaaaccacttgcggtttaaagccccctttctctagtgtctagtctggaccctgcatatcgtccaatccatacacagattgataatccccgttaattttctcctaacacaatactaccacatagtatatttcttttctgtgcattccaaacagcccaaacaaacccctgtttgtagtctattctacctgccctcgttgtatgtgtgggggcgatgttcattccccccttttttcctctgcacgaaaatgttggctgggtcggcacctaataaacatcctttacgaaaaaaaaagagaaagagaaagagaaaaggaaaaagagagaaacgacgcgagtttatcttatcacaacagggtagacaataaaacaaagagcatgtgacgactgcttacattttcccgacataaagtacaccccctgtgacaaacaaatcaaactagcccagcatttcactaatcattcaatcatttttttaatgcagtatcaaacaaatactaatccacaacttttactacttaccaaaacattgacccacgcaaagctcttactcctaccaagtcaaaaaggaaataaaagcattgttgaaaacaaaggcacctcctgatgaattgcccatgctgcttttcccaatattataccaaaatgctggaaaatggactctaaaactatacagacaagaaaaatgcaaccaccatgattcaataacaatggcttctaatgctaccaggtcagtgcacagatgaacggcttgtaccacttaaacatgacattatcagttgcaagaaatgcttcaatcttatcttgtgcaagaggaaaaatacagcagaataaatgcaaatgtgttttcaaataacactggtgaaaaggacttcgattgattcaacctgtcttattaagcatatcatataagttgctgagttcagtgaagttatgagaagtgccctcactttcccgttcggctacaccggcaggaatcaatcaatgccagaatctgaaacagtcaaagttacttaattttggaatcaatacagtgtggcagactgccagtactaccagaagttagttgcaatcagatagagcaggcaagaacaaaaaaaaaaagctatcagtagctacaacacaaagtagctatcatacagatttgacaagttaccattgatcaattcttacgcctgccaaacctagatacaagcaggtaaacccctcgggtaaaccgtgtttcataggtggaagattagtatcctcccacatatagggtgacgtttcagtattgtttcagcaaaatgatagaacataacatagacataagggtaggtgatgatgtgggagtttattaccgagatcccagggtaccttgacaaatggtggctaagtatgtcctattgtacctcatcatcctgtatggtgtgatgacaggaggcccatctgttctgtaaggttagccatgttttcagctttggtccatccattcccctgttgtgtttccttttggtctagtacacctgaatcgacttcatcattatcaacagatagagggctagccaccaggaactgttcccagaaagaatcaatgatagcaggaagtttctgggtgtcatcgttgtacaaaatctcatcagtctcaatgggaacactatcatcaccttcttcaggcaaagagaatacaccctcaggaccaggcatttcaagccccctccaggaatatcaacattttcttcagctactatatcttgcaaatctggaattccagaatattgatatcagttgggcctggagccacagccttcggaacagaaggcaccgcactcatgtttggaacttctttgggtatgccgttgtccaaaacaactgggcactgaatctgaggagtcgaagttgaacaaatagctgaaagtccagagcttgtagctacatatggcaaacctgagttagctgggacctctgcaagggtaacaccagaattccgagttgatgaagagctgtcaagaccttgaccatttggcatataattctcaagaaggaaattatctgaattgcccatggattcaaatctatgtgaagaatctagctttaggatcttccttagcatcgctttggctgcttcattgatcataggttgatattttactatttgtccatccaatgaagcactttcagagtccaacgaaccatcctgctttggtagcctcctctttttgttactagcaactattcttcttctgctgttttcgttttgctgtacaaattgtgctaggaagccaggactatgcattgccttagccaggaaagacatcatttgttgttgccgttgctccattccttgaagacgcttgcccaaagtctgcagctgatgatctgttgtctgctgttgttgtctcagcctgacaagttcctgcattaaaacatttttatcccttttgagcatctcaatctcttcttccatcccaaacttccccacttctacgcaagcaggtacaggagcagctggcaactgaggctgctgaacttggttgtttccatgagttggtttccttctgttgatggtcttcagtagatgcttttgtcctctaagaaaaccttcgtttgcaaactcccacctatctggatcaactttcctaaatccctgctcataagtgcaccaatgagatcgttagaggccggctaacgtacatggcacagtgtatctgcccggtacaagtacttctgactgagtgttatatgattacagaagtagtaatatcattagaagggctaatgtaaatagcacagtttatctgttcggcttaagtgattctgagtgtattagcaggatcaagaaaagatgaaccaaagaaaaaacagacaagacaaccagtacaaactgtccatgattcacttaaaactgtttgtagttcacaaggaaacagctgattggccacattagggaagaaaactaccacaggatgcacaagcagtactggtgtaatagatatatttgcaaatgccataaaggccccagccaactgaataggaccaataaattgctagttgcaaaagcacatatcaaccgtgtgtttgttaattcagcttgagaaaaacttatatcggcaagaagaaagttatctatcttgcctggtaataaagttctaaaagatcagactcaaatctcatataggctcattaatccattaaggtgtagttacttctggttcaacaatcatcagaaaggtgcaaactacaaacgatctcataaaaaccgtctacctgaaatagacagtccttcacaggaggtatcacagatggtgattttgaagcagtggtagttgcacaattgatgacaaaacaagaatacctatatctatatgtgcgtgaaactatgagctttcggttagcatttaaacctgcttcgcgtgaggatgctttgttctctgtgtaacttgttcattcttgtttaaagaagacgtgaacaagtaagatgtacatactcaaaaaaaccaactttttcattcttgttaaaagaaggcatgaggaattaagatgtgcatactgtaattgttcaagagagacagtcaagcctctgcagaagtgccatagatgttggctcattaaatatatacgctgtagtttggggacgaaacctcaaaattttggactgaataactatgaataaaggtacgatggcctaacaaaaccataagatgtatcaagtgctgtagaattaaagatggtctaaaagtgtgctggattagagttatgaatccccctaggtgacatccagatctacggtgccccaaaaggggaaagtattaaagccggtcgatatgtgtgtcaccaaagaatggaatccggagt

SEQ ID NO: 40938 - DNA, 1591 bp, Oryza sativa
ctcgtcgtcggctgctagtgggaaggagacgagacgagagagagagacggcaggccgcagagaagaaaccaacccatccacaagaacaacaggggatgggccttttcttttcttttttctccgacgagggtgtttctgtaattttgctcttctttgctttgccgctgccgctgcggctgcgactgcgacctacctaacggcgctgccccgtcgccgtcctccactccgccgtaaacatatctgtatcaatccttccgtttgtttgttcgcacgcccatgaaaattatccctccaaataatctgatttttatcttaagaataactttttattgttttccttgcggtcaccttttcttaataaaaaaaaactttttttataacaaacaactattgtagaaaccaacctataatacaaacatgtatgacacctacacctagctagacatatgtcatacgattgatacattgcatatacgcatgaaagcgaacttcaggcaggcaggggtcatctcgccactatcctacttactcatagccttatcctacgtattctctccgttcccaaaaaaaataaataaatcttaacacaaacatgttcgtttcgttgtaaattgtaatatgatatatcaagggcatttttagatccatttgaaatagcaaatagcaaatagcaaaagttttggtggcaaaagttttggcattgcaaaagtactagttggtgtttagatgcatcctaaacttttgccattctagcactttttagtggagagagagaggtcccaaagcactttttggcacaatttgctactatggcctagcaaatggtaaatggcaaatcgccaacttttgctactagtgtttagatccaaaatagcaaaaagtgctccaaaatggcaaaaggatctgaacaggcctcacatttatgcgtaggtttgtttttgaaattgatgaagtacttactccctttatcaaaataaactaacctcgtccaagacatgaaacattctaatacaacgaatctggacagtatgtctagatgtgttcagattcgctatagtagagtgtgttacatcatgtacgacattattttttttatagagagaggacaaccttagcttaactatacagagagataggactagacatgtgatgtgtctgtcccgagaagatatgtcagtggacttcatctaccaaaagcatcctccttttgagattgtgaatttggattcgtctttctttaatcgaaacacgtttagattcatccaaccctatctgatcccactcaaaaaaattgctattgtgctatcttcaaacatgggttttgccacatatgccattctgcattttagcttcgttaaattgccactttcaaatagatgttacatgctatagtgtccttgccatatgaatggacggaaatgccccttgtcctctttttctctttcaaggcttggaccgttgtcatcgcgtgctgtggagagggacatagacatgtgcatgatgaactacttgcagctgtatctggaggagaagcccatcgaggcgattggagcgccagtgacgaggaaattgctcgaggaatgccactgca

SEQ ID NO: 40939 - DNA, 8256 bp, Oryza sativa
atctttgagagaaaagaaaaacacctaagggcattatcgtctgcgatgatattctagcgcaacacctaaggagtagtagatatcaattgacagtggcaatttagcaatttactcgatcgccaacttcatcatcgtcttccttggccgccgccacattctcttcttcactttaccaatttccttgggatcaatcaagggtcagtgagcagatagatgggcatggctcacgtcctcagcctcctcgtctcatcctcgtcgcaatcccctcttctcgctcgcacgccttgccgtcctcctcatcccccttcgacgccgcgctcgccacgctccagaaccagatcgcctaccgcttccatgccccggacctcctgcgccgcgccatgacgcacgcctcctactcccgcgagaacggacgcgcgctcgccgtcctcggcctcgccgcctcgcagtccgccgccgcgctccgcgccctcgcggccgaccacgacgcctccgcctccgccgtctcccgccgcgcccgcgacgcgtccggggaggccgcctgcgtcgcggccgcggcccgcgtcggcatcccctcgatcgtgcgcgtcgccgccgggaccaaaccgaccgccccacccgtcgtttgcggcgccctccgcgccctcatcggcgccgtcgccgtcgacgccaacagcacccacgccgccgaggaggtcttctggaagctgcacgtgctcaccgccgcatcagccaaagccgcaatgtgattcacaaatcagactgatcgttaatttaaattagtgctaatgctgctgcctgctgcaatatcatcacactagatcgttaaatgtactcctactacttagtactatcaactagtagtatgaactgtatcagttgcttctaatttccagtttgaactggagtatattagattatgtaagttggtattatgcatcctaatatccagtccacgaatgtgcatctgcttacatactcgagttattatctggaatatatgagatgaatcatggaacaagacttcatttttatcagcacctgtaagcgcttcagcatcggttttacagtggatgttccaagtttgcatttagcagcacttatacacaaaatggtacgtacctaacatcaaataatttgacaatttaactggaatgctgtagaaagctcatgtccaagcatattgatgctctcacaggggacaactggacaaggttggcacatatgcagcaaccaaagctaaaatgcaaatatttcaatcaaaagcagaatgaatgatatcagtgcacgatgttacagggaaaaaacaacattatgtcagtatacatgagcgcaaactttaatttaagtaatacagtactacgaatttgtatcagccttgcatttcaagatcactcttgcatggggtttaacaatgtcaggagctcattttgtccaaaatctgactcaacccccttgtacaaagacaggatgacaatcttcaagttaaggatggttacttctttgcttttttgctccgatgtgtattttcaggagtttgagcatccaacttgcgtttcttggctagttgctttgccttccttgctgcaacagcagggcgcttggctttttgagaactagcatcatgtcctgtctcactagtcctgccttgctgcttcccctggtaacttggacgctggctcaccttcgccttcttcaccacaccagatttgcttgccctaaggccttggtatgacaaagttgacgccttccgtttggtcttgtcactgccttcatgggatttgctgcttggtgttaaagctgtcttgtgtttcgatccaccctttgttttgccagcatccgtcgtcttctttggtgttgcatcagctgattttgcatgtgcaagcctcagaaggcgatctctaatcttgaaatcctgttttcttacgacagtgtttgcagcctcctgcatggcagatattaaaatggtcagcataaaagtgtatgattgagtcgtcaactggctatcttggttctgaatacataattcagcaaggaagtctttctgttatcgtcttcctccagtactagcatttaattgtatggcatggttaatgctaccatcttcaataaatgatgttcaaaatcacgtagtacatagtaaagccatttatcgacaaacatattatacatcaaatggacttctgggttttgacttatttagtgggtcacactgcaccagatgaaataggaaggtaaaagattgtacccttgtcttgaacaaaacataggcgataccctttcctagacttgtatctggatctcgaacaacacgtatagcttcaacatcaccttctgaaccactggaaccacagaacttttggtacacctcttcatcctgacatgccagtaaaaaaaataaatctgaccttttcttcaaaagaattacacagaccatatacaatactgaccacatgatactcacctttatatcaaacggaagattaccaacaaaaactgtccgctttctgtcataaagaggtccttcgcctttaagtttcttacgaggtggacatgccatatcgacacggacatgattgccatcaaactagaaagtatcaaaatcaagaaaaactatcttatcaggcacaacatagaagtttttgaattatataccagatatataaactaatcatgttttcagttctaagaaagccaactcaccagggccatattatgagataaagcagcacgtgcaccctgctcatctttgaacacaatataggcatgtacactgcaaagggtgaaaaggtacagacaaaatgagtctgagaaacattaggcaaacaatacatttgacatatgcagctgctcagcacaatcaattacattttacaatcaatatatagtccttgtgcattgatgggcgtctaataactgggatatatattgaatatcagagttgatggcatcagatcatgaaaaatacgaaatatcaacaaaatgctcttaaaggaactatacgaagcacgcgcctttttggtcttagtacaccattatatatttgggtaatcatgtcacttatctcctcctttgcttcaaacagcacagaaggtagaaaccaaaatgacaaagtaaagggctgtggtgattttagttgatcgaggaaagtattccatgcacgcagaaataattacataggcacatcagtaaaaaaacaaagcacgcgctattagaaacaaactgcagaatattgactcctaagctacaccaaagttgtttgttatatcactaaataaaagttgtgccacaatcaacactgttgagattcagaagtttcctatactacattcaactagcaatccaaataggacagataacttgtatatatcaagacagtagttaaaggaaaacactttaaggtgaaatgtggtaaaaaaagagagtgaaaaaacagggcatttaaccatgtataacaaatggtagagaacttaataaatgttcagggcatagaagcgaattgtaaagctataactaatggggaggagataggataggaaaagaaagaagtgtgagcaagcccatttcaatcggtgtttcaatgctaatgtcctaattgcaaccagctgtaatctgttcatatgtaatccatttgaaattgcaagcataaaggataggggaaaaaatgcatttcgtagctatctctgccatctatttaagcaatggcataaacaatcgtagttgatactagacaggcaagaatgcactcacttgtcgacagaatcattgatttttccttttatgacggctcctttccttggaatcttggtctgcagcaaagcacaaatcagcacagataagcatgaggaggacgaagatgaagacgaagcacagggcaatggtgctcacgtcggtgagtggcacggagcgtatcctgacggactcgatctcgccgaacgccgcaaactccttggtgagcgccttcctcttggtcttgagcggcaggttccccacgaagaccgtcctcagcagcttgctctcgtcgtcgaacgcctcctcctcctcttgccctgcccccgccgccgcagccacctcttcgggcaccttcctcttctccccgacgaccggaagaggaggcgcgggtgcgccgccgagcctccgccgctcgtggccggcctcgacctcgtcccgcttcctcttgcgccggggctcatccctgcgcgacttcgcggacggctcagcgacctcgggttcggggtgcttgcctcggggcgccgcggcggtgggcgccggtggagcgggctggtcgtcggagggcttgcggcggaaggggttgtctgcggagaagagggtgcggatggccgcggcgtcgtcggacgcgggctccttgttcttcttcgccattctcgccgccggtgcgaggcgacggcgagacggtttgcggcggcggcggtggggttgggattcggaggcggagggggaaactcttttgttgcggggtttcgcctagttggaactcgccccagaataggggacaggctggggcgatctcgaccgttggattcagatcgaacggctaggatttgtctgtatccttggcacgagccgcggtggcatggtagaacaaggggaggacaggaggaggagggggttttctagggtttctggagttcgacgaccgccgccgccgtcacgctggttcccatcgccgaaggagagaggatggaggagagccgcgcggacgggcggaacccgaaccagctccgccccttctcctgcacacgcaaccctctcgaccgcgcccatggctccgcgcggtgggctcagggggacaccatcgtgctcgccgccgtgtacgggccaaagccgggaaccaggaagggggagaatcccgagaaggcatccattgaggtcgtctggaagcccatgaccggccagattggtaactactctcctctccacgcttgctatcgctgctcgcccaattgaatcgctcaaatggtgtgctatttttattttttattttttatttgcagggaagcaagagaaggagtatgagatgacgctcaagaggacattgcagagcatttgcctgctcactgttcatccaaacaccaccacctctgtcattcttcaggtataagatctactcccttcccatgctgctatggctattgctttgcatttgttttgttctacctatacttattgacaaattgtgttagaatcattgctcttgtgttgtgccacgcaagttgactgtctgtactctcttgtccctgctttaaggacgctgattgctacaaaatcttcattgagtttgcttactgattcaagcttgctatattattgctgacttattgtcaaacttcattttcttagcgtgccatatcaagcgtactttaggtttagtgcatcatgccactgccttatatcgttttgcctttaatttagttatccttttgtttgcaggttgtgggcaatgatggttctgtatccttttgccgtaatgtactacttagtattgtttctgggtgccttttggattatgaacattgtacttgatataggaatgatttcagatttttggctactagctgcagtagattggcatttgaatttaatttcctgtatctctgtgaatctcataagctaactgctaatttcagctggttgtctacagttaggataagtggttcgttgttttattcctgaattctttgcctcgcaaaatgtttgttttggccggctaatataactgacttgtgatgagaaaatgccaagtattgatggaagtccctggttccatgctttttctgagtagtcttccaatcaacatactgtatacagcgtgctttatatgaatgggcatggcctgctatagcagatatcaacatgtagtatgttctttgtaatattcacagattcttagtatttcggtcttcaagatttcaatcaagcacaatccttgactaagtctagcttcttccatgtgcaattaatgcttgctgcgcagcccttgtttttgctggcatccccttgaaacatcttgcaggtaagttagtaatctttgtatgctcattgatgaaatatatctcataagcttttgtgatgcagttgcaattggttgtggagtactggaggatggtgaagtgattttggacacaaacaaagcagaagagcaggtagaaatttctcgttttgattaagtcctctgcactaggaaaggaaagaacgaatttttatctcgtttcttccctaaaaaacatcttagaactattggttcataattcgctctttaaacttgtggacaacaagtacatttttaatccctctactctgtggaaagttatcatattggtttctaggtgggtctagttgtcaggtatcatcttctgaaatgttatgttgattgtgtatagtcttaactgttgaaaatctaaataagttaatgctgagaacatctttaggagtgcatatgcattaatgttactgtttgctgtcatctgcagcaattgaaatcatttgctcatttggtgttccccaattcacgcaagtctgctagttcaaaagaaccaaaccagaaagaggaggattctgagagaggattgataacttccattacccatggagtgatgtccggtatggttatatcttgtgcctcagcttgatgtgttcttctggacattatagatatagggatgcatatattgtggctctaaacatgtcccctttctgtctcatgtaaagaggaagattatttcagctgcatagagaggggccttgctgcatcgtcacggatctcggattttatgaggacaacattgcagaagcaggcacctggagatgtctgagaggaggcaatcatgcgatagaaaacgcctcaacattgcagaagcacaaggttgtagcagctcatgttttgaatatgaaacgcgtggggactcttggtgcattattgatgtttgaaattggctcatagatgtgcatggatggtggagcgatccggcaggaaatatgtagcgccttgttcgcattttttgtgaatgttgagctgctttggtagtgactagtgagttcgtttgtagtactagtagcgagggaactgtcgtttgtttagatgagcaaggaagaaatgcctttttgtaactcaggaagaagtcaaagcagttgtgtaacaaaccactttgccatgttgctgcacatttttggtcgccctgtttatgatgaaggtgagcaatacatgagaggaagaattcatcgcttttagttgattcaaatcacagttttataatggaatatgtttaggattaggaaagaaaaagtgtgtgagaatatgattattattccacggtattccagtgctgaatcctagtactactacatctgtcctaaaatgttgctacacacatcctaggataacgaatctggatagacctcccatcctctgtccagattcgttgttttaagatgggtaggtagcaacattttgggacggaaggagtagctggtaggagcagtgatagtagtgatgagttggaaggtgcatggttgatgagagagagacgggtagagaggcaaaggacgaaagcagaagagtgaagtttggtagcgggtcttggaatcgcaccgactgggatctatgatgaggcggcacggcaggtcatccatccattcatccaggttagttgttgatgcctcgtccaaggcagctagcaggagtacgacattatcatgaatgaatacctaaaaatagcgtgaggctgtgtgttgcacagtgcatatgtgctggctggcttgtttttactgtgcttcatttttagcgaggggcggtgaatggaggcaaataataattaaggtggtggtggtcaaaaaaagtaaagggggaaacgctcgcgaggagggtcagggagggagactaggagtcagcctggcgttgctagtgttgaaggccagccagggaagaagaaaccattgataatttgacattcacaaagaagggaaggaaggaaggttccttcggcttggttgcctttgcctgacggtgaattgggttgggttgcgtcgcgttgcgcgcacggtcgtcggctcgcgctccgcctaattggttgacgttgctctcctcgctggtggtattgtatatagcgagccctacctactccacaaaaagagtcctctcctctcctctcctctcccttgccaccaccaaactgccattaattgtttgtttcgcaaaacaagcatcctcgcctcggcgtcccagatctctgctgctgg

SEQ ID NO: 40940 - DNA, 11174 bp, Oryza sativa
ctcgactgctccgccgtccaccgcagcctcggcgtccacatcaccttcgtcaggtttctttctacccccccttcccatcccgatccacgccccctcccctcacaagatctgcaatccgcccacgccatcacatccgattcctttcctcatctttccatcaccaaccaactctaagcccatcacgactcctaggaactagcgcagaccagctcaacgatctcaataatacttccctttttcttctttaccccccaaaaaagggatatggtacagcgcataggtgcctgtggttgctgggtttggtggatctggccgagcctttcatcaaaaagaaaaaaaaaaggtcctatttttggtacagcccatctggtggggaatgcagccggagatctaggttcttgggccatcaacgtcaatacctgctttacaccttcatcccatcggcatttgcattcacaagttacacattttggtctaacagatccatatgcgcattcacagtaaatcacctactacttcgttatatttttctgcaatgaacatattgaacttcattgctggctgctatatctatgatcactactatggctatgctacattgctacccatctcatgatgctgcacgtttgtcttattgtgttgtttctaccacacaaaaaaaaaaatcataaaatgccttgctttgatactccgcaaaagtactagtattgtgcctgccaaatgtcaaaactgtacccattttattttcactttctcttatacaatccgtatgtattttctataggtcaacaaacctagattcatggactccagatcaactgaagatgatggcttttggaggcaacaatcgtgcccatgctttctttaaacagcacgggtggacagatggtggcaaggtcgacgcaaagtacacgtcaagggctgctgagctgtacaggcagatactgcaaaaggaagttgccaagagttctgctgataacgtcttgccatcgtcgccagttgcagcgtctcaaccacaaaatccatccgatgacttccctgagttcaagctaccagaggcaccagcagagaataccaatgggaagcaggaacctgatgtcaccaattcgcaaaaagcacctacgcagacaccaaaagcccctactcatcccacttttgccacttctgtaaagaagtccattggtgcgaagaagattggaggcaagactggagggcttggtgttaaaaagctcaccacaaaggtaacactgtggatcattagcgctatgtatgcatgtgtttggttccttcccacagttaatatttaatatacctcctctcttctatctatatgatgtgaacattaaggactgacctttgcctttatgttgcagccaagtgaaagcctgtatgatcagaaacctgaagagccaaaacctgctgccccagtaatgactacttccaccacaaaaagtggcccgtccttgcattcacgttttgaatatgtggagaatgagccagcagttgattcaagaaatggaggaactcaaatgactggccacgtagcaccaccaaaatcatcaaacttctttcaagagtacggaatggataatgggttccaaaagaaaacaagcacagctgccacaaagacccaggtaaatattgaaccaatgtttgtgctatgtcaataagtaaataataaatagattgacttttctgatcaatacataagtttgcaaagtttactttctatgataatgtaaacactgcactagattttgctgcatccactagcttgacttgttttgatttcatgatgtcatttccccttcctttatttgctgcatgcttgcattctgctgtttaatcatcagtgaacatctacaaatttcacagaataattaccttttgaactttggaaaagtcagttctctctatgcaagctgttgttattgctagcatgttcttattatatcaaatagttttccgcttgtagatttttgttatgttaataagtactgacactggacgtgaatacctttcagattcaggagactgacgaagcaaggaaaaaattctctaatgcaaaggcaatttcatcatctcagttttttggcaatcaaagcagagaagagaaagacgctcaaatgtcccttcaaaagtttgcggtgcgtattagtttagcatctctttgtccgaggaccattacattgcatctccttcgaacttgtcgaagcattcttaacttcattccagacttgaaatttcttgtctattgtttatgtttgtgctagtacttcatttgaatattctgtagaagtttgcatcttttttttcccttacggttctccttttttttccccctttaattcagggttcttcgtccatttcaagtgctgatctttttggccgccgcgacatggatgactcgaatctggatttaagtgctgcggatctcatcaacagaatatcattccaggtagttattctgtaaataattgccagccttttgtcacctcttgcatatttagtttttaagcaaccgagcatgcaaatcattactacactgagttactactgaattattcagtacaaagattgatccttgaaacgcacaaatatcttacctgctgggattgttgtgcaggcatctcaagatctgtcttccctcaagaatatggctggagaaactggaaagaagctgacatctatagcctccaattttatcagcgacctcgacagaatcctttgagtggttgatggggcgagatcattagcattttttgttttggcaaacctgcacagaataccgtattgagtttaaaatgtggtgcagctcagagaagcatttgttgcacagctatgtagatgaaagtagaggattggcaattatgcgtctgtattcttttttccttttttactattgttggaaccctgtccgcatgaagatatttttattcgtttcttgacaagattgaaacatacgatggtattcattccagttagtggtatagctgggaagaaaaggtatactttgatgtgcctgtgctaaatggaaccagtcatgttatttcttatttctcacagtgatctgtgccactgccagttagagttcatcttcctattataagcagataagctattgcaaactggctggttgttccttttactgacgtctctgtcgatagcttaaatgttacaggtttattataatgcaatcttgcagggtggaaaaaaactgttaatttgtgaaggcaagattcagctaaccgtgtatggaaactgaccaaatactggcagtcgagtatgatagattcagcttatcgtgggaaaaatggtactttgcgaacagccgtctgtcgacatcatattatatattgcaatggcttgttttgctgtgattttgagccaccaatgataaacacaatgcaagttgctgtcttgccgggtgtatcgttgtagcagagccgttcaaagtgacgtggactccaggcggtgccacgcaagactgttattttgtctcctctcttttctccactttttcgtcgtcaaaaatgctggaacgtcaaggcccgcccgttgtgcaaatggttgacagtgacactgacagtaacagattcttgatgtaatcgcattagaagaatcttgcacaaagcaaattctctttgttcttgtgttgtgtttgtggcttgttattctaagcgagtgacgggagcatctgtgctgcctttgccaatttgcaatccacgcaaggctcgtctttagattcattcgttcattttatttccgagtcaactaagatatcgtgtattgtctgaacgattcaaggcagctgtaattaattaagatgacagaaaattcagagcagagcaggttatcttgaacacatcaattattgtgaccagaaaattatggttttgaatttgcgtcccctacaaccaaattcaggatggttgtgttatctttgggttgaagaagagtttttgtcctcaacattttccagctaggagccggcataccacagtaaaagttgaagccttgatcgagataactgatgaacaggcggccggcaaatttcacagccaatgatcagtgagtctaatggaaaatcattctattttattacaggaagatggctgattttacccccacacaaacggatgtgatactacagatcacgcgatcagcgatagcctgatatggcgatctggtaggttaggtagcacgcgtgatcatccattcatcacaagagattgtcacatggcccatgcacgctatcgcacaaataggaggagtgattgcaaagagaagaaaaatagattaagaaaagaaaagagattaattgatgggttctacgatgactgcgatgagacgaacacccgaatctgctccaggaaggtgagctgctgcggccgatccttgcggcggatgtagccgtcggcgacggccggcgagtactccgggtaccccttcttgccgctgcgcgcccacaggtcgtcggcgtagccgcggtgcgcgtagtaggcgacggcgtcgacctgggcgccctcggcgaggaggacggagatggggaggcgctcgtagtgcgcgcgggagacgccctccagctcgtcgaggcggtcgagcccgcgcggcgtgacggcgtagagctcgccggagacgcggtgtccggcgccggggaggttgaggaggaaggggacgcggtagggcccgcagacgagcgggaggcgcggcgcggtggtggcggcgcccacgaaggaggcgtcgccgtcccgggccaggtcctggaggaggccgtggttggagaagcccctcttcagcgtgccgtacgtgaacaccagcgtccgtggagccgccgccctcttcgcctccggcgccgccggtggctgctccgccgcgtcgcccgccgccgtgcccatgcgcgattcaatcgcggcgagctcgagtcgagcttttctttctttggttggttggttggtgttttgaggcttgggtcggcttatttatcgagagaggtgggcccgcttcgtcgatgtcgcgtgggcccagcctctcacatttgtcgcattagccttccagcccattaacaatatgggctgcacggagctcgactcaccttgcggcccaacaaacagggccttgatgcatgggcctcgttctacttccattggagaaggcaagcctctcctccctctccgaaccagccgccgccgccgccgccgccgactgctcggcgatcatggtcggcgaccgaaagcgcccggctcccttcgccggattctccccgttcgctcgctccctcctcttctccgcctcctcctctaaaccactacctccccccgaggatccacccgccgccgccgccgacgaaatcccttcaggtacgcgtgcttacacttaattggcaacgccgtcgccggggcctcgctacctccttctcacgcctcgccgctctccaggaatcgccggctccagtcgcgatatgccgccgcccaagcgcgccaagcgggccgagccttccagcgacgaggagcgctacagcagtgacgacgagagctacagcagcgactccgacgacagcgacgacgcgtcggaggaggtgagtgcctacctctaccttggttctagcctctctggagttcctactcatcgattgatgcgagttgctcttcggattggtgctcctagctcgatacggtgcaagcggacttcgccttctacgaccccaagcccggcgacttccatggcgtcaagctgctgctcaagacctacctcgactccaagccgtgggatctcactggcttcgtcgacctcatccttgagcagaccacggtgggtacggttgtcaagattgctgacgatgaagaggatggtgaaggaaatggtgctgatggaagcagcactggtggcaatgacgatctgtttggtctcattagcgtgcttaatcttggaagatacagtgtatgttcaacctactcactgcttcatccacaagatacataggtcttgctgcactggtggcttctgattaatcaacttgctggtgttgtcttgtaggagcaccgctgtatgaaggatcttaaggattacctgcttgctgtttgtggtgacaaggataccaagaagaagctcaagcaaatgctgggggacaaagcacctgatgtgggtctgcttgtgtgccgccgttttgtgaatttcccatatgaacttgtgcccaagatgtatgaatcgttatttgacgaagtttcatgggccacagaagacgaggtttgtcaagcaccttcttttatgaacgtcgagctcagatagtgtgaaacacattcttttctctactttcttataacgtgttttcaactgtcctcgcatatctgaagccaacacaagaactccgggactccttccggttcaagcagtacctaatggttgtcagagtacttgaggtgagcaatgcaatttgtttccatgtttgttttgcccattgatattcaaagcgacttgttttgttgctcagtatttccgtgtaagatgttgtatagatcatttttcaagtgtaattgtgctctgtatatgaaagttcctgtcttgttgtaactgcttcagctgtatgaataacacgtctttgccatctggtgtagaggaaaactccagcaaagcaaaaggcaaagaacagtacagaagaggatgagcctattatctatcctaagttagaagacgaaatttttcgcgaggtatcaagcaggacatgctactgacaatctgagattaatttttctttgtgcagttctgtttgatgtggtaacaaaactttcttcctcagctttcttcatggtcgttcactttcccaatacgttctgaacaatcggctcagcaagaggttagttgtgtataagtacttcaggctttattatgctgttcttttattcatattttcatagttactttcagcatctggaactggttcacttgtggcactggcactacaaatttcctttggtacctggattgatattgttatcttttggacatctgtttgactattcgttttaataaatatgtaagtatcatttattttgttttataattaaaaatactttaagcacgagtttttacatatttgcataatttttttgataaaacaaatagtcaaacatatgtccaaaaaatcaacaaacgctgtatatttaggaacagaggtagtagtagccaaatgaccaaatcccaatcatgtgaagtaggaacattcgttcctttgtgttatgctttcgttatatctttcttcttctgatgatcattagctcaccatttcaagcagaatctgaacatgcatcattctaagtttgatgttgtgtacacctaaattgaatggactccctgtctaccctttcagatgaagaattacaaggagatgggcttagtgatggccgtcaaagctgaagcaattccgaagttccgaaagaagttggaggatctactatctgaatagttctctccacgcattgtaggtcgtgtggaattttgctgctgtccacatgatattggaacctccatatcttctcttgctattgcttgttagtgtccctagtaagcgcggacgctaagtttgtgagtgcaaagccctaattgaattgctagcattgccatagtagaagagaaattcatgtgtaagaggaaatcaattatgaacttcccttatactgatatcaagagattttgaaggacttttttggttgctcgaagacatggtctttctcagcccatacgcaccacattttagctgggagtttgtttgatcgatatacatcacactgtggtcaaagtcaactgtctatgattgtttttgccatgaggtagaaacgtgtgacgaaactgtgccctgtgcataacaaccgcatctcttctgaaggcataggcatctgcgtccttaaggtcagaggacattagtcatgccttgcaaagtctctgaaaacatggatagctgaacaaaaacaaccagcgaccaatcgctcggtgttccagatgaaatttgaacaatggttgcaaatatatcatatctctaagccaaaacaagagcatcacgtaattaaactgccaagcacacacgggcgtgtagcattgcaacatcataaacaacagaatgttgggaggtgtcctaagcaaaagtcaccgctacttattaagaacagtcagcacgccatctcagtgtcttaactaaaatcgtagtatgacaccagcatttactgatttccacatggatttaaaggaacgctaataacatagtatactacttcttctggaagtattagcagggaggtatcacaataaaaatgtaaactgccaacaaatgatcatgaacgcgagtgcagccatgaggtcattgggcaaccttcaatcacaagttcttgaatgcagactcattagggtgcttgggagtaagcctcgccaacaaagccttgttcgggaagtgctcggcatcaacaaaatagaagttcccttcagccctaaaagtgacaaaaggtctgttggtctctggaggcctgacatcagcaaacttgattgtccttgtgaggggtgtagccagccatgacataatctctgcttcaaagctatctgaacctggtcgccacctgagcttgtgaatgtacgggctcacaaaccagtgtaaggctgccgttgtggtagcactgaggaaaatgacagtggatgcaacagcgcccttgaggattacattcatatctggggatgtcatgaatgttatcacagggccaagcgacacagagagacagcaggtggacagagaaagaagcttcacttttcttatggtcgatgatataggtccctggtaaactagcctgtcatctttgtcatcttccttgatctgcttggattttggcccaatgcttatcttgctgccactattttcagtttctttaacagcagcagcttgagaagcccatcttgcctgactgtacaaacaagtgactgaaccaaggccatcaagttttggaagaggattaggcttgaatgttgagaaatgcttccatgcaatacatccaggagcctgaagatctgataatgtaaaggacagttagctgactttaatcggatttttgacacctataaaaaaaataagaatgcaaatctatatacttcggctatccaagataatggttcagaaaccattaagttagcaaaggagcatgttgctttcagaaaggaagatcattacgctattaagcattttgaggtaacatacagtggtaaattggacttcaaccatgcgccctgttgaattactataacacatcttcctaacaaatgcacctcaatacagtacaattagacacatgtaactggcaaaactaaatcatgtgaaaccgaaagaggtattgggggctcacgagagtaatatgtagagaatagcagataataaatcatgaaattcaaggtagaagcttgaatccacagattatgttggattgtgggtggagttagaaaaaatcatccctgaaatagatgtggaggactgtcatttaaactaccttttcattgacacatgcactctcaccgaagtctaaccaccaactacaatctaacttggaaattccgagattactcacaacatagaagaacatatagctagtcagtcagataacattagcactacatagagggcacagcacctccaggagcccaggacctaatcaaactagaaccgaacttgtgcaccatggaatcgtatgcccgttctcacaacaatttcgcagctcatagctgggcactaccacgcggatcagatttaactatggagagaaccacggggggagagattcgaagcatgaggcgaacctgagacgcgggagaaaacttgcggcggcgaggtggttcccacggagcagtggcggaggaggaccccgcggagggaggaggcggatcggagcctcgccgtcgccatggtctccttccgatcgaggcggggatttgctagggtttttccgaagggatggaggagaggccaagaggagacgaagcggagcgggcctaaacttacaccacatgggccgatatgggccaggccttagctgggaggcggtttcttattggatccggatccagaaacctcttcgccttcctcccatctttctctctctttgcacgcggatctccacactccgcaccgccggaaccctagccgccgcccgtcgccgccggtgagattcccttcttctcttacctgattattacctcactactcgaacccaaggttttttctaggcacaaaccctaatagagttccccaaactaggcagattttttttacccctggtcgccgctccgtcgtggcgagcgggcgggatgagcagccaccggaagaacttccgccgccgcacggacgacgccgaggacgcctacggggacgactcgagcaactccaagcccacagccaccaagacccaaacccctcccgttcccaagcccaggtcgccgagacgtcagggcgcgagccgcctcagcttcgtcgaggacgaggacgacgatgacgccgaggagggacctttgtcgcagcgccgccgcccggctgctacggtccggcaggcccgcacggcatcgccagctgcggcgactctccaccgcctcacgcccgccagggaccgcctcaagagctctacggccgtggcagcggcggttcccgcgccgaagccgtccaacttccagtcgcatgctggagagtacacgccggagcgcctccgtgagctccagaagaacgcccgcccactccctgggagcctcatgcgtgcaccgccgccccctccccctccaaccgctgaagccccacgacagcgtttgcctggagctgccgccagtcctgctcctgctacaaacaccactgctgctgctgtagagcccgtggtgattctcaaaggtctggtaaaacctatgtcacaagctagcattggaccaaggaatccatcgcagaacgaggacaaagacgaagatgagtcagaggaagaggaggaggaggaagaaggaccagtcatacctgaccgcgcaacaattgaagctatccgagcaaagcggcagcagcttcaacagccgaggcatgcagcaccggattacatctcccttgatggaggtggtgtgcttagcagtcgtgaagctgctggggatccagcgacgaggatgatgatgagacacgc

SEQ ID NO: 40941 - DNA, 4576 bp, Oryza sativa
gttgaggatgaaaaggatgacgatgaggatgaggaagagaggaaatgggaggaggatcacttcaggaaggggcttggtaggagggtggatgatgcttctgctcagagagcagcgaatggtggaccagctcctgtgcaggtccagccgcaaccatccggatactcaatcgatccccgttaccagccttcctttagcggggttttgcctgggacttctatttttgcatctgggagtgcagagttcctgtcaatcgctcaacaagctgatgtagcaagcaaagccctgcaggagaacatcaggaagcttaaggagacccataagacaacagtggatgctttagtcaagactgacacacatcttactgaagctctttcagagatatctagccttgagagtggtttacaagatgcagaaaggaagtttgtgtacatgcaggagctccgaaattacatttctgtcatgtgtgatttcttgaatgataaggcattctatatagaggaattggaggagcacatgcagaagctgcatgagaatcgagtgactgctgtctcagagaggagggcagctgatctagctgatgaatcaagtgttatcgaagctgccgtcaatgcagcagtatctgtccttagcaaaggatcaagctcagcttatctatctgctgcatctaatgctgcacaagcggcggcagctgctgctagggaaagttcaaacctaccacctgagctggatgaattcggcagagatatcaatatgcagaagcgaatggatcttaagcgtagggaagaagacaggaggcgaagaaaaattcgatcagaatctaaaaggttgtcatctgaagggaggagtgcaaataatgaacatatcgaaggggaactaagcactgatgagagtgatagtgagagcagtgcctatctgtccagccgtgatgagttgctcaagactgctgatcttgtattcagtgatgctgccgaggaatactcaagccttagaattgttaaggacaagtttgaaggatggaaaactcagtatcctctggcttaccgagatgctcatgtagctctgagtgcgccatctgtgttcaccccttatgtcagactggagcttttgaagtgggatcctctccatgaaacaactgatttctttggcatggagtggcacaagattctttttgattatggtgagcaaaacagtgaaagtggcactgaccctaacaatgtggacaaggacctcattccagtattagtagagaaggtggctcttcctattttgcaccaccgtattatgcactgttgggatattttaagcacccaaagaaccaaaaacgctgtggatgcaattaatatggtcattagctatttaccaacctcaagcaaggcattgcatcaactattggccgctgtcaatagtcgtctgactgaggccattgctgacatttcagtgccagcttggggatcaatggtgacaaggactgttccaggtgcttcgcagtatgctgctcatagatttggagttgcgatacgtcttcttaaaaatgtgtgtttgtggaaggatatttttgcaaaacctgttttagagaagcttgctctggaagaattgttgaaggggaaaattcttcctcatatgaagagtatcattttggatgcccatgatgcaattgctagggctgagcggatatctgcattacttaaaggagtgtggtcttcaccaagccaaaagttgcagcctttcatagatctcgtggtagaactaggaaacaagttggagaggcgacacatgtcaggcataagtgaggaagagacacgtgggctggctcgtcgtttgaaagacatattggtagaactgaatgaatatgataaagctagagctattttgaagacttttcagatcagagaagccctttagctcttattcggcataccacaagaattccagttttgactgtgatacaggttcttaatccttctgctttaggaaatgttgtaacttcatcaggttttctgtacattaaatgatcatgagttcctcgttcaatcctgcatgatgttatccatacaaattttatgggggcttctcaattcagaaattatggtcatttttaattaccatttaccaatgctaattaactgtctgcaaatatatatctttctagcacttttctgtgttatagacatattgtatgacagtttgagcgtgtctgtatggttaattttactatattttgaggccttgagcagaatgtctttgctgtttgcatcagcaaaccattttttacatttagctaactgacaatgtattttttgaaagatgcaaggtgtctaaatattgcatgaacgcttctatttaagattatgtttgatatctataacttacactaccagttaagcttctcagctttgtttgtattcgtgtctactctgttttcttcatgtgcgctttccctattcttccttccattattcttcacgaagggtgacaacataattgaataactgggattattgtatttttttaagtgataccagtacatccaggtctatggaattatacaaaatataatattgtctttctgtcattctgtcctggatttatgtccaatggaaattgtaaacatcttaggcctttcttacgtatgtcttgtggaccattcttccaatgcaaaatgtttctgtttgaccgacctgaaacttttcatgccagtttccatcaatcaatcccataatccagcacttttttgctagttgtttctattattcatgatgttaggcttttatagctgatgcacacattgactgtcctagcgtactgtatattacctggagcagggaagaaagtgaatagcttagttctaaatagtgatgaaaaagtaaattaccaagaaaacaatgcaaatctgcagcctctgtgtataaaaagaaaaactctgaatctgagcatctgttctgtgttgcaccaagattctacagctacattatgtcctcttctctgtttagattagtgttcattgttaattatcttttttgttcctaagaaacactttgtcacaaacagtattgataggaagcaagtttttttttgtcaaccattaatatgctaaacgaatgcccttagaatatacatattgtctcagagattatctgtcgcctgctgaggatttcgaaacatgttgaatatcaatacataatgtttcagttttagccgagagtttgtgctccaaatatatgactgccaatattttgtgccccataagcgaactccaaaaccattgagattcctgaaggcaatgaataaggatatgtgttttgtggtttggaaggtactgttggcatttcaaataaatagggagtttttttttttagtacaacctgcaagcatgtctgatgtttgttttgcacggatgactgccttacctcaactattatactgtaaataatgtttgcagttggatcaggtaacatgtagttggagccagtcacatttggtgcagattccattctgtgtattcagatgctgctgtttatatcacataatatatgacttgccacaaccctacgctgggaattatgtagaatccttgttggtgttggttcagtctcagattcaccaagcactgatgcagaaacatgattcctgcaaacccttgctgcgtatgaagtccaggtgctcttgaattgtgtgattctgagaggaacttccagtaatgtgggttcttgttttttctttctgaaggcttcaacattattccactagatcttcatgttggttcccgatctgtatctgcaaaatacttacctactactagttggcttggatggtgctcatgtagtgataaatgaggtactgtgatcttgctacattgaacatggcactgtaggtgataaatgacccttgctgacttcactgacatatgagaccagcaggatcttccaatcaaaggtacaatgcctcgtgcatgaatgatagcaactatgaaaacttgtgaatgcaaagtgattttgatacagctgccattgtgcatgttattagcatatgtctggattttctgcatcttataatgttgaatagggtcattcatgtccctgatcaattcagattttgcacattatagctcttccttttcgtttgtgcatcatgtaaggctggtgtgtgtgtgctagctgtgggctggtcatggtggcgatgcaggggggccagccgcagccagtggagggtacagactacagactacagagcgggcaggcagcgtaatatgcaaaggacaaagcgtcatcaagagccgttggctgtgtttgtctatctgtagtagcacaggcagcaacagtaatttggtttcagcttagcacgactgcacgagtctactcatctgctctttctttgtttggtgatctgatctgttgtttagcttaggggtgtttagacgggactaaaaactttttagcccatgtcacatcggatgtttggaccctaatttagagtattaaacatagattaataaaaaaactaatttcataaataagagctaatccgcgagaagatttttttaagtctaattaattcatattatcaaaagtttagtgta

SEQ ID NO: 40942 - DNA, 5628 bp, Oryza sativa
tgtgacaggtacttgaataagtaactggaaactaaacagcccccttagcttcgcagatggtggagacaatgacagcaaagaaggagggggcagccttaccttaattaattcagcgagatttgacagcgatggtcacgggaagtaacgcccggggcccacatgtcattgtccgcatcgcacggtaaccaccttttcatttggctgattgattggcatttcgctttgttgtgtcagatgagatgagataagcagggaaaagtagttgcctcatcggaccacacagccccgccccgcgtaatgcatgtacgcatgcatcgtcgctcgccggccacactctactactctaccacagctcaaactactacccttattaatcaccctctattatagtaactgttttgacactttgttgtgagttttttcttacccagtgataacaatatttttacccccaagatcgaaacgccagtgggctccttcgagagaccatattggcaaaagttgaggttgacgaattagaagcttggacggggcgtgtattgagattaacgtaaccactatatatagcctataggcaaatcatcttgttatcgacgggtatcaaatacatgtacctttaaaagaactactccctccgtttcaaaatgtttgacaccattaactttttatacgtgtttgaccattcgtcttattaaaaaaaattaagtaattgtttattcttttcatatcatttgattcactgttaaatatactttcatatacacatatagttttacatattttattttttttaataagacgaacggtcaaacatgtgctaaaaagtcaacggtgtcaaacattttgaaacggagggagtattaaattttaaaagaattattaaatgtaaatacgagtaatcttcacttttaactctaatgtggtgggtagatttcaatacaagaaccttaccggttgaattagacttcaccaatagattacaatctcggtagatgtcaccacttacattgctccttaataacgaatgtagctacccctttgaatcgtagtaacaaaaaaaaacagaagaatagaaaaaacatataattctaacaggaatgtaagtgtaaaatagcgaattgctaagtacaggaaaaacacaacaatgatcgtttgattggatcacaggaaaaatacaataatcggatgagagagatagactcaaaggattttttttgctaagtttcctccaaaacctatcctatgcaataagccatcccataagaattttgtaggatttgaaaaaacttcaatcctttaaaccaagggctaaatagaaaaatttttgatagatttcaatcctataaaattccttcatagttcctttaattcaaagagatcctatactttcttcattctagaatatgagaatcttctatgaaatctagaagtaatcactttatctcaaaatacaccatataaggtctggtttagttggggaaaatttttggatttgatcgtcacatcagatatatagacacacatttgaagtattaaacgtagactaataataaaacaaattacagatttcgccagaaaattgtgagacgagtttattaagcctaattaatctatcattagcaagtgtttatggtagcaccatattgttaaatcatgacataattagacttaaaaagattcatctcgcaatttacacgttaactgtgtaattgtaaagaaggcctaagatcttattgggagaaaagtgattattactactactccttataatcacgacagataatcttgttcccaagccgacccatttaaagccgtgcacatggcccgaggttctccactcttctcagcccgcacgcacccaccactctctctctttctctagctagctcctcctcctcctcctagtagtcgagcacacactactacactacactagtaggagtagaacctagagaaaatggcggcggctgctccgccaccgccgacgccaccgccagcgtccagccccgcgccaccgcaggaccccgctaccggcggcgacgccctcgcctcctatctcggcctcagcttcgccttcttcctcgcctccctcccgggcggcacccccgccgcgcgccacctcgcctcgctccagtcccgcggccgcgtcctcgccacgcgcctcctcgccgccgaggaccagctccgccagctgcgcgcgcgccgccgcgacgacgcccgcgccaatgcccgcgccgccgagatcttcgccggccaccgcgcctcctggatggacaacgagcgccgcctcctcgcccgcgccaccgccgccaccgacgaggccgcctccctccgcgcgcgcctcgccgaggccgaggccgacgccgccgcgctgcgcgcccgcgtcgaccgcctcgagcgcgaggccgccgagcgcgacgatctcatcaacgcgctcctcgcggccacgcgcgccgccgatgccgacctacgctccaccgacgacgacccggagccgcgggacgcggagcagcaccaccaccaccagccggcggctgcggcgttggatttggatccggccgaaccgcgcggcgctgacgccgacgcggaagccctggctgcagccgcggctctctacgctcagcagcgccagcagcaggagggtttcggcagcgacgacttctacacggcggcggcggcggcggcggcctcgggaatgcagcagccatggatggagcgatcaaaagggtggcaggtgagacgacaaaaagctggaatccatcccctttctctcccattgaccccttccttgtttcttctcttctctactaacacgttgccttcccttactactactcctacactaccacttacttccaatgatcttactccatcgagcacttatattctactatcttcccaggaagtagtaaatctattggtggattgcttaatgcttatccttttaatggctgctactgctaatggatgattagctagggcgcatactacatttgggaaattttaatgttactgttagacttaaaatttttgtatgacttaaaattttcacggcacaagtttttggtgtgtctgtttttgccagaaaacagataacagtgcctatcaaattgattgcaagaaaagttcgcattcaactgcatacttaatcacacataactttgtacttgtctcagaaatgtccaaaccgcctcgatttactacattttcttgttccccttgtccaaaccgcctctgttagtttgggtttagtagcagtaggcttatgccctttatccattatctgtgaactgtaataaacaatcaaattttgatgtagttaatgctaagtcttaggtgtaacatcctgtaattgctctccgtgcacgatttcccagttgtgatagtgataccaccatgaaccttcatacaccatgtcatattgcagaacatagaacagacaaacgaccactttgatagctttctgcatccactggaatcctgatacaaaacctgtggggtaaaccatgcaagaaagctacctgtaccgtatctggctcatttggaacctgtgatgcgatcacaggattcctgttgttgctcatgctaacagtgccatagaagactagtactgcactgcaccgaaataatcagatagccttaagttactctgtaaaaaaccatcatcattttattattctaaacatctcgccttgttataatgtcatgtagtctcgtagccctgatggattgtgcttatttttcatgatgcatcatttgatatttattatagagcacacatttttctcgaactcacaggagagatgcacataattacactaagaagattttatagatcacacttgataatcagcaaagcttttgtgctttataactgaacaaatatgtacctctcgttagcataattgagtggttcacataaatccatctcacactagtaaaactaatccctaacctaacataccgcacatgcccactcagtttcttttgttcatattcgttaccacattgagtacacatttttcttttttgattcatatgattgcaacctgtattttctctcctttctttgattttctgtcttcagatctgtgttgcaggataatcaaagttaaagatgatagtttattgttaacctttatggcctgaaaaagcacaagaatttaaagaaaaaaaatcaagttttgcattaagtaggaatcagtttgaaggtcaggaaggttgatttcatgggttctatatgtacttcattctgtgtattctaaaatggaaacagttttaattaaaccattagaaactgttcggtttcaactaacaccattgtttagttgctcttttctaaaatgtataaatagcaaattcttggaagggtagggccctgttgggagcatcgcttattacttacagtgaagggaagcttagctgggtgggttagtggaagctacagccttgttcattagcccatggccatatgctcatcttctagtgagtagcaatataggattgatatgtgggagtccataataggtgatgttggtgctgattactgctcctgggtgtctggttactggcatctggcagcattgttatacgcagtaatttaagatctattagggttgctggagcctgcacgtccaacaagactgctgcatacaaacactcagacatgacgctcatatgttaattgtaatgatactatgaagtgcagttttcatgccttggtcgacttgaaacagctgtctttttggctcagtacagtgatacttaaaagacacattttgatttaagcaagaatctatgcttttgttattggcacttaagcgaccactaatttgcatatatgtattttttttctagatacacagtgttacataaattgaaatgttgtaatggtgttgccacttaatgcaatgattgatttgcattaatatatatttttttcaataccagtggtacgtaaatggtatatataatcttattatcattgttctacgtaattatgttcatgttatatatggacacaaatcctaggtatcaatgtttgattgttggtgtcagtctgagcattgttagactagtaccctttttaaatttttatgtttgtggttcaatttttaatgttcatcttgtaggacctgaagtatgaaacggctgagccgatgtataacacaaaacatgctgtaccacggtaggttggcacttttcaattgaggcacatggtttcctgaacttgcaaatgaataaacgctagttaatgtttactctctaaacatcttccattaacaggagagaatcaccttggaaggtggatgtggaatcgtcaggagttcctgcaaagcttcaactgcttgagcaggaattaattaacctggaaaagattggaaatggagacttatccaagataccattggtgatgagaaagcaagtgaaaagataccaaactcttgctgggaagattgatgatctttgcaaaagaatggtaagcatcatcttttgatactgtatctagtcttttacttggatttgctgatactactgcataacttattcatagtgtataactgaagatgtgatgaatacattaatgtagcatatggctgttatgctaataaatacatgcttgggaag

SEQ ID NO: 40943 - DNA, 11601 bp, Oryza sativa
ggaagcattccaccttcagcaccgagcaactgaaactaggcagaagctcagtgcatgcaagcagagactgcaaaaggaagttttggtgatgaactgacagcagaagccaaaatgagcacaagaagagcactgagttcaattcggaacaacttcaaggaaattcagcgtagcctagagatttggttggcaagaattctgggagaccttgagggcatgttagcaagggacggggcatcacgcataagggagtactttttgtctccctacgcatcagctgttcgatgataatcttagagcactctggtcggcacattaattcatcttcatcaggtaaagtatggatgaagttcagcatgtgaaatcgcagatacccttgggtcttaataggtattcttgcaaacattggaaggtatgaagagaagtgatcttagaccatactgatattttcactgatttcttttgaaccaaaggagaaacaaaagattggtttaggatgtctattttaacttcctatccagagtttttctcctctccttgccggttacatgttttgacacaaattggtcgtgtcctagatcacttttcttcacatttatccaaattgctgttgaggattccactggacaagggtgtgcgcgaacttgcatgaagtggagcattcacagtgtgtactacagatgccctacattagtttgcacatagacatcgatcagttggcggtgtcaatgtgcattaccgcagttcatttggttagtaattgtacaggtttatgcttatgcctctgataaatgctctagtctgtattaatcttgctagcttacatttaccgatttatgtacattgtaatttttttgatcgttgggccaacatgcggtgtaaatgctggatcactttggctgttgtatgaaactatcatgtgtgattcgtagcttcactatatctatattgcatttacaggtggtaaattaagaaaggaaaatgcacacatttttttctgctgtgaaataagttgctaggcatactcaagagaaattggattgaacaaagctgaaggatgttgatgtgtggaacttatggtacaccagtcacagattacctggggcaggtactaatgccctaaacttttccctttcttttcccctcacctcccacctcctatcttaatctttcccagctccaacttggaacacaaactctatttacttgtaaaataaactttatgtagtttaattcctccttgcaaaatggaagcatccaacttgtagcttagctagtagtaattcccagatttaccaataatgcaaagtgatcatctagaggtactgcgcctgtatcctctccttgttctcctcccaccatagcttagcattcagctctgcaaacctctcccggctgcaagaacaaaatcatcagcaatactcaaaaacgcatttaatcaatcatctatagtaattagcagatcatctgatcattcaggaagtaattaatagatactacatcagggataggtagctagagtagtagaaaaatgaaggttgtgacctgaaacggacgcggcggagctccctggtgccgtcggcgagctccctgacggtgatgtagacgccgggctcgtcctgtatgacccactccgtcacctccagctcgctggcgttgctgatggacacctcgtccctcgacgagcagctggtcgttctcgccgcgtccatggcgtccgacgccgccgcggggctcttgccagcgcgctgcggctgctgctgctgctgccaggcccgctccgacgggttggacgacgacggcggcggcggcgacagcggccggaagctgtgctgctgctgctggcgcgaggccgacggcggccggacgaaggcgctccagctggtgacgcggtccggggtgagcggcgccggcgacggcgtggcggcggggctccccctcgtcgaccccacttgagagtagaacgattccctctgctcaaataattaattttaattcatgcaaatgcagagagagagagagagaaatggccatatatgaatatgatatccatagatcaccagctttaatcgttgcatgcatgctctgcactctgcagcactagcagcagctagcaaatcgtcgttgcatcttttgatgcaagctactagctagcaacgacgaaagcaatattctgtaaaagcatcgccatatgcagagttgcagatgcaggcaagaacgtatcagcatctatcactgcatgatgccaagccaagaacgggacaggctaggctaggcaacgtcgccgtcgtggccgtgtgctgttgccttgtcgccgcctcgccggccacatcatgcatggggaccatgacatttgtactagtagtagtcaggaaagaacaagtgaagtgacctcgccgtcgtcggagcgcggcggcgtggggaggacctggcggctgaagcggcggacgttgtagagctccatgatccgctcgttgttctcgccccaccacttctgcgcctgccacttgtcgtacatctcccggctgaacctgatgcgtttcaggtcgttgccgccgccgccggcgagggacacgaacgtgatctgcaccccgggctccacctgcgccacccactcccgagcctcgccctccgccggccgcgcgaagtcccacgccggcgtcgagctcgccgagctcatcgacgtcccgccgccgcccaggtacgtcgccggcggcaccgccatgtcgtcctggaccatgcccggccggtagtacccgctccggtacaccgacgtcgtccggcccctcggcggcggcgacccgccacgcctctgctgaccgtgatgacggctcgtgccggacagcttcatcaccatgtccttgagctgcatacaccaacaattaataacacatttaatttttgatgatccatcatccatcatctcctaattggattcatgggatcatcgatgatcaacactaggatgatacttaaatatcaatgtgatcagatgcaagattttgtcctatgatgacgaaaatgacattgcgtcaacttcatcagggttcattaggtgcattgaaatgagatatttagcccttgatggttgcctctgcattcagcagatagctacactgcaggtaaaacaagtagtaaaagaaattgtaaacgctttctccaagcaatgcaaatcgaacttgtgctattcgatcacattatagtcctgaaaagaactataatgaatcatacatttgtgctgattctggatgttatttccttccgttaagattatacctggatcatggtttgctgaatatattgaatcataattcaggacgcatttgtgctcattctgggtatgtgtcagtcattaagcttccatctggatgcattactcttggttacaacttaaaaggcatcatgatttgctgaataagttgtatactcttccaactggctgatttccagggaagttcagctcttgatttggactcattcatacgactgcagctttgggccaggtactagtcctactacctagtatatcatccatgttcctatctgcattattgtcaaggtatttggttctacaaccagaatttctggaaactagaggtctagagctaatagctactagtaagttattgcttaacgcatcatcttgcaactatctgcactaatagccactagttgtcgacaaatctgtctgcagcattcaaatgggcgattttatattggggtactattggcagtgcagctagtgaatccattgaaggctccggtcaaatatgaatgctagataatgaagctgcttcccctttaggggtcagggaatgacattttcaaagactatcttacactctaggatccactatttgacctatagccaatcaatttgtaatctttattcagctcagactgcacaatgccatcttgcattgctacctcatcaagactgaagaagaaagtaaatacgacctgttccacacttcacacagtaagtggtagtaaattcttattctaccatgaggtaaatatataaagcagcacaacctgaaacaaggatatgtatgtttttatctcatacaagtatatactatatttacattttcttcctagctatttaactccattactagccactactgtccatgcgcctgtatgtttcatctacagtttgttttcccctttcatgatatcaagcatcactttaggactggtctcttttatgtattgttattgttaaaaacatgtactagtacaatgaacatccccgcacatagattcttgccgtgctactgataacaactgaagcatgcaagcagcaatgcagatgcagtgcaacatccccatccatccatccaaccaggggatctctttatttgcattgcagtgcactagtgccactctctcaatctctccttttgagaaagaaagcatgctggagccccatccttatatcaatatctcatctgaagctctgagcataccttatactacatatactttggtgttgaaaaaagagagaaaatgagaagcaaaagacatggacacatagctatgggaagttggggcacaaagcttctttgtcacaaaagaacaagggaatagtccatggccactctttgtgggggaggaatgaaagaaagaaacaatagacatatgtagatgacgcatactatgtgctttgctttaatttgttccaggatctctccccaaggaaacgacacaaagtgaaaggtgatcatccaccaaccagggcagccacagcgtacactacgctacctgtcccctcattttgaccatctcgttgcccgcttcagtttcagtttgaacatatatacagtatctaactaactgtatccacatcactcaaatattagtaactgtgttcagttagcttaaataatatgaagtgcagtgtccatctggctgctacatctatgggaatagctaattaaaaacaatatatctagtcctatctgatctaatttcagattttcatatggtagaccggtagcggtattatccttacagaaagtatggatgtgaaaacattggattcaaagcaagtccaaatgtgaaaacaaatgttgatcaggactaaatggggcacatcttttctggtttcacattgatgccaaagcatggattagtttgatcagatgggtgaaacgggtgattggttaaattgaatcaggcatctactgcaagctaacttgtgatatgctactctgaaaagtttcagattgggagagctgggaaagcattggtgaaatggcgatggatcatgcaacaacggtcgtgaagaggccggggcaaaaaaggcgcgaaacttgctttgaagttaaaggcaggtactggccggatgattgatcaggtgagcttccagtattctgtttctagtagacaagcataataataacaaaaagagaaaagagaaagaagaattgatcgactttggcacaaagatagctagctagcgtcagtgtcatgctcagctaaagcttcaattcgccgaaagagatggagagaagtgagatgcgtttctttttggcagatgaccggccaccaggtgttagtatactatagtattcatccgatcgatcgatcgattaaagaagaaaagagaaaagtgatagagatacatggacgacgttggactgattaggtagctactactatttaattaaggttggcgctaatagttaattagcagcttcatctgttgaagcttgcagacatctgatcgatcgatgtctgcatgctgttggtcgatcgatgagctgaggtagcagaaggaggcagctgctgggagcaatggagcccacggccggccatggatcacagttgttactcgatcgatcctacagtaaattagtagctagctgcaatgcaatactagtaaggtaggtcgattgatcgatggatcgatggagatcggatgatggatcgggattggcgcctggcttttgtgttttgctagtactgcatcatctgtatcatgtacagtctcatgcatgcagcagccaaagcaatgaagctgcgaaaagcagcagcgtatgctgttattatcagcagcagcatcagcttgagctgccatgattccgacacgtgggccacgcatccaccgtacacgcccgctcgcatccatcatccatgccctgggtagggttggtgggcccctacgtacgcctcggaagacgtgccaagcgagacaatggtcagtcgtctctcttgtagtcttgctgtactgtcagtcttctctcttgtttggtaatacctctggttgcttcttacactggcattattattaacctactatgcactacttcatccattcaaaaatataagtatttttagaatagaggggtatatattccggttgtataaaaacattattaagctagtaattaattagggcatatagtaaacttaagagagaggatggcaacgcgcatatatatatatatatatatatatatatatatatatatatatatatatatatatatatatatatatatatatatatatatatatattgctcaatcgaaagcgactgcacgggcacgccctctgatctccggccggccgaccagccactcatcctctctcgatcattactgctctgctcgcagcatcacactttgcttaactgtattattattatcgtttccgtcctcatcatcatgtccattaatttatgtagctgcagcttcatctctctcactcactttttgtcagttaattactaccgtaatgcaattaattggggactctatctacctagttcttctatatatatactccctccgtacttaaaaaaaaagaagtcattttgaacagcttcacggtctccaaaacacaactttaacttcttatttctataaaaatatttattggaaagtgatatatgtattcttttatggaagtatttttcaagacaaatctattcatataatttttacattttcaaactcaacaacttgagagttattaatgatttatattttaaaggtttgacttaaacattgtcctaaacgagtttctttacgagtacggagagagtataagactctgatattaattgccttgcgtgtatcatataaaaaagcaagaggaaaagctaggtgtatatatatagcaaactctaccgtccaaacagtgaaacaaacgatgtaaagttttgaaattaatcagtctcgagtatgtaagtagtgctagagaaccttcaaacacgtaggagtacatatataaggccaaatcaatcgatctagctagtgacgtagtagtagtaaattaataagttctaaacactactcattacgtaggagtacaacatctgcaggtactattatattgtacgttgtgttggattggtgaaatcatcgaatactttatatgtatatatatacagtacgtactaagtttttttcgcgaacgccatatacgtacatgtatatactgcacatatatgtgcgtagtacgcatctctgaccctgagtacgtacgtactcagttagcatttactagtaattttattttatttatttaattatgaattaagacagtactacccgattataattgaaggaatcgatggtacaggatcggagttaagtgccgggtgtcataacaaccctctatgtgccgtgatcaaatcctcgatcggcagatcgatcgatgtgctactagtaatacactgagcatatagtgtggctaattaatagtgtatatttatatagaaaaaaaacttgcacatatatatatatatatatatatatatatatatatatatatatatatatatatatatatgtattatttatatattgcgcagctaataattaataaattaattaaagctcgatcggtagcctcaagaaagtaatggatggtacggtggtgcagatggttaagtaacagatgatagtatcgatcgaaaataagctggagtgcagatcgatggcaaacaagatgcaatgcaagcaaggtagcccggccggttgcaacaagaacaacaacaagaagaagaagaagcagcagcagcaaacaaaaaggaaggagaaaaatgaaggtatagtagtaataaattaagtaagaaattaacctgggaggtgagcgtcttgacggggtccctgcaggtgggcgtgtcgtccccggcgccggcgccggcgcgcggcgtgtcctggcggcggccgccatcttcctgcttgacgcaggcgatgcaggccagcatcgtctcgagcgcgctagctagctagctgtatgtgtgtgcaggcctatagcctagctagctaggtagctctcgctcgatcgatctctctcgactcgacctctctcgctcgccggccggccggctactagtgtactagtgagtgtatatatacaagggaggcgaggtgaggtgcaagtgcaaggccggcgtgctatatactccctgtaggagctagcttagcttgctttaggttaggttgtcttgtgagagagttaaagcacagcgcatgcgcgcgcgcagctggagaaaggagtgcgcgtcgtcccctcccctggaactggacctggatattcatttatcgctacttaatctagtaattaagtttgtactcctagctactcactgctgtactatttcctccgtcctataatatagcaacttatacaattaaataaaaaattttaccgtacaataaatctgggtaaaaaagtgttaagatttattgtactgtaaaatatttcattcaatatcaaattgttatactatgcgacggaaggaggagccggcgtaggagtagctagcagagtgatagctaaggttactcgagctgcaagcgtggccggccatcgccattcgccagcgatgcaacgcaagcccattcgtcctattcaaaattatcataatcttaattaatttaccgcgtgtcccgctcttaactctgtcccgctcttaattaatttaccgcgtgataactattaactctgtcctgctcttctctctgctccacggactctgcttttctactttcttctttttcttttcatttcttttcttatctcttctcttcttctgtagactgtatgtatgtactactatatttctttatccatcaaatttctatataagttatcgctagggattacccctgtctcgctgcacaagaatcctctgctctgaattatatccagctccatcaataatttgcattttgtctatctatattaacgttgttgtttctagtgttggcctttgtataaacatccttgattaaaaaaaagagagcatcgattgattctctagttttgtaagtgctccaaagtaatctcagttcagacttgaaaaacctctacagattagctatgaattgaacaagtattagtggcagtgccatagatgttattattacacacactcaaaacacaggtgcatggctattatgatgatggatcatatactctagtacctagtcaatttcacttcatttcaatgcagaaattagggggcgttttatctgtaatgaagggcccaccattgcttaatgatcaggtgctatgtgtcagccatacatcaatgttaacgctctcactgcagcataagaaaccaattaggccactctgtcaagtgtcaacacgatctccataacaaactttaaccacaagatcgaaattaagggctagtgccggaatgttcgcctgtccgggccacacacgaatcacgaatgctcgtgtttttctttttccgccacatcattaatttcctcgatcttcttgtaagttaatgcactgaaagttcgattttatagattcaattcatccatagccaatctaatagctcattcatacaatagttacatactacactattaatacctggtcccacctgtcatacaaacactgtgtctttgagtccatgctacagctggctataaatctgtagcccgctgctcttctctctccttatttatctccttaaaatatgtttgcagctggcttatagcttgctattgtacctgctctaatactgattggatttaaataattttatatagaatgattctatattaaaaagcttatagtataaaattattatgtaaaaacgtttcagggcaaagggtcagaaacatgtaggccaagccgaatgtgtttgcatacatctagaccgtgcgtggacgttctcccattaggcctatatatccaacagataaagaagaatattcaaattaatgttatcttggtgcgcgtatattttatgagatactcccatccgcctcatgaaaaacgaatatagtaccgaatgagacacatcatagtactacaaatctggatagatatataactagattcgtggtctatatctgatactaggttggttttttataggacggaggaaataatagacaagttgtctataatataaaatacaataacccaatatgaaatggtagtagtatatattaaaaaaaaagagattttctaatgaggagatggagcggctattgaggaacagcatgcatggtcggagagagagacagtaatccgagcacttataattactcgtgtgcgcacagtagataggcctctgcatcacgctatgatttgttttgagtggagcgtgtgcagcggcagcggcagcagctagctttgcacttgcacttgccattgatgaatatgcctaggttgcatggcaggcatccatcgagtgtttgatgttcttttagtacgattgatcggacattagctgcatcattactgatgcacgtaggccatttcacaccgagtgcatatgcaatatattgcatgcgcatgcacctccttttctaatcgtggatctgttgtttgtaatagttggtaaatactccctccatccctaaatatttaacaccgttgaattttttaaacatgtttgatcgttcgtcttattaaaaactcttttgaaatatgtaaaactatatgtatacataaaagtatatatttaacaatgaatcaaatgataggaatataattaataattacttaaattttttaaaaaagacgaatggtccaacatgtttaaaaaagttaatggcgtcaaatatttagggacggagagtttatgtacccaacacctgaggcctgtgcaacgtcccgcctctcgcagaccggcctgggcccgcttacatctggcaactttcataggccatagactgccctcacagaccaacacaagtcttttctgcaaccaagcacgcttaacctatgttctttcgagatcggcttctgaaaaagaagttacaaattgttgatatgagtatcctatcaatcctattaagccctgggcggagatgttacaacctagtacatttggtactagatccgttatctacttggtatatattacatctaatacacaccttatattatgccattattatgtaacgacacgacgaactataatgcccttttatataacctgaaaatataattctcgacacaaatacttgtcggcctagttataaaatcttgaagctctgctagtggttagcacttacagtataaatcgattcacggttttatcgggcgttgacaattgaggtcaggttagaaaggaacgctcgtgtccataagggcggcgaacacgggggt

SEQ ID NO: 40944 - DNA, 919 bp, Oryza sativa
tatgtctgcagcctatgcaacagctttttttttttacctctaataggacagtgtatgctggagaacaactatccggtataagataatcgatacatggtctgcaaccacctggatacgacatgcgtaggtacaatggtttcatatataagaaacaacagaagtggtgattctatggcacaaatgtaagcagattgctcaggaaggaagtagtataagcggaatagatatagtactattaataagactatgtcttatcacttgcagtgatatttgttagaacgtgcatatattacagacaccaaacattgctgatactaattcatttatcatttggctagctattaggggtagtgagcccgtaacaggtaaaactaatatcgattggtctaatggcttgcgcaaaagaacatttctcttttctatgttggcactgcaaaatagattgaccaaagtattttagctttgcttcaatcagggagagaagtatgcgcgttgccatgccaggtgcaaaaggtcacttcgctctggggatatcacatgggaggctcaagtcctgaaacgaagaatgtaaagcagagtcacatttttgctataacaaatgaggaggcaagaaatacatagttgcttgagtatagttggtcacattttggcagctctggtggcagcttgtctacgaacagtgtgtgcacaacagaaggcttgcgacgatcatgttcatcaggagatgagctacaaatggaagttgtttgagtcatgaggaaaaagagaagaaatcaaagtaaaacatgaaattttccattggcactaaccctccatggccaagattctcatcagccatagaagatttacgttttttatctagatgtgctatagctatgacctgataaagtattaatggttaggaaggtctgacaaagac

SEQ ID NO: 40945 - DNA, 3300 bp, Oryza sativa
agcgaaaaaatatgttgaataaagtagaaggatgtctatgtgtatgaaaagagcagagctaagtggcacctgcttatgagggagattgtttcctggattggtgcgttaggataccatctacagacagtgctaccctgtagggctagctggcctgtcaaagacgaaagaacacatcatgtgagttagaacagtgaaaatatgcaaatgagataggagggataatagaacaggaatttatttcttacggtctcgaaatttaacagttaaaccaacaaataacatgacaacatgtccattgtctgcttgctgctgcaagttttcagcgtggaattgtgtagcatggggaccccataacgccacgacgacagtttctctgcaagcacataaaagaactaagaagtggaaaataatgcagatgactttttaaccatccatatttgctactaatcaagatgccagagaatgttcgtctagaaaaaaaaggagaaacatatatgtttccaagaaatcgatgatgcacatgaaaaaagcaataatgatctatccgtgcataggttgctcattttggatggtagctttcactcacccagaacagaaatatgtttggaataggtaacgtatcgatacgcacataccttccattggttatatggtcattaagcacagctttcataacacctgcataagaaacagtctgcactggcccgatggctgtcattatgcctatagcatctacatgggaatatgagggaggaaaactgtatatgagtaaatgagggcagcaagctagaaatggagaagattaataagcaataatatagattgatctgggccaaggagacttacctgaaataatatctttcttgtaagcccgagctctgagttcatcaaaagaaagaattttgcaggcataagatgggaacgtggatggtggtccagtatcttctgtaacggttgtgtgagcagtgaactttgccatcaacagtcgatcaacaggcctatactgggggcgtgcctcggcgacttcgaagtatttgatgtaatacacagcgccttcctttagcaaaggcttgaattgaacaacgcggcgtcctgggatttgcgcatccatcatgtcgccctgttgatgtttcaatatgtaagagggtgcggaggcaaatagtgtgcagagaaagaaagcatgtactcggtgctatgcctgctcatcaagcaggactaaatcaaggcgcaaaatcttgtcaggctcattagctgtggtgaactccgagaagcgggttgcccgcactcgtacgcgccaacggtgtgattcctgtgtgacatcctttaggagactgtaatccatctgcagggcatagaaaacacatcatgcaggttagaggggaattatacaaacaatgttctgcatgatatgaaggcgcaaagctgtaattgctgaagggactatggtggagcatataagttttttagttttggagctgagaattattttcagtgcagggcattttaataaatcatgtctaaaagcagctgatagtaacaagagagaaatatggaaattaagaaagaagaatcgataagcacgcatgaaaggcactggaacaagcaagtgatcaaacaggaacaacacatatacgaacacaagctggcagtaaaggctaaacaaaagggaacaacaaaataggaaagctgcaccgacaaatgggatcacagaacaaagagcttcacaaaagagccatcacagtgctgcagagatagccacaataaaactaatctacagcaacgataatatttcgttgtagacgatgttcttggtggtggaacaaggatttccatcatcatcttctatcaataacttgagtccttcctttgatgtagctcgcgaaacagcaacatatagctatccatgtgtgaagatagggttcttgaggtatacaccaacatttcctaatgtctgcccttggcatttgtttattatcattgcataacatagtctgataggaaattgcctgcgctggagcgtgaaaggccacttcggactatttccacttaggacaatccgtggaatacagaccagctggccaatatttgtcccagtcatgattttgccctcaaaaataaaatcaccaagtcgagtaaccagtaatcttgtcccattgcaaaggccaagtgattggttgatgttgcgaagtaggacaactgctgaaccaattttcagggatatgtgatgttccgggaagttgtttatggatatcgagtttagaaattctatgggatacaacagatcaaaatccgcagctttctcaagtgtatttgcaatagtgtcgctgctaagatagtcctttgcttctccaggtactttggcaagcatcatatcattaacctcatcaacaactgcatttactagacagactattgcgcgctgagcaagatatgggatgcagtcatagttggtctgaaaatctgggtagacagcatcaattatagctgtaatcttgtcaccatgtggagtaagcaacaattcctcaagtatctgtatctatgtctgtcacaccccaaagttctttcccaagcctacattgaagttataaatggtcttcagagaatacttgtgtaagcaagagtaaaccttaataaattaatgcaaataataatcggaactgacatgtggaacttttgagttctacatgtcgaaattcgctaacaagatttttagtgaattttcagagccctagaaataattttaaccaattaaaattgagcaagcatattttaattccagggaaaatccttttcttcctttttctttttctttttcccccttttcttttcgagtgggccgccggcccattctccttcctcctctcccctccgctgggccggccgcctacctcctcccacccgggacgccgacaggtgggccctacctgtcgggcccgtctcctacctcgcaaccgccatcgccgcacccactcctccgctttccccgcgccccacgccgcgtcgcccgtgcccacgccacgtcgccgccccctctccccgcgtcttccggccgcgcctgcgcacgagaggggcgggattcgattttgaatcgccccccaccttctctctctcctcccccacgtcgccggcgaaatcggggcgcctcccggccacgtccgcctccccctccacctataaaatgctccccatgcccttctctctcgttttccgctctcaccgctccatcccgtgccccctaccgagctcgcgccgccgccgcttgcgccgccgcccgccgccgcactccggccgtgtgctgcc

SEQ ID NO: 40946 - DNA, 1074 bp, Oryza sativa
gtgagggtttccctctgtcttaattcctcctctctttttccctaggtgtcgccgtcgcttgtccgcacctcggcatcgccggtcttcgccgcctccctcgttttccaccgccggccgttgccgcccctccggtgaggtctccctccccttcctttccttccctttttttcccgtgcgccgccgccctcttcgtgcgctcgccgtcgcgttcggtcgtcgccgctcgcgccgccgcctgccgtccgtgccgccgtttgccgtcgccggcggtcgcatgcgcgcgccgccgctttgccatggccggctggtcggcttgatgccgggcctggccggtacatcggcccgtggagctggggccgtggggcccgcttgccagccgtgccccccttgagccgctgccgagtggggcccgcgtgccggcgccccttttccctctctcccgagccgctgaccggtgggccccgcatgtcggcgcccccccttgatgacgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgcgtagaatccactaaaaatggttttgttctctgtttcagtagtcttatagcctgtttgtattgtttgctttgtatgtcgcctagattccggttcttccgacgctccggtgtacttcgagatagtcgccgaggttcctccagctgcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatggggaaatctcatttaaaatatagactgtaggttcatatgataatgttggtttagtaccaccgctttg

SEQ ID NO: 40947 - DNA, 712 bp, Oryza sativa
ctaattttcaagatttctattcggactcctcaacacatatctttactcgtgcaatgagtactcgatgacaagaagctacagttctcgactctatgttcagttgccttctaactaaccaaagagtcgggggctacacaaatacaagactctcaaaattcaacaagctgaagaaatcaattaatcagccaacgagtcaactccaggagtcgttatcttcatctttgcttcgaagcagatattctacttcagcaactccaattatttcactagcaattttggtttctggacgctgccataatctactccaaatttctcaaagtatcaagttcaagatttaatctacatgttcgagagtttggagttatcagccaatcagcttggtttagacgagttggacaacagcatctactttcctccaagtgaagcatttacaacagctataacactaagttctgcagtcatcttcgtacatcaagaagcgttgcatcagtcttctttatgcacacgctctcgtcaaggaaactacttgagctttgatatcttctgaacagtttgatggattattgtcgctgacatcatcactagcacctctgcttcattagccctgacatctccgctgttgctaatggatgactatgtcttcgccgacttattatttcaccttcacggttgacctacaatgcaaacgctgatgagcgtcttcgtcattatc

SEQ ID NO: 40948 - DNA, 7274 bp, Oryza sativa
atgataagatgagaaattaagtcgtagtaataatcttgacagcgtccaagatgttcttgccctggagcttgctggagacgacgagcctgacgtagtcctccacgctgatgctccggtagcgcgcctcgccgcctcccaccatctcctccagtggtccgtacgtcgacccgaacgtggcgttgtggaacgccgccacggacacccgctcctgcgccgcgtccaccaccacccggtgctcgatgctcttgtacctgccgttcgtcaccatctcgaccacgtcgccgacgttcgccaccagtgcgccggggatggggtcgacggggatccagtcgtcgcccctcctgatctgcagccccttcaccgggctcacctgcagcagcagcgtcagccccacggcgtccgagtgcggcgacacgcccaggaccctgtccctctccttggccgggcatggcgggtagtagttcatccgcatggactgcgccgcggcgagccttgtcatcttgtcggcgtcgcgcaggcccaggttgcgcgccatggctcggaggagctcggtggccacccgctgcgtctcgagggagtagcggtccatggagcggcggaaggtggaggatgtctccggtggccagaagcggagatcgcggtagctgggcggctgcgtggtgaggaagtagaggtcggaccagtccagcgtctggtcctccgacgtgacgaacgcctggccgtagccctcgatccattccggctgctgcgcgaacgccgccttgtcggccagcgggaggttgaagaaggccatgacgtcgcgcttcatctcctccaccgtctcgtcggcgattccgtggttgatcacctggaagaaaccccactcctcgcaggcgtgcctcagcttggcggcctcctcatggtgatcgatgagcctggcaaagtcaacgacaggtatcatagccatggcatggtggtcgtcggcgggcagggacaggtggtgcgggcgaagatagcggcggaggagggtgggcgtgaggtggtccgggcgggcggcgaggtcttgcacgttgggcaccggcagcgagccacccagattccttggcttcttctcccaacactccattgattatttcttcttcctcgatctctactccaagaggtcttcaactaacttcggggctatactaatactatacatatactgctacgtggtcgcaaattaagtcacacaaattgactcagctatcagctagctggtcaccctcacataaacgtcggacgaatccgtcttaaaaatgcactccctaacttctcttaatccttatcttataaatcatctcttactgctttatggtctctgaatgaataagatcatttttgtctctcctgtttgtctctcaaaacaagttgcaaatgattgaagttggtaaaagtagtggataaatgcagttgtctagcaaatctgataatagtattaggatttcataaagtgagggtgttttaatctttttgttttatattggtttttttggcattgatgaaaaattaattttttttaggacggatgtattttttgagccgttttccgtataatcatgacatcttcttgccgaagctcctagatccagtgacgcgatgcaattatgcaaataaagtggattcggacataaagagctcatatgatatcctacacaacaatcttttagcgggttcaattttggtatcaatgcggatgacggaaatgatacagagtcaaaacagatacggcttaagaatggatcaaaattatcgtataaaacatacatacataaacagagcaattttatgtttcttgagaaggtaccatgaggtattaaaaatttacacagttgaattgctcacataagcaatatagaaaaaaagaagccgacagataggctcccaaactcacgatagagtcttcaagttaaaaataatagataagccatttgaatggaacatgatgatacatgtatcgggtgatggtacatcttttcttccaaatagccctttcttgaatgacccacataagaaatcggatattcgaccgtgggattttggtaatatgccatatgtcattggcaaaaacatccggcttcctagactagcctgagggcacctggtaatttatacaaacttctttgataccgaccaagaacatgagtaagtattatccttcgaaaggctcaaacctgtatacacgatcatgttccttttcgctcccgagcacactgcacacccggacacaccccgtttacactcacagcccttggtaaatcctagatctgtggtcggatgctaacgcttaccatatctttactttagtcaaactcggagcggatcggtccataaacaatttgctctttgctctgttttcaccatccacattagcttctactagacgtgcttgtgggggccacttccagtccttcacctcgtctatgttatttttattagtcgataagtttatttctggttgacttagtgggagcctgagagtaacataacatgttttatggcctaaaatttctactaataataacgggattgttatatggcattcgaatgaaacttggggatgaaatcttacagatttctattaataataatgagcttatcgacaacttgcttctatggctgcatttataggccaatcatagtgaatccggtgaattcaaacaaagttctgaaatgaataaaatttctatgcataaacttttgggataatgtctcgtgatgggttggacccatgtgggctagaccgaacatgtttggcgcacccaagctatgtgaacactcgcccattagatctactcatttgcatggagatatattggtcgaggggaagtgagaataaagatgagggtattgctagtgggcgggtgatcgcttccctctcctcctagcgatcacccgtcctttgcccctaatactcttctttcatatctcttttttacttttatattacattatattttttttaaaaaaatagtaaaagaaaattcgaaaaaaatctaatactcttattcatatgcataaactttataccgtaaactttgcacgcataaactttgtgtatagaaatattttatatataaaatatttgaatccgaatttgaatttgaatcgggtatataaacttttgatttataaatattcgctctacaaactttaggtggataaactttagatgtgtaaactttaggtgtataaatttactaaaagataaaaatataaaatatttgaatttgaatttgaatttgaatcgggtatataaacatttgacttataaacattcgatctacaaactttaggtgtataaacttactaaaagaggaaaaggaaaaaaaaacgatcgctggcagcgatcaatcgcccgttagctgcatataatgtttaggtggtaaagcatgcatcacactctagcaatgtttggctaataggaaatggaaatgatttccaacccaccaaaaggcatctttcaatcctaaccattcattctcactcttttatttaatcctaatgcttcattcatttcccaatctcaatcccaccccctatttcctattatccaaacacaccctctgaatacacataaatttattctccactagtaataatatattgatggagatgcaagcacaaagttgtcatacgtaccgtataaataccaaatactccaatattggcgcaggtacgtggccagatgcaacattggctcatacatatatatttaggccaatatgcatggatcaatataaggtccgcatcgatcgatcatgtttttttttttacttttatgtgaaaaaaaatatttaaccatgaaagcttaagcaattgcgtgcaccatcaccggccgtcgtcgatcgatcgatcatgcctggtttcggtttcctctgcaaacatatataatccatcgataattaataaatcaatctacgtatatgcatatatgttaataataattagctaggaaattactctatacaggagtatatatatttgaatgaataaatagaattaagaaggaaggaaggaaggaagtgaggtatgtatcggtacttgttagtattattgttgttgttgccgttggggagggcttcgccggcggcgtgggagtggtcgtcgtcgatggtggtgacgtcgtgttggaggtggtcgtagtggcgcctgacgtcgtcggccgtcttgccgccgccgaccgccgtggcgatgagctcccaccggttgggattgtcgctgtcgtacgtcgccagcgcctgctcgaacctcgcgttttcactctcgctccacgacgccgccattgatcgatcgatcgatcgatctctgttgcttgcttgctagcttaattaccttggaattatgaagaacagtagtgctgctgctatagctagtcagtagtcagtgttgcatggacgggatggccggctgtttttatagcttagatatatccaattaggatatattaattacctaaatttgtctgcgctaattgcagttatgtattcatgaatcagaatgtcgtagcactagctagtcatataattaaattaaatgcaaatagctttatatattagcatatatatgaatgtcagtagtaccaattattgttggagatccaataatgtgaggggtacgctcggttaataaacaaagagaagaaaataaaactatgtatgcatcgcatcgagaggctggccgggcacacaacaaggaacggaaatgggtttttttgggccaaaatatgttttcgctgggtccagtcactatgacagccggcttaagtcagataccaacgaaaatatatcttcgttagcggctaccatatgacagtactttttccgttcctgtataactcaatgtagaatatgatatgacctattttaatataacgaatctatatgaaaatttatccaacttcattgtgcatggataacaatcctagattaaactattttggaacgaaaaaaatacaaatcaagaaatgaagcaaatacatactcctttcataaaaaaacaaatatagaattagatatgatacattattctggacaaagttatattcagattcgtagtactataatatgttacatctaatactaactataatatgttacatctaatactaggttgattttttatggaacggatgaagtactctatatcactagacagcacagctacctacctactaggaatagcgccattctcttctatatatgctctttaattttcaacagctatctaagctagtatagtgatgaatcagactagatgactacttatgtgaattatgtagcattcgatctctaccgaagcatgttttgataaacttaacgctctttgaaatgttgtatatgaaaacacaaaaataaaaaaaaacatagaaattaattggaacggcatgtttctcttatcctaatcctacataaacgaaaaagataagagagagaaggggagccttccgatagcatcacagaaaacaaaaggaagaagagaaaagtttccaacagatatgacgtcttcttatttatatatatgaaattaattaagatacacacacacaccatcctccgaaacatttcttaccatttcctatgaattaaatgattccatacttaaaaatttcatagaaaactgaatcctccaaaatttctatggcaatccttcatttcaaagggaccctataaagtgttaataatccattcgtttgtttgtaattttcgcctctccttttaaacagaaacgttcagacttaagagaagagcgcgcatatttgtccgcaaaactctcatcagtaaataacgagccggattgaagttaatttctttatttttcaccacgccaattcatcccttcttgatagtacactgtttacacatgaaaagaaatggttccaacaaaacttgcaatgcagaggcattaaaattagagtgctaactagctaaatcaatcgtcatgtgttgagttttttttataaaaatgttcatcttcatctccaactcgatgtcagtgctattatatgttgcattgctatatatactagagcgggttcgcgcgctgcgccgcgcggtttataaccgattcgtgttatttgatcagtaccgatgtaacaattgatggaaaacggctttttaagttggctgtttaggtcgtatttagttggctatttaggtcgtgcagcagtaagcattggatctctctgttgttatcgtgggctgatcgggctaacatatcaaggagctataggcttttgtgcttatgtttgacgttgggctcttaaaggtgtgcaagagtataaatagtgggctgctggtgggcttcaggatgcaaggccttttttagctaaggatggatgtcctagggcaacgtgttgtgctgtcattgcatatgttttgttggggctggtatatatgtaggagtgctggctgtttttttaacgctgaatcgatgcggcggcggcgctgctgatcttagcggtttagccaaaggacatttagctagcatggacgaacctgtgcaaggtatgtatgcatatacagcgattaaccctgtggattgaggtgtgctctttactaatttgtggtgatagtttggctcggtctttaatctgctcgatataatggaaatggggatgggtgtttttttagtggcacgattatttttaagttaatctgtcttggcttggaagcctatagaatggccaatagtattttacagtttgcaaggtggctgtgtaggctgttaattgaacgatgacctcaatctatttgagctctctagaataggtcatgtctcttttaaaaaaatacagatgattgatgtggtagggatttgaatgcctgttatttcatttggtgatctggtaaaaagagatggttatatttatatgtacctgtgtagggaaattttaggaataaggggaaaggaaaggggatggacctatgatgctgctattcttattgactctgtttttgttatggtataacagaacaacgccaccttgtgcacatcaggtcgaaaatgttgttgtctgagatccttagaagcataggcgctaatgaggcacgttataattgtcatgctgtcactgatgggtatgttggctctgctgaggcatctgtttatggtgtaagaggaggtgaagagccatttcttgttcgtgcacatggcatcccagctataaggccatgtgatgcggaagaaagtgccgcacatgcactaattgctgttatcaagaaagagtgcagagtggagatcgaagatacgaactg

SEQ ID NO: 40949 - DNA, 714 bp, Oryza sativa
gagcccaacctattaacttgttgtggtagactttctgatcagctcgctgttaatgctttctcatgtatcgagacatctcgcctcaacttccatactctgagccagaagaaccttcgctctgaaacacattaaggtatatctgatgctgttggtaggggagacactaatggaaaagatgttggtataaaggtaattctgccatcaagtttcattggaggaaggcgatacatggtgcaaaattaccatgattcaatggcgttgtgcggtgcctacggtcctcctcacatattttcaactttcacatgtaatcctaaatggccagaaattgctcaggcgattcgttttgagctaggccagaaaccaaatgatagaagtgatatggtcacacgtgtttaccatatgaagctagatgagtacattacatatattaagaatggacaggcattcggtccaatacaagctggtaagttccatatctcattgattatagctatccagtctttatacacatctctttaccaccacatgtattgcttctgctagctgttcatatcttttttcttgctgttttattttccagttgtatacactgtcgagttccaaaaaggggattgccgcattctcatacattaacatggctcatgggtcaatctggagatccttcacctgcattcattgatagccttataagtgctgagataccagatataggca

SEQ ID NO: 40950 - DNA, 50282 bp, Oryza sativa
ctattcttaggttcggcttgcgaaaaaagtgacgtaactttggccagggttgctttcagtgtatagaggtaggcattaggctttgatcccctctcgacgatggaaatttaaaagggattaaacaaagagctaagtcaaatctaaacaaaacccctggggaatttgtgatagaagaatgatgcaaagctctgcacatttgcacctagtttttccctcccgtgtaagctccactacacacaggaagaatcatatgcacttcacctctgtattttctatgcattgagattagcagtgtgggaggcagcttgaggctaaactatgtgggctatgtgagatttttgtccctatatgttattttttttattctttttagtgtagtccctatctgagcttgagagattagagtctacatagattagggactaggtgaagtttctcactgaaacacttgcttattaactacctaatcctttctccatgctagagattataggccatgattgtgttctgtcagaaggcttggggcctgcatattccatatgtagcatacctttcttctaattgcatatgctcctatgaaacgtgaggcatccataaagtttaatacaattatattctgaaaaggtcgtagctagcacagaaatttcagacaattgtcgttgctgaaaatattacagtttgtcggttacggggaacagcatacgcaactagcacaaatattctataattatctcttttcttgtaaacatttcatggatggttaagtacatgagatccatgattttactctatataaaaaaaatcccccctttcagtaaaacctaattcatatgtagaaaacgagggccagaggttccttgagaaaaagaagaagaatccaacgttgtatttagatgtcatgtcatagctagctccggtttacttttcaagcatcccctttgttacagaaatacagtattgttatgtactatatgtttctttcaaaatattactttcacatattttaacaagattcgaagtaacgcacacactgttttgcattttctgctgaaaccaggatggtctgactctgaagattctgtcctaagcacgtaaatactgaaggttattttttttccccaacggggccgtgttcttacagttgtcaaaatgggtttgaaatgaatggtcgtgctcatacataaaacacggtttcatgtaaagaaatgctcatgtccgtctcatcagaaatacttttgaaatctgacagcaatattctctgggttctgattgcctgtgtcgttaggtacggttccctggttcatcatctcgcactgaacaacacaacggaaagataatttactgtatgaattgagtccacgtcaagggcctaattaacacaagtcagcggccagaacgcaacttggaatgatgcagaaataaagagagatatttgaggccagcattgtgtcaagaaggaataatgccaccagaaaagactccaaatcttcctgccggttgcaattgcacgatcacacctgaaaaactcgagagaaaaaactttgcttccgtactctcttccacttattaatcatatatgtgatttttattttatgtgtacaatttgtcctcttttattcagtttatgcaccttgaggctaatgaaaaaaaaaggtttttttgaaggaaaaggtatttaaaggtgaagtttagtgcagaacctatcctctgatcaacatttaatatataatccagaacaaagacaattctgtttatcttggcgcttctgagttgtttaataaatgttcgtgcttgtgaaggaggggaaaagaaatatgagatgaaaagttacaacaatagtagcatttgtcaactttaatccatcttttcacatgagcacacatgctaaatttttttctttataaaaatccgattttattccaatccattggtgcagccactctgtcagaattccatgggtttcaaggtgcaaaaacccaccattacaagtcctattcgcgcttgcggtaactccgtgcctgggtgcgctgaattcctgaaagagatgaaacagaatatgatgatctgtttgcaacaattcttttacacttttttctacttttttcacttgtaagaaaccatgcgtagggcacacttccattaactacaatatcatccaaagaaggagggaatgttatctgattttaccactaaagtttctggcatggcttcttctctcaaaagtaaaaaaaaaaaaaaaagaaaggctcccaagtgtctgaaatgacatgatagatttcatatgaattccttggcggtgtgaagctctcaaagaaactacaggagcacaagttttctcctgtccattcaccaattgatgcgtgtcaacatcggccaattaaaccatgtcacgcgagatgctgcgggaattcctcgtgttcttggagcccttctttttcgcgatcaatttgcgactgttctgaatcaccagaggcattatcttgaagcttatggagaaggggaatccaagcataataatatgttcttgcctttttcttactttttttttctttctaaaatgtcaatgcttgcatgtacatggtattgcatttacatcttggcatgatgccacaaaagttgaatgcaactgaaaagggagggtaggggtatgtagaaagaagaacatcaaacagctacgcagtactaccttttccttttcatttgcaacgaacgaagtacaagctcttgagactacctaggcaagaatccagtttcctttatgctgaaatcttcagagtgagcggattaacggagcaacgctgctcttttgttccgaaaacgaaaaaaagaaaaggaacagggctctaacattcgccagatcaccctagctagctaggtgagtggagcagggagttcaaaaaaacaacggaaatgcacttcgttcacaccaaaatgtacgtctagacacacaggaaacatctcttatatttaggacggatgcagtatttggtagagccaaccaaaacaacggaaacaaaatttgttggtcgagtttaaatatttgcaatgtttgaattgaaatttgtttcaaaagggttcatctggattttctgaaatgattctgaaatttgtgaagaggcttaaaaggtttttcaatggctaattaatctcttgcattcagggagggaatgtgaagcggggctaattaagcctatgaaatggcgccactggtcacctcaccggttagggcatcgatcgcctcgtcatagtggggattcttgctcccttttttctgagattttccgcggcacagagaataatatcgtggtgtcatcaccaccatcagcgattgaattgaacgcccctggaaacccctggcccttcctattgttagccggtgacggatttgatgtttcctagccagcattttccatgtaaattgtgtgtacaagtataacgaacaatatatatgcatgttcatgaattgtaatattgatctgatctcaaaaaaaatatatggttcatgaattgacgtgttgtgctgcacgctgaatcaaaagagctcctttttcacgaggttccttagagagagagcgatggtgtatcatatcgcattttctagtgttaattttctgatatctcaaccatagaaaaaagtacttcctccgtttcacaatataagtcattctagtatttcccacattaatactgatgttaataaatctagatacatatatatgtctaaattcattaatatcagtataaatgtggaaaatactaaaataacttacattgtgaaacggaggtagtatgtattagatggactcgtgccctctaccgtcacgacaagtgccattgagacactaacatatgaacctgatggtattagatgatctaaaagctaacgttgaaatagcgatacgtgcaataccatctcacttgttagaaaccatgcatatataaaatactaccttaaatatgaaataggagtagatgccggtgctatgaaaatgcagagaactacaagaagcatttctcctccgaccctctttttttttgctctgttgaaaacagcaaagcatttcctctttgttgcccttttggaataatggcgagggagatatagctgtgacaaattgagcaggcagtgacagatcataaagataatacataaaccgtgtcaccgttcacacaataaagaaaaaaaaacgacattattataaaaaagtatattattgcttttctcttcgcactactgcaggacattggaaaaggcatgcatttggctcaaaaccgatgtaagttataggcctataattttttctcagggtaaacttaaaacgttgcttggatgggccataacctattaaatttaccagtgtttttggcccattccgacattttgattgttttgttctctgatgagatcatgagagaaaagcagcagcagcttcgttttttcctgcacggtcaagagcaggtttcccaattcatgttcttcatgagcattgctatctagaatcagagcagaacaatgtaatggtcccaagacacaggtgattcttcagttccctacagttcttcaggatttcagatcttgcatggtcaagaagagcaggacaagtgattatattctagcaatccgatggattaaaaaaatcgttttttttccttttttgtgattatgattgagtatcgactatcaaggacatgtgtttatatgctgcctgtcactcttaacttaattacaagggtattcgtaaggcaactagaaaagattacaagtgtgttcttggtgacctaaaattacaaggtgcctttacaagtgttaaaaaatactatactcccaagcagccccgcacagggttcaacatttcggcccttccgatacgatattatttcagccgaaatttttaatttttttaaaattttacgtgaattttggtattatttattcaaaattgactaaattttgttctaaatttcggaccaaagttttcgaaatttcgtcataggggcaccgccagatacaaacacccaaaacgaaaaacgaaaagttgaacctggccctgcacgcattgctgaagagatcaccgatggatggcacgtgcgagccatcagccatgcgtgcatggctggctgagcgacaggtaacctacggggaatgaaacttttttccgatgaatagtgtggctactatcctctttagtcagtgccggaatcctattcctatccgatccgagcgtcgagcgatggatcgagccgtgtttttgtcatgttggtaaagaggggtgcttgtgcgtgtacgggcacgggctggacccggcctgactttcaagtttgtgagacacttcatccgtagggaaaaccccatcaggccttgttcgtttaattcctcccataaaaaaattaagagggatttgaagccttggaggagatttatttcacataatatattatgatgtagaattattcccctctcttgagaattaaaggacaaaatctcaggaatattggtgtcttgatggccacccgtcataataaaggccccattcctaacactccattcatgtcggtttccgtgaggatcggtttcagacgtcaggagaagactgctttctggtgcgcatgatccctcaaggtggatcaaccgtacatgtgttgcttgtgtatttgtgtatggtacggtcatatattctaagctatatgagcgtaagactatgaacaatatataggcttttcattcggtctccttgatttgaatgatgatttctttagataacatataatatctggcctttacttcaactaaagctatagccacttagtacataatttttggttgaaaaccaagtataacaatttctaacaaaggatagagagacgacacaagaataaatgtcatcatcaaagaagagaaaaaacttatttaaagaataatcctactgttaaatctccatttgaagttgacagaaatttgcatggcggttgtctccaagttccaacatgcaacgtgaataatcaccattttctcttcacacctttgtagttatacccaaaaccgaaaccagtatattactttgaagagtacctacatataagatttagttagcgttttgtcaaaaactatttcatttctactcaacgatagagctcaatataaagtagatgctataactaaaatatgtttttttatccttaaacggtgattaattgcatataagaacaacaatcgataattcaaacaaagatagtgtctaatgcttgttatgtggtcataaaatgcatgctgggaaggggagggggtgcacaggatcaaggaaaatattggccacatttcaaggaatctacattagtgaaaagggaatccctagatgtcaccaagatgagccacatcatcaaacaaatatcaaccgttgaatgaatgatttggataaggagaaccgttggattagtacagaaaaaatcagtaaaaaaaagacaaacaattttattgggtgttttagaagcacctcccatgagatgtgtgctaacaaagatgtgaaaatgaaaaaaagaataccttaaacattgaccgtataaaagaatatcaatgagtattcagtactagttctattgtatcaataataatgagtatcggtgtatatatgaatagctaattaacctgatgctatcgactacttcatcacaccttaaaactaaaaatcatgtgtcatgatgggacatagtaaatttagtaaacttgatttaacatatgattataagatttatgataataaaatgtatatatacttcttaactggtcatgacataattgtagcatgtaacagatgtggctatttatattattattgctacagataatgcatttaaagataatggctacagtaatatacaacagattttttttgttgcgataaaattcttaatcatgaatcaagatatatagactcattaatgttatagttacacatcaaaatatgttaaaaatatatttcctgtttgtagggatacctaggctagatattgagtttagcatgacaaccagtggcgtagctaggattttagattagggtggtccaacttaacataaattttctaaacactacaataggattatgcattgttttaatttatcaatccaattctaatcggaatttctaaaatcgaaccgaaactgacatagtgacatagctgcttgctgaacgctgctctcgatcctagtcgccagacgccgattgcccccgttggacacgggtccccaatcccaatcgttgagtcgtcgagttacgaaagaagcactcgcacgatcaatggtgtagtcaggatgggaactgggaaggacggaagctgaaacaacaactcgataaggcaaatcaactaatgaaacaaaagcatcgttcttttctacgtttgcatcagaacaggggtaataggcatttgggctagattttactgtgttccatggcccacacggaccaccatgtggctccgcccctgtaccacaggggccagggcacaactccgccatcacctaccacgttaccactaacttcgttcatctcacagcgagccaggttagttcgaatgagtgaattgttaccccttccaactttcttattccacttttctgttttttaagtgcaagtgcatgctatgtagtttagagctaatgaattttataatagctcatgtgctaatgcatctaacactccaaagagctaccacggctaatatgtagttgcaaattcacacaagaagtggaccagcgaagccatggcaaactaacatgccatccagtgggttgtagaggtaattaagatagagagaaatggaagacatgattaactgtttattactagtgctactgatttcctatgcataaattcatattattttatatatacatatatatgacatatccccgtatgcgtgtttttcaaaaaatgtcgtactccccgtatctgggtaacatagactgtaaccatccaacctcgttgttgccttggcatgccaaataagaaatccaatataaaacccaaagcaccgagtagggaacaaaggagatcttcgatggaatagtttgccagtcaacttcaacctaagatgtacctgccagaccgcacgaaggcggcgactaaatgtgttacacatctcaggggacttgactgaaagtgctaaattccacgatcatcgcaattgctcaaaactcttactcgtgatcagctagcctcaggaagttgctagcttcacactttcatcttagctagaccaccaaaacacaaaggcctaagttaaacttaggaacaattaaagacatagaactaaatcataaatataaggccgaccagccaatagtagaagtttagcagaaagcttgtctacccttccacacaagcaaaccgactaggggtaggcccctagttagaatcatgctgaaaccctcaacctaagcaacaaaataatcaacaagcaagagtcggtacattatataaataatgtattggcaaagccacgatcaaacctatgcaagctctaaatcaaaggagggctatttgtggtttcattttcagcacaaagcaaattttgtttcataaacattttgcaacggaacttataacacaagttaaagcatgtacatgatataaaacattgtgatccacgtaagtaatttcaacaatataaatatcatatccacacttgcaccatcatgccatcataatcatcataagtatcataaactcccaatcccatggcctatttcacacatttaaaagaacaaaactatacttatggcgcacacactatgccgctcatgaccatgagcatggctaatcgattattttagactctcaagagtttgtaaaaaaccacatgatgtgaatcgctctaatttatctggtacccgtcggtatcaccacaccttgcctattgaatgcggcctagaggtcacaatgagggcattacatttcccaccagcacagatcctggtcttcacctgcggcatgacggattcgcaaccagttagtgccccagatcaagccgccatcatacttgcacagctcagctgccactgggcgagggatcggcagatctgcagagccatcattttcatcttctagtgaagtcatccctccaaggtgttagaaccctagctcacgattcacacaagcacacaagaacaagatgatacgaggaactcgattgatagatttctctctcgcgtccaaccggaccgagccaccgtcgccaacgccgccgccgagttccaagccaagttattacaactgttgttttgcgtatttataggatgttctctcctcaccaactctctctctctctctctctctctctctctcttacatggccaagatgggccgatacacagagatggttcatacagcccagtcaggtcccatgtacttcttgttccttcgccggatgcgttttccccttggtaaggcgtcttcctccaactcgccttcagactatacgtcgtcagccttgttgtcgtcttccccttcaggtccttccttctcttgggacttccagctggtacttccttgagctctaacacaaggtgagctggacaacaagctgaaactctgatccattgttgttgcggcggcacagtagtatcccagcgttcctgctcccgtggatgttgatgacgacgccatgagagcaagcggggagcctcctgagatcagccgcagcggcgccagcagctgctgcagggtggttgtagcggtagacgaacagctcttcgcagaggaggcaatgtatggccttattggccggaaactcgcccccccccccttccttcacctggttttcttttttggcaccgcattaattttctattttagtaaatttatgcacctaaagtttatacacctcaagtttacacatctaaagtttagagaccaaaagtttacaagtcaaaagtttatatatccaattcaaatttgaatttgaattcaaatattttttatatatagtatttctatacatctaaagtttatacacctaaagtttatagacctaaagtttatatacccgtttcaaatttgaatccgaattatatctgattcaaatttgaatttgaattcaaatattttctatatatagtatttctatgcatctaaagtttatacacctaaagtttatagacccaaagtttataagtcaaaagtttacatacccgtttcaaatttgattgaattcaaatattttttatatatagtatttctatacataaattttttcaaactttttttaatcttgtggtgtactgtagtaggaagagaaggaagggaggaggaaagggagatccgagtgtataggggaaggttgggaattgggatcggacgatttcttagagcaagtttaataagagagccaactatgagcttatagcttatattagagttaacatgtatagtaaatgggctataaggttatctcttttttttcttctcctctctctatctctcacctatgtatttaatgtatctatcttaaagtatgtgaatagctagctcttgcatgaaagccaatcctctccatttttcaaattctctttcctccacataagcttatagttggcttatagcctactattatacttttttttgaaactaaaccggcaggagaactgccaattatattttcaataagcaggagtaaaaaccctagacgggttacaagaaaagaaaaaacaaccaccggctggctgaacagctgcacagcacacgccagaactcactagcaactgaaaccattgacggagcccaacatagaacgtcgttaccaagcttgaccaagacaacaaaggggttccgaccttgcaaccgtgtcatcgttgccgagcttgtcgcctagcgacacagcagctccgacttcaaattggttgcatcatccatacctaactcgctgtcaatggtcaagtggcttcaacttcccacgaagaacttcagccaaagccatctaaacgccacatcctatccacggccaacagcaaaacccctagaaagagaatgcaacatgtcatcgttgcctagcttcgtcaccctacaaagcagctccgacttcacctagcaaacacaaacaaggagcgaaggtcgcccgccgcaaaacaaaaagtgggactagacagtgaaggcctcgtcaaaaccaagtactgaaaagcttcgaagccaatgcatagaccattaatgacatccttgcatgaaaaagtttctccaaagcggtgcctccaaggaggacacgacgtggatcgccgccaccgctcgtccggaagccagagccaggttttcacccggagaacggtagggaaaggagagagatcaacgccaaaatgacgcctccaaggaggtgaatgacgccaaaaggcgccgccgtcgacagccggccaattgcacagcgaggctttcgccagcgatttcccgtccaaacccacacaaccagtccgcgcaagatgatcgtcgccggtcggctacatcgtccctttagcaatcagtcctaggctaccgcccgcagctccggcagactcgccagaccagccgcagcactggccctcctgccgcggccacccacgcctcctgctgccctctaaccgccgcccttgtcgacgcgtcgtccactgccgaggagccaccggaggggatccggcctccctcgccggagaggccagatccggactgggggtgccggtgccgaactagggggaaccatagccggcggcgccgtgtgcagctaggcccatgcctctcccaccgttagcgccgcccccgccgtcccgtcgccgccgccgccgcctcctctgccccgccaccccggagccggcctccttcgctgcgggcgttggatccggcctggagggagccagatccggcggcggccaggctctctgcctcgtccccgccgccagcgacgtgcctcctccgcccgcgccgcgactgccgcagccggcggccttctctgccggcacctcgctaatgcggcgtggccgacgccgcttcgtctcgatctggccgcgggggggccagatccgctaacggcgacgccggcactactacctctggccgtcggcgtcgccggagccgcctcaacgcgtcgccgcccctccgcctgtttcccgtcggggccccaaccaccgggtgttggagggggtagaatgccccgccgccaccgtccttgccgctgcccggctttgccggcggctgctcaggcggcggcgaggtgggggaggcgagggagagaaggccggcggcggggcggcttcaggtcgcctcctgtgtcaccctggagcggagcgacacgggggtcctctctcaaagagagactattatacttgctcttagggtttgccaaggtaggcgcttcgagtggtgaaaggaattgaattttaaatatatattgtttatttatttattttttttcccagaaaaatccgggatgtaattttttggcataaatatatcatcgtcgctgagtgggagttgcacaatgatggttgcgcaggagctgctcgaggaccgtgctgaggaatctctatgtaaaaagaatcgatgttgctaataagctgcaagtttacttgtaactttgtttatgatacccttaattttttttatttaacaaaatgaagtgtgcatttgcttgcaggctaaaatatggccttcttcgccaataccgatgggtggagtggcaattagcttcaatatctgatttgagatctcacatggcaatataatagatgtgctttgtgctatattttgggtttgagacatggtgatagatgtgctgacgtgctgtgagtgtgaggtatattttgggttcaatatctgagttgagacatagcaatagaggtgtttctgtggtatatatttgggttgcaatgttttagggccattgtaacggtatatttggaaaaaaaataatttgtgaataaaatttttatatacacgttcttagcaatctaaaggctaaaaaataaactatgataaaaaccaaatcaactttaaatttaaagttgaaaattcaaattttagcttattagcgtataagcgaaaagatgagaccgtttgatagctgctaggttgcatctgtagcctattgttttgggttgtgttattctaacactgtcaatcttaggttgaaatgtttgatatatactcactcgatcttgacattggaatgaaatatgcgactccactgcatcttctttgtgagctattcaatgcatcaaatttataattgtgttttacattgctcgtacacgatatctcaattttgtgttttttttaatgtttgtacatatgtctaaaactcttcccccgtccttaaaaaaaaaacctagagaaagatgagacataacataaaacaatgaatctaaaccagattcgttccgtccttgcctagtttagcttagggaatatttttttcaaaagatccttgaaataaataataaggttttagcattttctgtacttttcagtgtcggcgctgtgaaatgtaagggtaaaaagtctaaaaagtaggttagttgtacacatgctccagtagtctttccggtgaaatttggcatgttatcttactgtttatcgtcgctgtgctgacatctgtaagtaagttcatgaagacatgacaagcacttccataactgtcacattatgaggaaattggggactatgagacgatcgttaaagatttagtggctgcttgcaaacagggactcactgagcactgaaaataaactgttgcatgatctgaatagaacaggtccatcacaccagatggccattaggatacacaagaaaaacgcagctgatgcagtcatcttttattcgatgatgctccgaaggaaatgcacaggtcaagcctcgatgagttttttgtttggacaaaatccctaaggaaaaaactaccacctgcttgatggccaaatgtgtgcattcataaacaaggacgccgtagagcagtctggtgctaaaaaggtttaaatgaaatcatctgcctcatcaaattcttattatcagaaccacgaggcatgggcgtccttagtggtgatgctcgtcgtcatcatcatgtccatctggatcaccaccatcaccaatgaccttaagctgcaaaaggcgagcaacaaagatccattaaagaacaatagaacattacagaatcaaaacagcttggaactgtgagctacattcaataaaaacagttactaaatacataaattaaagtaatatgtcaaacaacgaattccaattaccacaaaatattgtgaacagactgggcactcatgcggttcatcttttttcaaccagaaccatacaacatcatgctcatcctctgtaaatgaaagaagtgaaaaaatgttgataccagtattgcataatatttggcagtttagagttttcgctgagccaagtcaacactgactgacctccttcaccaccaggacaaccaactatcctcttgttatagtaggattcaatgacagctggggcctcctgcaggtaacaccatagcaaattgatgaataacatgacatggtgctcaaatgatgctgcaagataataaatgaagagactaatgtgccatggttcagatccagcatcatccttacagccaatttaaaagaatagctccaaagttgaaatttcatcattttaaagcaatcgcaaatcacaatcagtgcaaatcatccccctcaggccctcactctaaaccacccatgtttaatcaacaagacatcaacatggataggctaccccccaacccacacacacacaaacaaaaaggtgtaacatgctgcaacagattcaaaagacttaatcgtagcagaagtagaagtacaggaaaggtcatggtgagccaggacaggctaaaatcagcagggaatacttgggattgtgcaatctatcgccacctcttgcagcaccctgctgcccattgtggctgtgtttgcagaggtcaaaggaccatgttcacacacagcgtcaaggaaattaaggaaaggacttaaggcttgatgtacaggcaagaaagaaaccgtcaataagaataaatcaaggtcccgcctctaatgttcttcattactctcctgtctcctctgcatctgtatctcaacaaaaagaaatccaggttctcatcggcaataattttctcactaccatattctacgtcttagaattgaaaaaaaaaataattttcagttgcacttccattgcacgctgctaaaccagagtctctgtcatcatggcttgcctcctgactcctacatttgggatgtggagcgtggcaggtgatcaggattgggcatgatgcaggtggctactactttgtacacagaagagattgagtaactgataggatataaactgggctggattgattgaagcggtggactggtattgctagctgaagggcataaaacaaagttctaagagttgagtagttagattttgactccgcggaaagccaacagggggtaaaatgggttcagttcaaaataagaattgtggacaagtaacatagaaacctgtttccaacaggaaaagcaaacagcaatggggaaaatgaatgacaggtaaattcaaataagtaacagtacgatgtgtcacaaggatataagggagtgtaacacagaagggagcaaactaggggaaactggacgagtccctcaaacagacatttgtttattgtacaaatacatgaaggtgtataaatatgctcatttacaaatatttgatgacctctttacagatgaaatacagatttcggattaaaaacgcaacttgatatttaatgatcacatcactgtctataaattgaccaagcttgtgtggtctgctgtgataatactaggcattgagaaatcagaattagagaaaaaaaacatgctgtgataataataggcattcagaaatcagaattcaagaaaaaaaacatacatagtactaatgttaaaagacttggctacaggaagaggaaaatcatccaaagaacaggtgggtgtggtgagggcacagcagcggatgtatgctggttcttgttgagccacttcacacattagtgtgtcgttatttttttctggtatacatcaagaggtaagcgaaacacctttgcaggaacagaagggcacagttcaccacctagtggttaccctaataaatttggcacgaacactaatgttcttgggatagtaaaaaaaaatttaaaaaaaagatctcaccactcttagaacagaatagtcaatcagatgatttgcagttaggtgatgtacaaagacattctacaacaggtcaccaaatatccctgctgacatcaagaggtaagcgaaacacctttgcaggaacacaagggcacagttcaccacctagcggttaccgtaataacctactaaatttggcacgaacactaatgtttttgggatagtccaaatttaaaaaaaaaacgatctcaccactcttagaacagaataatcaatcaggtgatttgcagttaggtgatgtacaaagacattctacaacaggtcaccaaatacccctgcttcaaaaacaggttttcatagttcctattcaatctgagacatagattgccaacttaacaaaaaatctaagtatcaggactaaaagtccttgcattgcatagctcaagcatttaaccacagtaagtttgtagtccactaccatatcacaaatgcaacaacaaaatgaagttaacatactctcaccgccaaacaatacttataaacagttcccagttacaggtaccggtttgctagatagctatagaaaaacagattaatgcaacattcccaagataatgttcaccattcagtctctaatttcgacttcgacaattgtttcaacacaaaaaaaatgcatattaaacttgatatttctcagcaactaatgtttatttaggtgttccagctagtcaaaagaatgtaacttaatggcatatccaaaaaacagtttcaatgaagaaaaggcaccccaccaatatgcatattaatcaataggattgggtcagccatattagtttatatgaaaggagcgctgcgtttctgatcaaataagatagcacacactgtgtaaacattattgtgtatcctgcaccaactactcatagaagtttaaagaaagcatccctacaatatatgacaagaacttatcataagtagcattagtcataacatcgcaaactgccaacgggggaagaatagtttgcaccaatatattaactagtaacaatcatttgctcaataatgtggaacaactattgatgctttagtagacaggcaaaggcaatgaacatggagatcaaacacattgcccgtcatagagtgaacaagttttacaacaatggtgcattgaagaatagcacacgaaaacaattcccgaaacgcattagtgtatagaaccaggcaatatagcatgactactggcaaaaaatgcagtttctccctcccagcacaacgcgaatcaagtcgaaggtaatctagcaaagcattcgcaattcatagtttcattaaattcagctctaataaacctaaagctaaggaatagaaccaccacgtatggtgacgatcgcagattcagaatttcagatcaacagaatcaatagaaaatatcctacaactacgaccagcgaacgcctcaccttggtaccaaatgggcctacgggaggatccatgtcgaaccgcttctccccctgcgaaaccacagacagatcggcaaatcacgaaacccatttccagaacagacaaaaaggagcaatactccaacccgaagaagcaaaaaaaaaaacgaaaaaaaaaaggcataggcatctccaccttgagctccgccgcgagctcctcgcgctccagccccgtggcgatgggcatgacgtcctccaccgtcgccggcttgtcccctgcagcgcgacccccaaccaccgaccgatcagcgccgcccccaccaccccacggaagcacatccaaacacgcgagatccgaggaggagagcccttaccggacaggagagggctggtgcggcggaaggcggcggcggccgccgtggagagcggcgcggcgcgggcgagggaggcggggcccgcggcgcccgatgccgccgcggaggcggaggcggaggcggcgcggcgcagggccggggccagggtttggaggcggcgccacatggcgggcgtgcgtgtgctctcaggtcgcggcgccctcggcggcggcggcgggggaatggggaggagggaggaggaggcgaggcgagatggggctctctctcgatttgatttgacccggatgcggacgaagacggcggggtgggatggggaggaggaaataggagggagaggggggaggtgtgtgttttgggccagaggggtgtgtggcctgtggcgccgccagaccagtgtaaattcggctctgccagcgtgtcaatagcaaccaggaggacacgctattgtttggaagaaaattgggttaattctatttatgccattacaaatgtggttattaaaaaatatactattacaattcgtatatttataaatatgccattcaaattttataaaattagaaccatgccatcacaatcttcatccccatctacacgtggagcctactcttcagattgatcttcctcctccaccctcccctcttctcttttttccttctttcttcccatgtagagcagaaggaagagatgagcggcgcgccggtgctccagtggctgggaggtggcgacaccggcggtcaaatgtgttaccgagcttggctcaatcaaggaatgtgttgcccgatacaaggagctagagagatggccagaatagcggatggaagggcttggctctggcggcaaagaaggtgatggtggcggcgggatagggtggctaaaagagaggggaaactaggggaatgggttctcctcggcgggacaaagccggtggtgcgaggatttggtgtgaggggagcgagtcattaagattaaacacaatcactaagaaaatagatagaatataaatatggaaaatattatgattggacgagaaatggagataggtgaggaaattaaacggcgaaagattgagattgatggtaagaaaatgttagtgaagaagttgttatattttaagataaattttgaaggctagaagttattatattttgagacgaagaaaatatgataatatgtataaaatctaaacacaaatgtactcgagttcttcacaattcacaaatgaatttagacgttcagatttgttgtattataatatgtaatagattagttttctatagaacaagaggactattccatccgtcccattttaagtgcagccatatatgattttccgcgaccaactttgatcgtccgtcatatttgaaaaatttttgaaaaaaaaattaaaaacataagtcacgagtaaagtaatattcatgttttatcatctcataacaataaaaatattaattataaaaattttcaaataaaacaaacaattaaaattaaacatagaaactcacgtttgcacttaaaatagaactgagggagtacgtgtgtgtgcaggccgtatagctttgcctgcaaatatcttttcgctctatagctttctccgagaagggacaaggaagtgaagccaggccggctgtggtagaagcagcacaatacacaaagaaggggtacgtaaggctaatttgctaggcacaatttctcaacccatccatctcgacaggccgccatatcggttcgatttacggtctataggaatatccacatgggcaatgcattctaaaatctcttatttttataaagctaatacttactaaacatgtaaaactcaacatgaaaacatagtatttattattactcctataacctacatgcaaacatgttatatcaacccattaaacacgtaaagctcaccaagtaagtatatagtaattatatctataaattatttcattttaaaactagacatacatatactaaatcatcattctcaaattatttttataatattttaatccaaatcatttcatcatttctccaatatgtaatatatatatcccgcagcaaagtgtgggccatcatctggtagtaggaatatcgaagtacagattaaccgtgaacaaacaccttttgatttggaggaaaaacattgaaaaattttctataaatatctttgaaacaaataattgaatcatgtcctatcatttgaaattcctatggaataaacaatcccaaagagattttaaagaaaatttagcaataacttcaatatcttggaaaattttcttttagtttatctctttcatccgattcctatgtttttcatgtggtccaatcaaacggtcattctttgtgtgtttctgtgttttgtaatctttctgttttgcacttatattcctattaaaatcctgtgttttccctagttctccgtttttcaattcctgccatttagagtgacggttctctccgtttttcaattcgtgacgccatcagtgaattgtcgcggatgcacccgctccgacggtgaataggttcggctcgatcaacacgggcgtcacccattgcctcctcaagttggtaggttattctcgttggactgacgttggaggtggcgatatggtgccgacggaggagttagaaccaaagtacgatcaaatccccaccgcttcaacacggatataagaaatacagaaagtgatcccaagcaaaagagaagagacattctcaatggtgtccgtagtaagtattctcaaattataggaactgatgcaaatagaaataggggtatcagatgcaaagtgaaatgagatgagctactagtagtaacacatcccggttagttatttagttacaagctgatacttctacgatctagcaccaaggcagtaaactacagctagcatgttatcagacttacgtagctgggcgtttaagcctccttgagttgtgatttttatcttttgtaatcaaggatctgtttgtattctgttttccttcttaatcaaattccggctgagctcctgctgtcgtcttcaaaaaaaaatggagagtaattgaagtcatgactggtgctattaagctttaacaccacaaatcatacatggcatatatggcttcttttaaagaatatgtttcggtactgaactgactacaaggttacaattccactgctcaccactaaattgagaggagtcactacagataaattctcaagcgctgtgcatagaatatgtgtaaggtacagcaaatgctacagaaaaaaaaaagattaggaaaaacaacatctctaccattaaatcatacaggatgcaatgaatacatgttataaatctattatgatggcgttgcgataaattatgtttatgcagttccatcaatttattttaaacctagcgactacaggtaccattggcaaatgaaggccaatggaacgccatcttgcataaaactttcatcatccaatgagcgcaggtccatcagcattaaaatggcatcctaatttagacctctagcagttcaaaacacatagtacctacaacaatagtaaagaaatggatctttaaagagtaaagtgcattgcgatatttaaacttgtagggttgtatcatataggtccctaaactctcaaaatacatatccaggtagcataactttttaaagtgtatcatctagatcccaaattagcacatcccctctaagatcctacgtggcgctgatgtgacaatgccacatggacatgacgtgtccgtttctcttttttttttctttttttttcgttttcttctcattcttctttttttttcctttttttctgcacgggtcactaataaaggagaagaaaggggaaaaagttaaagaaaaagaaaaaggaaaaaaaattaaatggatcctatttgtcagtcaaaataatgtcatgtcatgtccgtgagacatggcacatcaacgccacgtaggatcctgaagaggttttagcgatttgggacctagatgacacactatgacaacaagttctgggacttagatatacattttgaaagtttagggacctagatgacatatccctataagtttaaggaccgcccgtacactttactcatctttaaatctcacaggttcagtggtttcctaatttcaccccttcttacagctcttaccactacacacaaaatggacaactcagtggaagtaacaagtctattgatatcagcacagcgaataccataccacctccgtagagtgcacaacactaaaaaaaaaaaacatgaagcagctgatctaaacaccatgagggctaaaacataaaaagggtagcgcggcaatgccaccctgcaattctagttgctcaagctaaaaatgggcaagtgcaaactgtttcaagaaaaagggcaagggctttgctatttattgaaggagaatcaaacatatgttcctcatactccctccgtcccagaatataagttttagagttgggacacggttattaagaaaatagataaaagtgaatggtggagggttgtgattggatgagtagtggaggtaggtgggaaaagtgaatggtgaaggattgtgattagttgggaagagaatgttgatggagaagtggttatattttgggaatcccgagggctaaaaattgttatattttgggacggaggaagtaagtcataacataccataaaacggttggggttttagttcctatatgcaatttgatcaaaaagagtaagataagtcatgccgaaaccaattcaagtagcagagccaagagagacaatacatatttgtcttaggtcaaccagaccaacatcatgcagcttaaaaagagcttccacagatcacctcgaatgcttcgactcctctcaactctataggttcaattccagctcgccgagacctaaaccaggcgttgtttcgggaggcggcatccgttgtgtggaagctgggtcacatcgtggataaacaccacaggagattgctcccttactctttcaccccgaaagccttctctgaagctcaggatcactttcttcttcttattgaagaacacagttcctttcactttcatcaccacggatttcaaacccatcttcctcgcggctcgcccgacatgttctgcggttgcttcagtagcatatttggagagacgagagcgccctttcttgtcctccaaacaaccagcggatgccccggtctttctgttcccccgaacgtctgtcacggtcacaaaggtcttgtttctcttgagcaagacatagacaaaatctctcttccctttcaccagagattgcttgtgttcgtcaaagatgtgtgatggggtcccgaagtaggagggattctcgccaccagctatcctggaccttaactcgggattaggaggaatgagcaaaatcatcatcagcagaacaatgcagaaatcatatgggcgcatggaaattaccatttgcctactcccatcgtgtcaccagaacgcggcacattggcacggtagtcttgaggcagctgctgtgactccatgagacggtctccatatgaaggttggcgtgtgtcgccgccgggcatagagaacaaacccatacgtgaagcggttttagactgaggaggtgggaaggcggcggcggccgccgtggagagcggcgcggcgctggcgagggaggcggggcccgcggcggaggcggaggcggggcccgtggcggaggcggaggcggcgcggcgcagggccggggccagggtttggaggcgtgctctcatgtcgcggcgctcgcagcggcggcggcgggggaatggggggagggaggaggcggcgaggcgaggcgagatgggggctctctctcgatttgatttgacctggatgcgcgcgaacggagacgacggggtagggtggggaggggaaataggaggaagacgggtagggggcgcctcggggttcgtgcgggcgtgatggacggtctggatcgggtcacgtgatgagggtatgctgtgggccagaggggtgtggctagtggtgccgcagaccagtgtaattcggctctgccagcgtgtcaaaatcaaccaggaggacttgcgggccccatcgtttcgccaaaatggtttattagaaaataaataaatttattggtaaaacttttatatatgtgttcttggtaacttaaaaaccaatgctgaaaaagaaattacgttaaaaaaaatctcaaaatcaatcctaaaattaagtttaaaaatttaaaatttgacttttttttttcttaatgggatgggagccgcagtttagttggggggccgaaaagcctttcagaagtccagcaaaagccggcaaggcgccgccaacgccgccgccatcatcgccggagacgatggagaccgcggtgccatggaaagtcctcgagttctatagcggcatcggcgggatggtactaacacccaacccaccctctccaccttccccactgcgaacttgcccgcacctgtctaacggcggctagggtttttgcgccacctgccctcccccgcagaggtactcgctggcggcgtcgggcgcgcgggccgaggtggtggaggccttcgacatcaacgacgttgccaacgatgtctacgagctcaacttcggccaccgcccataccaggtgcgctcggtttcttccccaaatccatctgtggtatcccaaattggaacctaggagaaaaagcttctggttagattccgcagttttgatttggttcggctcagatttaggagtagcacatagaacatggtattattgtgccaactgcaaaggtgatgagaagtgagattcagaacttaagctgctcgaccagatgtttaggctgagattcagaacttaaactgcttgatcagatgtttaggcacttcttagggagtatgcttacaagttttccacagaatttatgttctgcctagaatttctcaattagtagactgtcttgatgtatttgtttaaactgtccacagaattgcttacaatctggttgatttcttttgagtatgttgtgttgttttctataaccatttcacatggcaagggaacagttggtcatttgccttcctcatgttcatgtagtcattctcctggctcatctaccctgtcctgcagattaagcatatcattctacctgcatgatgattcttgtattgaattgtctaagtctttaacaatttcattatctgaactgtatcactgttatctaaatacagggaaacattcaaacactcactgctagtgacctagataagtataaggcacaagcatggcttctttctcctccatgccaaccatacacacggcaaggttttcttctggagctttctttcaacattatctgaccacttttcaaatttcactaatggatggagtatcgtgtaggactacagaagcattcagctgatgctcgagcattttcattcataaagattcttaacctaatgaaaaacatgtgctttcctccacaaatgttatttgtggaaaacgtagtcggatttgaggttggtgtaatctttggtttctttaaagcactattcttgaccgcagtattttatcaagttgtgacccctatttgtttgtgacaggtgtctgatacacatgaccagttgatagaggttctttcagatctcaatttcaacacacaagaatttatcctaagccccttgcagtttggtatcccatattctagacctcgctacttttgtctggtaagatttctggaggatctttcctgttgtttcaatgtgatctgtcacttgacgttataggacatgacatggcacaaatcttattgttactattacatatgtgcatagcttccaaagttcacaaattgtggaaatcagcaagggatgacttgggggtttgttgcttaagattggtaaaaagattgtatttgcccaagtgcttattaaaagaaaaaccataggaaattagtctggtgtcactacaaaactgagaaatcatgcaataaagttcctgataaaaaattgctggataataaactctaggttcttcaatagttcatttttgttcagctaagcaactcttcatttatttaacagtaccttgtctataggcgaaacgagaacctgtgagttttcaaaatccatcagacaacagcaagctgctccggacacctacattcctaacattggtaagggcaggtcacaacagatgtaacccggatgaagatgagctggaactagtatgcaaaccaatcagtgacttccttgaaacaataagtctgaatgtcgctgatcaggattcttcaggtacaatctctgacagtaagttcaataagcctataataattaccagtatctcatttgaacatgcaggttaaaaatattttttaatgccactctatattttgtagttaatgggtctgatggatgcaccccaagtggaataatttctcaagattatgtagtcccgctaaacttgattgagcggtgggggagtgctatgggtatcttttttttttcttagtttaagactcctgaatcaatcatttaatgatagattattatgttttactgatgcttggctgtggtgtctcctcgactgtttgcaagatattgtatgccctgaatcaaaacgatgctgttgttttaccaaaagttattatcgctatgtcaaggggacaggctccttactagctacgtccaatgtaaggctcattatattcaatctttcatctgctttgttttcaggcatccctggtgttgcctcttaatctgaacattcatgattccttttccttttatgattacctacttaaattacagaacctcaaacgaatttccaaagaggaccttgaaatttcttcactgaaggagttaggcttacgatttttcacccctcgtgaggtatgtgcttattgacaacttcacataggtccacacccttccgtatctatgttttgtctcatagcatgcaatattcatgatttttcaggttgctaatctgcattcttttccatcgagtttccactttccgaatcacataagccttaggcaacagtaagttttaatccctaccttttactctgttggaactcaatgaacttcaggaacatcataatcgcaatatatataagaacatgaatgtgactttctagttttgaaaaccagaccgcactgcctgaattgtttgttatcgctaacttacctatggtggcaggtatgctatgctgggcaatagcctgagtgtagcagttgtggggcctttgctgcgttatctgtttgctgagacatagtgatgttcaatcagttggcacatgatgctacacaggacaaacacattgaccttcctttgcccgtgttatcaccctaaagccaggttggttcgtgggtatgattcgtgtactccccgaagctgatggttgtggttcaaaccttgcaacccaattggagtgaatttcccacagtggtgcaacttcaacttcatagggcttggggacttgtcgattcatcggtgggaagaagacagcgtgcatgatggcccggcatgtatcggtgaaactctgacgcgaatcttacctagtagagtagagaagcttcctcagcattttccctttgccccaggcataagttttaataataatgttgaatgtttgaggtgttacagcatttgactcatgcgcattgtgaaacgaggttattatggtttagaactgaacttcaacttcatgagctcaccattcgactgtctcaaatcagtttgctttcttgatctttctgcaaagaggcaatattttgacgacacatttgccccgtgtacctcagttaaacagtagatctgcattcgtttagctatagccaattcttgtgaaaaggaagtttgaacatttttttcgtgagaagtttctacccttaaattgataaattgaagtttctcaatccctttattttgttctacaatatgaacaaaatgttttgagaaagggtcaggactgctcgttaacacgtggatcctcagttccacatgtcaatgtgcagtgtgtgtacagcaccgttcgctaacacaggtcccacagacactcgggcctacatgtcagcgaagtgaaatgtttcaccatgatcgatgttaaattgttaatctaccagcagctccaaattcaagaatgtttgagttagaaaaacacaactgaaaaagggtctatcttttattttcaaacttaaatttagagctgattttaaggttttttcatcaaaatttaattttttagcctttacttttaattgctacgaatacttatataaaaattttatttacaaattactttttatttgcaaatatgccgttcacatgttctctgcttgctgagaagtgagaattgagaactgagaagacagtctccaagatatgcattgcacagcgcgtattcgtcgcaggaaacggcggcatatgcaagcgagagcagagcagatctaaacccaaaacaacgcaaagccctctctcctcctcctcccccgcgacacgacactgtcgacacaccatgcgccagccacagctccgcgccgccacctcgcgcccgctctcatggcgctccaactgcacggctgctgcggcgtccgcctcccagccgagcgagccgctctccgcccacttcaccaacggccggcccctctcgcgcgccccggccgtggtgagggacctctcctcggtgctccgcgcgatcctcgccgcctccccgtcctcccacagccgcgcgtacccgctcctcaagtccgccgccttcgacgcccgcctcgcgccggacgcgctcgtcgacgccgtcctctccgccgtgggcggcccggggtcacggcaggccaccgcgctcctcagccgcctcctcgcctccctgtgccgcgccggccgcgctggcgcggccgccgccgcctacgccagcatggaggcgcgcggggtcaccccggacgccaagtcccgcaccgacctcctcgccgtcacggcgcggagcgcgtcggccgcggacgccctcgcgctgctcgccgagatgcgggggaaggggcgccccttggacgcgtggatgttcgacgtggtgatgcgcgcttgcttcaaggaagggatgtacgacgacgcggtcaggctgttcgacgaaatgcctgcctctgagatcgagcccgaccagcgcgtgtgctctgtcgctatcgcgtccctatgcaagctgcgtgacgccaaccgtgctctgctggtgctgaggaagatgcaggatgcggggttcgtgccgtgggacttcacgttcaactccgtggtggatgtgctcgtgaagggagggaggatggaggaggcgctgcacataaaggatgagttgcttgctacggggaagaaaatgagtgtggttctcgcaacaacgttgatgcacggctattgcttgcaacgggaggttaggaaagcgctggatatattcgaggagacactaagggacggtctggtaccaaccgatgtaacatatacggtgctgatcagaggttgtactgaagaggggatgccagagaaggcctatgagctgtgccgccagatgagagatcatggattgttgccgagcacaaatgagttcaatatggttatcaagggccttttgaatgataaattgtggaaggatgctgtaagcttgttcaaggagatggctgattctgggataccagatgccttcacatacaatatactaattcactggctctgtcagcgtcgcaaaattcgcgaagcgcttaacttgtgggaaaagatgaatgaaacaggagtgaaaccatatatcgtgacataccacagcttgttgttgtgttattgtgtgaatgggtgcatggatgaagcagtcaagctgtacactgagatgcctggaaaagggttcacacctaatgttgtcacttacacaacgctgatgaaagggcacataaataaggctgcttttgacaaggcttatgccctccttgctgaaatgaaacagaatggagtctcttgcaatgattatacatacaacactctcataaatggcctttgtgtggttggccgagtttgtgaagttggtgaaatgctgaagagatttgaaactgaaggttttgttccaactgcaatgacatacaatagtatcatcaatggatttataaaagctggcatgatgggctcagcatttgctgtgtatcagcagatgtgtgcaaaaggcatacctcccaacatagtaacatataccagtttcattgatggatactgtaagactagttgctgtgacctggcactgaagatgctaaatgatgtcaggtgcaaaggctcttaacctgaaatcgctgcatataattccttaatatttgggttttgccaagaggggaatatgtctcatgcactgcaagttcttgtccttatgctgaaagatggtcttttaccaaatatttcagtctacaacagtttcattacagggtacaagaatttgaaaatgatggaagaagctttgagattgtacgagaaaatgattaaagaaggaattgatcttgatacagcaacctacactaccttaattgatgggttctcaaaagatggcaatgtaacctttgcattgaaactatactcagagatggtggctaagggtaatattcctgatcatattactttcacagcattaacacatggtctttgccgcaacggagatatcgatgatgctagaaaattattggatgaaatgaataggttagatatacgccctaatgttttgatgtacaacatgttgataaacggatacctccgtaatggaaagctgcaagaagcgttccggttgcatgatgaaatgcttgaaaggaaaattatgccagatgatacaacatatgacatactagttggcatgaaatctttgggaagtgacagtcccattgacgcggagaatcctaatttaagttccacaggataaggatcaagagctggcttgagaagattaaactttccattgtatggccagtgtcagattatgagttttgctatatataaagtgaaatcttagctatggcaaatagaagcaaaggtaagcattgagattcagttactaacaagaattcaccttttattattatgtaatctctattttaccattggcactttgtgattacttctgtactatacattaatttgtgtccaatcaatgtacatgattttccctttttggtattattgttgaacttcgcaaaaaaaaaaaacacttagagcttgattataaactgcaactgataaatttatcttttatgtgaccatgcccaacacatctcaagtaatggcgtctggttgggcctgccttgaatggtcaataactcaatatatcctctgtaaagaaataagtttgattgctattcatgaccttggtaattttgacatgtttaatatctgcatgagttgtttctagttgtactttctgatctattacctatttacttgctgcattcacaagataagagaaatggcattattgtcggacctcaaagatccataatgattaatatagggtactaactagactggagacttatgaggaatcctaatcttgcatagataaagggatgaaccttgtttcctcatagaattagcagaatggatcaatgctcttctgggctgtagaacccgacaatagaggaaagattcacctagaaagtttgcttaacaccaatagagcaatgaacaggacatcgatctaacttctatgccaaataaatttaaaaaatactaggttttgtactgtcattgacttctggtgtttcagaaaggtcaattcgtcaggtaaattgtattgagactttcaaatttctgccattttcctaaggtaaaacacgatgtgtgtcctcaggtttttgttgtgaacaaatgcttacagttaaccagccaatgatgaaatctttctaaaagcatgcatgatttgtgcttacaattagcagaatggatttatctgtgcagtctgcataactcaggctgttgtatcggcactgtcaaccttgaggggagggcaagcgttgattgagctgaggatggtgaggggcgtgttgctgtggtgcgcgagtctgttgatcatgttgtagaacatcacccttgcctgcagtgtgctccctcaccaaatccagaaattcatcataaaagaggatggagatggagacagatggagcagctcatgtcttgattcacctgatgctcactacactcacattacctcctctactggttgttcggagaggcaaggggcggctgccaagagaagtaactagtagaggatgatcaatgaacatctaaggtatttctaccttgccttgcattatattccataaaagaaagtgtcatctattggactcagattttctacaggacaaattccataaacaaactgtgcagtacaactctctgtctggtagcaggtataataacaatatggtaacgtgtacgtgaaaatagacatgacctattaaggattttctcacctatatagattgaggagggaaggacacagtggctgagagaatattacagtttcttaaaagtcaacatcaccctcatcctggttaacttcactgccgttcctacacatgattcatattgcgtcctcttttttcctgattaatcctgtgttactgtgggttattactttcttctgttttctctaaccccgtctgccagtgagcatatgtgcttgtttttatgtttatgtttgcgttgtgctatcttcggcatgctccacctgtggagctgagctgccgacggatgcatgtgagtagcaaggtgtcgctgcgctgggcgttgcggacgagcctgcattgctgtcgtgatggtttctctcaattcgccaaagagtagtccttttttttttttttgtgtgtgtgtgtgctcccttacctgtgccaacttaaactccttcattgctgtcttttttgtcagtaactacatatcatgttaacttgcttatgccagatgctcaatgaacgctaatcaaaggaggatatgtttgacaatgggacaaagtcttaaaacgctgtactggctaaagaagaacaaatatatggaatattggaatcatctgccaggcttctctgggaggtacctccaattgaacttatttatctgtttgcaaattaaatggtcttctcttatatttgacaccgcagaagaaattaggcatccagaattttgttgtgattctaaaatcttgctataccattttgttatgcagcacatctccattcttgacagcttttcactcgtgtccaaatcataacgattttaccaaatataaggattctagaaagcttcaaaggttatggtttgtcgttgcaattgccaatgtctatactatcgttcacctgcctactgttgcctacaaatcaatagaattattcacaacaatcgtctgaggtttgtgactgtacagttcacctggatgtttgcacataacccaggtaatgctatttatctgctttggacgcagtatacgctgataaacccattactgagaaaagcactccttttgggctgttgcatgcatgctgagttatttgatgatctggcccttgtttagatcagtgctgctgcttaaaaaaaatatctgctctagagaccaggaaattcaagtaggctcatgaccatctgcagtttggttgttgtaaaaatggtttttgtttcttgcataattgacacctattaagtatttaaattacatcctcaacaatatattctacggatggttcatggtgcttttaaatcttcaatactgttcatgtatatattgtactccctccctccatcccagtttgatcatcacataagatttttttaggttttctcaaaatgatcatcataacaaaaaatattttgtttatttgtgcaaagagtaaatccgcatcgtgaaatgccatgcaacaaacattctattggttcaatgcatataacgtttaaagtgtgaattaatttttgttggacatgaaacgacaaagcaccttaatcaatgaggattaatttcacaatgatgatcgatgaggattaatttcacaatgatgaatgttttggtgtctttgtcttggtgttctttgcttataagatgatcatattgggatagtaagagtattgctttaagtttgttgcatagtagtacaacttaaggaatattcccaacaagctactactttcttgtaagtgaatctcaataagctgctacttggccatactattttcgtattccctttgtcccttactggtatgctgcccgtgggttaaatcttaagactagcaaagctgtaaggctaaatataaatgtgtgtttagctccacatgtcagcacacacggtcctccatgtgggaaatggggataattggtggaatggcctttcccgctttacataatttgagtggttcttcccttttgtctccgagtatgcaagttttccatgttagatgtagagaccagtttaattcattgttagaaaaaaaatgtattgaatcggtacctcaaatctaaaggatttttttttcatgtgtgcaaatgagccgtctaatatgcacaagcagagggatatacagataattctccaatgtacgtgtgatttgattacatccatgtcctgtacctgtacgcctgtcttaacatatatatggccattttccgtgccacttcagcaccaagtttacatatcttcaattgtatctaaatgatcaaggggaatagggttgacgaaatgactctcgaacatatccttcaactcgtggctattggtgtagccgtccctcttgccatggaagaggagggcgatggacatggacacattggcgatccgctgcacgaacgggaggtacacgcggtcctcaaagcgcgcctggtttagggttctccatgcgccttccaccatttcacttatctccgcctccgcgacatcgcttgtcacgccatgctccttcatgtaacactccacggcattggccacgtccatcttctccctcccattctgcgtgccacatattataagtatgctatagggtaatggcgaacacaagattttagctatagggtacaccactactaaaacatatagttaaatagaaaaagaaaatatagtttccttgccgagaaaatcaagtgataattttgacactagtgcaaataaagatcaatcatgaaaaaaaaactctataaaacaactaagaaaaaattattacaagttttaaaaagaggtttatttgatttttttttaaaaataaaaagttctagaaaaaacacaatttaacaatttaaaaatcataataatagaaaacgagtaagttatagtttggagtagagaaaataacaatgcattattagttcaccatgaattggcttatatttttttattcaaaataaccacattgcccctggcatctaaactgaaaactttccatatgggaagttcatcaaggaaaaaaattacttaaatgtttttttcctaaataagatgaactctgaccaatggaatttcaacactcaaccaaatatgaaaaccaaaatttataacattcatatataaagttataaacccaagagtgagcgatctagctggcatacatgcatgcatattagtactagtaagtattaattaattagtacctgtgatacagccaaatcatccatgaaacgtgacacctctccaaaggccctgccagcatcagcgtaagacaaggcccaatcaaaggcatccttggtagctatgtcacccatgcctacgattatactgacaggtaattctatagcacctccggttacgagggacacggtcgcatgctctgtaaagcttggaatgtatttttgatggaaccactcagcttcctggaggtaattgttggataatatttgaaactgcatgtggcaaaaaaaacagagtataattaagataaatacatatttttgaagatgtatgtattaattcttaaagttgctagttcagatttttatacgtaggagttgattgaaaaaacaatttcttttttgtccatttctgttatggacgattatctatttatccatttctaaattataagctgtacataactttgttgaaaagttgtatacgacgcttcgtaccgctttaatgttgtaagcattacgatatttctcatgtggttccaactcatcttcaaagtccctaaagttgctcataatactgagaaagaacctcttcagcccctccggtacaagtgaaacagcattcttatcccatctgcattgtcaatttgagaaaatatgagaaaaccatgatgattttatcaaaactattggttatttgctactactttgggtagtatcttagaaaactataacgatagttgatgattttcttatacaatgggaaaaaaaactgatttgcccctctaaactattgtgttcatcggatttagcgccctcctcccactcccagaaaaaaaaaaactataaaccctatggtacataggagggggtcaaagtgggccaaaaatggaggagacgaatctgattgctgctgctcttcatcccctcctccctcaccttccatcatggtctactggctagctacatgggtgccagattgcatgtttgatgagctcatgctcatgaacaacagaagaagatcctttggttgtccctcttagaacaggtacaatagcaagctataatctcatatcgagaagaaaagagaagggagagaagaaagcggactacagatttatagccggctgcaacacgaactccaagacgttatgcgtggatgagaggtgggaccgagtattaatggtatagtatatttttatagttaactattgtatgaatggctattaaattagctatagttgttttggagccaacagttggctatactattaaactgaggtttagtggcatcagtgccgaggatgctagtcattggctgacacgctttggtcggtagcctcctagagcctattgcattggttgacatggagagcaaaatcaaaaggaattgaagaaggtggaggtgatatgtggggatcggatgccatgcaggaccaaaattgtcttgtattggactcatggtgtattttatctgatattaggagtttaggaggatcaagcttgtggtatcataggtagagcatgtgtaaataggacttttcccttccaaactaaagtagagatgcaaatggttaatcccgctacccacgtaaaaatccgcttactcattttatatatgctagtacaaaatttggaagaaaaaataaactacaagtgggataagcaagtaaaaaaaataccgctagcccgtcccacttacatccctattccaaactaggcatctcaacatccttatacatgcatgtattagttctcaaaatgaagggaataagaagttgacctttgcagtgcttcattgaacttccgagcctcttccaatgtcgcatgcacatcataggtatcatcaagtagagaaattagcataattttcttggcgagcatcatgcgtgcacgtgcgtactctttctcatagtacacaatgtaagcacaaaagtaacactcaaccacacgatcgcgggtgtagtctaggttaatgtcactggaaacatccttccaccacctaaaaaatatattaaatataaattaattctttttctcaatattatgattagtaatgacattatagagtgattagaagacttgccgacaaatatgcttgagttccttctggtgaagtttttgtaaaatgttaaaatcaagcttggctagctctgaaatggatgggttaaatgtatgctcttgtgcagtatactcgaagataaaatttagcgcctctactctcttcaaggtccttggtaatggtatttggagggcacgctttacttgttcagccagcgggaactcaaggctaccacttaataattccaggtgatgggttgcaaataagatagcttctttgagtgccctctcattatgagttagaaggtaagctgcatggtacaaacttaacaagcccttcgggtcattatttatgtcactcttgaagctcccatcttcacatttgaatttgttgaattcgtctgtgtatagcataaaccataaaaattcaaatacgagtactttagaataattaattttatatcttgatttatatatttcttcttgctaatccctgaatctataggagaccatattcaaggtttgtatggaaaacaataacttcaaagaatttttccattaagaataaaaaagatccccaagttttaaataagtcgtagtcaaagtgttatgtatgccagttatttcattcccgaacataaatacatacctggtgaaacccaatacccttgttgcctcagcaagcgaaaccgaagagcaacctcatggaggttagagctatagaattcaatgctgtgaatatttcttagagtggtgttaatctgctcctcaaaatgatgttctattcccaaacgttggagtacatcgaccaggttcatttgtttcaccacatcatccctgcaagcttcaaacattctacctatctgctctactaactgttctgctctctcttccatccattcatttgactcctgctagacacatggaagcatatataacaaacatgacatagagtggatttcataaaactattattatttcgttaaaattgttactttgatacaacttcagcacgatacatattttgttatgaaaaagattataacaagaccaaactatctagcacggattaaataacgtgtgtgcacatatatgtatacatgtccatgccttgagtggttggttgtattcgatgaagaagtcgccgaatatcgttgggtggaaagtcggtgccatcttactagcaatgggagatgacggcgctgtgcacttgcaaggcatgaggcgggcggcgtgcagggaggacagcagtggatgacgtatcatcatccgatgaggaaacgaagggccaggatgaacccacatgcgctgccagcaggaggcggtaggccacgctggagctgcagtgggcagcagcaagagggaagccatgtggctcttcatcccgtttagagcaaaagtgtacactgtcgagtattatgccttagtgtacctagctagtgctggctgatttggcagatgcaatttcaaaggagatgtctttttatagggcttcaaaaccggacgcttgttaactgaacccgaccaaagatatttcaaaatcgcttttgttgtactaaacccttgcttgttggatccagccacaattttctaattggcttttaaaggatgaagagaatacgatttgtagccgtcaagaaagttctcaaagaaaaaggcatcgatcgagaaaatacactccatttatcctagtttgatcatcacctacggtttttgaagtctttcacaaatatctctttacttatttatatgtaaaaagtaaataagcatcattaaatatactacatgcaaccaaccaagattaattcctattggtacaactacatgcaatatttaaaacttgatacaatccacgtgatacgaagcaacatattaccttaatcgatgagaattaattatagaatgataaaggtttagttgtccttggtctctacgctatttgcttaggtgatgatgaaaataggacgaaaggagtatggtgcacttatccataattatatatatacagatccgtttttgttagaattttagtgtgggcattgattaatcgacgcttttaattactaggattttgatatggtcacagataaatggttggtgttcatccttcagtgtatggtaattaaggaatgtgtaagagtgtgtatttctttgtaataagatatagggtatgtatatagataataataaataagctagtccagacaacaccatataagctaggaactatggaaatgggaggaagggaggaagagagagaggaaaccaaataaaagaagtattattccccttttatctatcctaaggttttcttgctactgtacttcatccgttcatattgtaagtcgatttaatatttctttctagtcaaacttttttaatttgatcaagtctatggagtttaacaatatctacaacatcaaattaacttaattaaatgtaacattgaataattttgataatagtatgttttgtgttgaaatgttattttatctctgtacaaacttgattaaactctacaaagtttgatttaaaaaaaatcaaaactatttataatgcatcagtgagggcccaaactctgccccgccagagatgaagagcttgttcactttgctaccatttttaaccttatcaaattttggtattgccaaattttagtaatgttgccaaaattttggcaaggttatcaaattttggcaagattttatatgtgcttattaaaatttggcaacaaactaaacgtagccaaaattttagcaactttaccaaaaaaaaatggtataattgaacagaccccaaaatccgttttggggaaaaacggcagtcaaagaataattttcactgtaagtcggtggtggcaacatttctaccatgcatggaccattattcatccagtcagagactttctactaattttcactgtcagtcagtggtggcaacatttctaccatgcatggactattattcatccagtcagagactttccactaattttcactgtctgtctcaattgttttgagtcaatattgactcaacaattgtccttcgaaaacgtagaaagcctgactgcgtcgaaaattcgatctctaccactgatcttgtacttggagctattgactattcactactcaattgttggctctttccatgagcatgaactatttattattcatccggtcagactttctaattgatcagtttcttgctcttgccgactattcatccagtcaagaaaacgtgaaagacccgagactttatatatacagaatatgtgacaaatcgttaggcacacatccttgtatgatcaaatactgttatatttatataaatagattcctacaaaccaaaaactgggtattacgaaaattagcaccacataattttactacatatggtcgattatagggtcaaatgaacatcgactggtatatatccaaaattgttgggaaaattgtgggctttaacatgtcagttttatgcggctcctgcggtattgtaccgttcgtactcgtgagctttttttgatgtgtaggttgtttctatcgttagtacagtgaatttctgttacaggcttatactactgtggtgcagtaacgaattctatctggtatatcaaccaggtaataaagaaaatatatttttagtaaaaaatattggttcttcttaaggcgcgttctttggttcagtaacgtttcacatctaggtcccatgtaaaaaaaataatatttcaatcacccgtgttatcctcccgtgtaacatactaaaaatttattactaacaaaaatctcaactgtttgattaagttaattgaaaattataaaaagttaagatccaaccacaatatgactcatacgtgtttgtaaaaagttcgtaaaacaaattagtatgcatatcgttctcctttttggagtttgattttttttttctctagtgtgctgtgttcggttttttcgcccacggttcgattttagctcaggaaaattctggtgttacataatcatggacctacttttgttctaattatgaaaacacgtcgttttggatattggaaaatctaactttgatcactaatttttattataaggatttttagaaaacctgataaattaatgattctaatgtcatatttttgataatttgacttgaaaattcttgaagatgacattatccttcgttttctggagcgcttgcgtgtgtttctttttgggtccaaacagagattgttgatgtccccaatgtagccggatccgatagcaacagaagctttcgtttgtaactgtggaaatcacacctctggtatacttgaccgacgacttatgccggccagcttcagcttggattcttgtttgttgaaacgcacaaatgtgattaacacaaagtacacgtgcttctacacttcgctgatcatattcatacaactagtggtaataaagtcctaagatagctgacaacttttctttgttcaacaggccactgcacactgatcagatcaagatatatactgtgcagtacaatacatacatactcactcaggaaaaatgctcactcagtcactccgtcctataaaaaacgaatctataatcggatgtgacgcatcctactactacgaatctgaacaaatatactctctctgttctacagaaaaccaacctagtaccggatatgtctagattcatcgtagtaggatgtatcacatctggtcctagatttattttttatgagacggagggagtatatccagattcgtagtaccaacttatgtcacattagatttggtttttataggacggagggagtacataactgctccattaattttgagctctaatatatgttcttaaattttgagtttaaatttcaaattgattttaatgtttttaatgtagtttattttctagcatttacttttatgttactaagagaacaaatataaaagtttttatctatttcttttatcgttaacaagcattacattttataatccgttgtaggtgagtagtcgcttttcttcatctcgtcagcttcacttcggagaggcgtctatggctgagtttttcgcgtacacgtttttcaaactactaggcggcggtgtgttatttacaaaatttgtctataggaaagttgctttaaaaaataatactaatccatttttttaagttttgtttaactaatacttactaaatccgtcccaaaatataataacttataaccgaatgagacatttcctatctatctagattcatagtactgcaaaatatcttctctgattctagattcttatattttgggacggagagaattaatctcctaatcctttgctttgttctccgtgtgagaggactaagcctatgtcgagcatctgccgaccaatgtgtgtacggtgtactggattcctggaatgatcatttttagataatggattttcattaatccggtctctatatccacgaaggatatacacagctaaaaggatacatgagtacttacactcccacctcaacaaagaggaaaacacacaaccaaaaaacaaaaagaaaaccaaacaacctcgtgacatccctgcttctctgcgtcctgccatattctcctgaaacggccagatattacaagtggaagttgtctagtcgccgccgcccctagtgcgccgtcgatgcaaacctccgttggtgccatctttatctgtttcaggtaagctgacgccacacgccgccagttagcctactttcaactgtcggcattcgccgtttagccggaaatagccaaccacacacgaaccgacgggatcggcttccacttcatcggattcacagtgctcagactaccgctgtcctaggccgccgcagcccctagggctgtcgacaccggtaggagccgtcgtcctcttggaccgccgcagcccctagggccactggcgccgacgggagccgccgtcctccgccgcatctcctagtgccgccagcgccgatgggaactgccgccgccccaagggttgccaatgccgacgggagccgctgggccaccactgcccctagggctgccgccgccactgggccaccgccgtgcttcaccgcccctaccgctatccggagagactccatcgctgacgccttgccgctccccaccgccctcccgaccacctccagccatccctaacccacacggccaggcgcaggcccggctgcctctggccaccacttccgcacctccgcctcccacctccccactgccaccgtcctagccgccgcgcagacgccggtcagctctggcggcggcggggctatatctggctgggagagaggaagagatgcgtgagggagagtaagagacgcacgcgtgggggaaaggaagcaccccctctcacctggaatgattatagtactagaaaatatcttatttgattctgggctcttatattttgagatggagagaataattaatctcacgctaatcctttgcttcgttctcagtgtgagaggactaagcttatgtcgagcacctgccgaccagcgtgtgtatacctggattcctggaatgatcgtacgtgcttctcgatcgctgcggtcatcccccacagatcgatctcaaagagtcgatgagagaccaagtgaaaaaaaaaagaatgacctaatattaaataattagaaggggtaagacttcaaaccagatcgtccagctcgctactttgtgaagctagccggaagacttctgttgtttctcgaccaagtgaaacgaattgatatgatatattgggctggctagtgcgcgtgtggagggatccgtcggattcggaaataaaagtatttaaatcgcgcattgaagcttctttttttattcatctcacaatcatcaggataaaggcccgcgcggcgtcgttaacattgagtgcaaaagtaatttcatttagcgcttagtttacataggtcaagtgtttttcattagtttaattacttcaaaaggaagcattggaaaggtagttatatcatgaccgtgtgtcttaaacattaaaaaacataggatcacacgtataaatactatggcaacaattggtctataaataattagcagtcaattaatatattatcagtttatttaaattgagaaaaattgaagcatataaaattcgaccaaattttatcaacagaaatgaactgatatattttttttggggggtggggggaagacccaacgtgaatgaaatgaaacgtcttgtgagcaagttcccttctttgcttcttgcctcaactaatgtattgtgtttatttccttgcaagtcgaacgcacaacagattagcggccccattgttttacatattcgtggaataaggagaacggcacatttgcaaataaaaaataatttgtgaataaaacttttatatacatgttcttatcaatctcaaagtaaggctggaaaacaaactttgatgaaaataccccaaatcatcttcaaatttaagattaaaaatttaaattttagctgataagcataagcataagcgaaaattctataataaggtacatcgaagttatcatataaaccgtaaacagtcttaactgcatgcttcatggtatgaacgctacatttaaagacaacttctatgatgtaaaaatttcacagaatggcaagtcaatcaactgtgttagatctggtagacagcatccggacatctggagtgcatcaaaactgacagtaggtaggtgttaaaagcattaaatttgtcgctaacatgcacaagataatcggtctcatcttttcgtttatacttatatttatcaaccaaaatttaaattttcaactttaaatttgaaactttgcgatttttttctcatcaaaatttatttttcagcctttacttttatatcgctaagaacacgtacataaaagttttattcacaaattacttttcatttgtaaatataccattctacgaataaaccaaacaatgggggccgtttaggttccagaaaaggcgaaaaatcatgcactagaattttggatggagggtcttctgagattttgaaaagcttcccatggtgatttgtcagcaagattttccgccagcccgaaaagtagacagtttatgttaattattatatgagttctatatgcatggtcactaggaaagatgcaattccgtaataaggtacattgaacttatcatataaaccgaaaacagtcttaactgcatatggttcattgtatgatttgtatcaacgctacgtttaaaaaagaaaacttgtatgatgtaaatttcacacagaatggcaagatcaattaactgtgacatccaaactgaaagtaggtaagcatcaccaacagtctatctattccatccccaatcctattttttttggattttggttaaaaaaaactgatccaacagattcccaaaagagctctggatgttttggagttccgaaaaaaatttgaaaatatatttttatttttcatattttgcatttatatacatgtccgagattaatttgcaaaaatatacccaatccgcatattagatgcgcgggagcgaccggtcccataggctggggatgcggtatcgcacctgtcccgcaggaagtttgcatgccgagcgctcccgcatattggatgtacgggaccgtggctcccacacgcgtcttctcccaaattgtgaatacatgtcccgtaggaaaaacggagcagtatattggcacgtgattaattaattattagtttttttttcaaaaatggatcaatataattattttaagcaactttcgtataaaaactttttgcaaaaaaatgcaccgtttagtagtttgaaaagcgtgcgtgtggaaaaggaaggagatgagttggaaaaattaggggaataatacagaaccggatcgctccgcatattggatgcgtgggaccggcccctctctcccgcatggcggatgcgcgagactgccactccgtcctttccaaattgtgaatacatgtcccgcacggaaaacggagcagtacattagcacgtgataaattaattattagttttttttttcaaaaatggattaatatgatttttcgagcaactttagtatagaaactttttgcaaaaaatacaccgtttagcagtttgaaaagcgtgcgcgtggaaaatgaagaagatgagttggaaaaaattaggggattaataccgaataacacgagactcgctcggtaccgcgcgctggaaccacgggaccgcgcaggtcccgcgccgctgttatgcggtaccgccgcgctcacctgcggagctgacgtccccatcgctcccgcgtatcggtgccgcggtactgactcggtcctgcagtctagccgtgcgggaccggttcggtcgcgcatctcggttccgcgtgaccgactcgggttctacgtgaccgactcgaattctgcggttcgtcctcgctcccgcacaaccattctgcggatcagatatatttttgcaaattaatctcagacaggtatataaatgcaaaatatgaaaaataaaagtatattttcaatttttttccttggagttcccatctccaattttctcggtacgtgtatttgagggcgagagaacgactcccaatcccctccttccgcgcgtttctcccctccttccgcgtttctcctgtccttcccgcgtaagggatctccttctgcgcacgggaaaggaaaaaaaaatagaatttctgttggtagtttaatagaagggcccacttttagtttttttagtttttgaggattgaatttaggctatctcttggaggaaggggttttttcaccatctattttcagtttaggaaaccaccaaaaattaaattttagggatagattattggtaaaccgttggtgatgctcattaaattttgttgctaatatgcacgggataaaccttcagtggcaacatctgactgcatactccctccctcccaaaataagtacaactattaatttccatatacaactttaatcgtccatcttattttaaaattttttaataattagtatttttattgatattagattataaaatatgaatagtactttatgcgtgacttatgtttttcagttgagcacggaaactcatgtgttgtgcttattttaggacggagggagtatatttggtgagattatggccctgtttagttcccaagacaaaaattcacgctctaacatcgaatgtttggacacatgcattgagtattaaatgcatgaaaaaaaatcaattacacatattgcgtgcaaattgcgtgacaaattttttaagcctaaattgcaccatgatttgacaatgtggtgctacagtgaacatttgctaatagcggattaattaggcttaataaattcatctcgcagtttcctggcagaatctataatttatttttttattagactatatttaatacttcaaatacttatccgtatatccgatatgacaatcaaacctaaaatttttctccatctaaacaaggtctattgtcacatgacttcagctaaggcgatggataaagcaaccacctgggcaacgtgggaggccctaccatcgtggcgaagccaccgtggatcttcgactaggcctgaggccaggcccatgagttgcatcgatcgaatcgaaccgtacgggttagtggtaagcgaaaactaattggtactccccgtcttgaaaaaaaaaatccaattccaaagataaatctagacatacaccatatctagattcatctctagaattaaattttttatgggacataaggagtacacactaacatacgtggtgcaaagtaaaatggttcaacttatacatgatgcaaagtaaaactgttgaatataccctgtgcaaaataaaatttactcacttttttaaatatataccagtgcaaaactcaagaaatccatagtactattttgcaactgagggagcactaactaagagcatccctaggagatcctccattcagaactccatccgagatttagcgtacgaaagtgaaaaacggggctccagcggacacgccatcgagccatccaaaaatagaggatgcgccaaaacggagagagtaaggccaaatatagcgtttctctctccaaaagccatatcacaacggttgcagctcccgccctcatccagagttccgtgacctcccctccgtcgtcgtcgtcaccggacggaaggggaggatggagagaaagaggcataccagatccagaagtacagtgtcgctagtggcaatcatgctcccttccacccctccgtgcccgtcgcctacctccgcccctcggccgccaccactacttccgcgcccgctggcctcctcctccgcctccgcctctgtgcccctcggctgttacctccacgtccgcgcctgccgaccaccgcctctgcttcaacacgcgctttccaccgccgctccacctccatgccatgctgcttcgctatgcccgcgctctttgcccacccgaccgcatcgtttatctgttcggctggggttggggtctcggggaacgatgtttatttgttcttttctttttttttaattttagttttttcttctttgatttaataataaacgtggtagttttatattgatatacgtgagagattaattagtaactatcaggtgaaacatgtttagcgaataacaatatttcttttaactaatccaggctaaaaaaacgtacacatagcaaagttggttaaaaattatttttaaatatatgacaggtgttatagagaatgtaatatggatgatctgttggaaaggaacaaaatctagagaaattttttttagatggccatccaaaccgagatatggagtaccaaatttagagagtgggtatgctctaatgtcctcactcatccacaacaaacctcgtatggcagtccaacctggttttcggagtccaccagggaggcctaatttcagagtccaccaactgagttgcagcacgaaattaaaacactttaactggattgttggcgtggtgaaaagaaatttgtgggatagagggacttttggaaggcaaaatttgcaggcattacctccaatttacaagcaactttggtcgggatatttaatcaattcaattaaagtcaacagcaagggcaatcccttgtgcaccaacagtataacagcaagaaaaacaaatgagaaagaggatttgaccatgtaatttgcagtcttttgtcaagatgatggcagggattcttcttccattctgtccacatcaggaagagacaaaccgcagcttttgcagggattaaaaactacttgtatcttgcagctttgtgcagaatttaggctgttttttaattagggtgaaaagttttggcgtgtcacatcggatatatacatatatctagagtattatagactaataaaataacaaattacagattccacctgtaaactgcgagacgactttattaagcctaattaatccgtcattagcaaatatttattgtagcaccacattgtcaaatcatagaacaattaggctattcgtctcacaatttacacgtaatcggtataattagttatttttttgtcccagaatataaatattttagtatagtgacaagtcaaatattgtttaactttgaccaataataaaaaaaataaaaaagatcaatcatgtgaaattgatgttactccctctgtcccacaatataa

SEQ ID NO: 40951 - DNA, 1716 bp, Oryza sativa
caagcaaaaactcaaaatcccttatattatgggacggagggagtactatatttatcattaaacaaactatcataatatacaactctttttatttgatattgttgatcaaattagtatctcgaagaccgtgtcagggtagaaaaaaatgcttatattttgggacggaggacagagggagtaacaattagcaccttcttcaccaccgacttacaagaggagaagaaatacagcagccagctgtagctttgtgcacgagttaaaaatgtttcaacctgcataacgcaaataagaggtaacacacagagcaaacaaatatggaagataattttgctcggtttgaggagaaggggatagagaagaatgggaagatatgcaaaacgaggtgagctattagtgcatgattaattgagtattaattattttaaattttaaaaatggattaatatgttttttaaagcaactttcctatagaatttttttgaaaaaacacaccgtttagtagttcgagaagcgtgcgtgcggaaaataaaacaaactttctcacactgtcatgctacctaacgcagaaaatcgcagatggcttactgacaattagggctattaaaaaagctcggggctcgtgagttgcttgagctcgacttgcccaaggctcgattcgagctcggctcgagctccaaacgagatgagcccgagcctatcccaaagctcgcgagccgagcttgagctcttatcgagtttggtaatatataattttttttgttgctatttaataaattgggagatcaaatatgttatttgtatatcctgtattggcatcatatatttattttattctttacaataagatatcacatgattatattcttatgaaagaaaaatatacgtttcaaacaataaaaacataatgtttcatgcgtgatagcaatatgtctcaccacgtgtcatgtgtttttattgtgtttcgcatattttttatatattcccgaggcagatttctctgttacatcatgtattatactaatagtcaactgaaacatttgacctctatttttttttacaacatctaacgtctgatttgtagctcccacaaattttatatctatatctatattatacctatctctactacgtaaaaaaagtgttttcgtggccagtacaaaataaataaccagcgaaaaaaagtccgattatatggtaaaaaatgcgcgagaaaaagaaagaaaaaagaaaccccggaggaaaaaccgaagggcctaagcgtcagcgccacacatgcgtgcaatcccacttttaaactggtttttttcttaaattatttatccaaatcatgatccaattacaccattaaattcgttgtaattaaatctttaaaacaagtccacacatggatatgttacacgatgttccaccaagtatatcggaattgtttcactaattagattgaaaatgtttcactcgtttaaatcggacattgtttcaccttatataaaaacaatgtttcagcaaatagcgaaagaaataaaacattgtgagtaagctagatgaaacatttttggtgaaaaaaaaaatgaaacgaattccattaatagatggtttccaaaatatgtggacgatttgtttcaatggagtatatggtgaagatacatggtaggtggtggcagagaccattgtagggccaggctcatgcatgcacgcgcgtgggggcggggccgcggg

SEQ ID NO: 40952 - DNA, 2358 bp, Oryza sativa
cccccccccccccccccgcgtcgggcaccggccaggagcattttcaaaaaaaaaagcacggcaaataaagtttctatatatctctttatctcaatctaatctacatctctatctctatctttctctactactttcataaaaaaacatccgacttccgtaaaaaaaggaaaaaaaagaatcaccaataaaagaaaacgaaaaaaagtccgactccgtaaaaaggaaaaaaaattctcacgctcgactccgtaaataaagggaaaaaatgtctcatacgtaaaaaagaaaatttctgactcccgtacaaaaggggaaaaacacttgtctgtacaaaaaaaataacatccgatttctatggaaagtttttttaaaaaaagtatcatcagtaaagaaaaaaaaagtccgactcccgcggaaaagaaaaaaaatacttctcacgtccgactcccgtaaataaaggaaaaaagtctcatccgtaaaaaaaacaagtctgactcccaaaaaaaaaaggaagaaaaacgtcttgtcaaaaaaaagaaaaattgtccgacccaaaatcaagaaaaacgcagtttataaaaaaaaatcccgtttataaaagaaaccgttcgaaaaaaaccactcgactcaacaagagaaaaaacatagtttacaaaaaatgttttaaaagaatattcgactcaatgcgagataaaaaaaaccgctccaaaataaaccgtcagaaaaaaaaacattgtttttttaaaaaaaagatccaagaaaccatccgaattcatgcgagaaaaaaagatataaaaaattgtctgactccacgcgagaaaaagccgccatatatataaaaacccgcgtttataaaaaattctggttcagtactgtgttatgcgaaaaaactatatgatttcagaaaaaaaaaacatccgatttcatgaaaaatgattcgtattgtttgtatcatccatcgtctaccatgtcattttggtttttccaaagtgtcatcgaaagttcaggtatgcggatctaaaacaagtcttggtttttggtttttccaaagggtcatcgaaagttcaggtatgcggatctaaaacaagtcttggttatgcttggttttctcggaacgagatcaaattggtcgaggttttgggtcagatacgatcctcgatttttccatctcctacatggtttgtgttccgcgattatattctcatatattagagaccctgcatatttatatttatgtatgtaattatcatactactggacagtatagctaattcttgatagcttatcatataaaaacaacaataataaataaacaattgttactaagaaatagtgcagtgaggctctatttgtctagacttaccatatgagacaatgtaggatcttattgatccaattattaattgtaagaatgagattaaaagagtaatttagattatatgtgtacagcatacataaataatccacttcatttaggcaaaacatgcgttagaaaggttgtcatcgtcgagatcgggtcattatattgaagatgtttcaatttttcttataatatgtcttagctacaacgatcgatacgattattatcattgacacaattatgcgtggaaagcgtatattgtcatcgaaatgttttcacccgttgcaatgcacggcatttattttctagtatataccaaattagaaaataaggcttctggtagttttcttttttggtccatcttttttttcgcacgcgcgattttttcgtacgttttttgggcccggtttttcccgtccgattgttttttttcgcacgcgcttctaatagtttttttcgaccgtcgtcatttttttccacacgtggttttatttgtggggctggtttttcccatcgccacctgtccctttttttgtcagtccaattattttcctagtgggtggcaatttttttttgttgcggttttttttgggtgggcccaggtttttttccaccactgtttccgatcagttcttttgcgagcgcacgtggaaggactgaaagcccaaatagtcagatacaattacaattacatggctcaggaattacatacagagtccaagaataggaattacatggccaaggcccaagtaggataaaaaatcttctcaacctatatcgtactttggtacgtcatgagtcgatttttttaattttatgttatctttactacttaaatttctgttgtctgttaaaaaaaaaagtccgacccaaaaaggtaaaaaaataataaaaaaaaaggtccaactcaaaagcgataaaaaaaatctgtcgtcagtaaaaatctttatctatagtaaaaatctttatctttatctttatttttatctattataaaa

SEQ ID NO: 40953 - DNA, 14411 bp, Oryza sativa
tggtatatatggcgctcacctgttgtcccttttcaccatgtccactctaacacacaatatggaacatatatatacaaggttggaaaacgtatgaattattacgacagtatgaattagtccactgaaccataaaaccagacatattaaacctcgaattattgataccggatgaattaccccccctgcccccccccgactcaattcaaagtggttttgatcctacgtggcattttggtacatcatctgtgtatgagtcgatttttaagttcgtttgtttttaaaatacatatccgtatttgagtcggttttaaatttgtttgttcgcttttggtaatacagaaggaatcatataagaaatttgttttaaaaaaaactcgcatgataacttgagacgaccagactcctaactgtagctcatgattttctaaaaatatatatatccaaatgatttttcacagtgagtttcatcttaactaaaccatataacaataataagtttaaaatagacttcactcgttgtaacgcacggatattttatctagtagaaaaaaaacatctcgtccgtcttaaaaaagaagaaaaaaagtctcgccagtaaaaaaccaaaaagaaagtccgtttggtttttaatttggcacgggtatttttttctgatctttttgcacacgaaagagtttttttttcgcacgcgcttaggctcttggttccgtccattttttaatctgatcgcgcctcctgtcaattcgttctgttcgccgcacgtcgcgccgctgccatatcgattgtgtgttttctactccaatttgattgcaaaaatcgattccccactcctccctcatcagttgctaatgatgacggcgatcttcccggttggttgtttttatctcgagctgattttggaaaaaaaaacagaaagaggagatcgagtggataaaaaccatcaaccaattttggtgatcgagaaagattcggatttaattgggaacaaagagttttacactctgattttggagaaaacgggaagagaagatcgactggataaaaaccatcgaccaattttaggtgatcgagaaagattcgaccatatttgatagggagatttgctccggcagctgtacgtccacgtggccacgggacagacaaccgtacggccacgggactatcttcgggaggttgaagatgatagtagactgtgcgagctacgcttatggctgtaggatcgagatgtcgactagaggggggtgaataggcgatttaaaattaaataacacctaatcaaaactaacctaagttgttaggcttggcgagggacaagtctaactaagcaactaagttatgttttgtaatcctagggtgaaagggtctcaagtatgtctctaggaatataaattgcacaaatgtaaatgcgacaaataaatgagacaagttgacaagagatttttcaccgaggttcggaaactcgccggtttcctactccccgttgaggcgagcccaactccaccgctcaaccatgaagacaccgcacgcccccttcgtcaaggggtgtatgcaattgaaatgagtgccaagagagaccccttgctgctggtgggggagtatttatactcccaccaaccaaaactatccgttgggggcgaaatcccccaattttgtgtactgctggtctgaccggaagtatgtggccggtcagaccgtgctactctgcaacggctagttttctagccattgtagccttgtcaaagggcccatcggcctggccggtcagaccgacgttgagtggccggtcagaccggcctcggctcggtcagaccgccctcagctcggtctgaccgtatacggctccgtcagctctgtatcggccaaccccgagcactccatcccggcctctagggggccggtcagaccgcccctggtcaagccgaacacagtgaatgcaagtgtgtgtgaaaagtattaaaacaaatgtgagcacaagtgaatatgaaaatgacctaatgtggcaatcaagatcatctctatgctaggtcattacccctcttaatagtacggagaagctaaaattaaactagcaaatttgatcgccctacacctcgatcaatttaaatataaagccctagtttaccatcttcttttccttcactttgcgccgtcaaattttaatccatcgataataatccatgcgcacatatgacgtggtactaacacaaaataattaactcaaagagaaacggttagtccacaattagcgcttgtcattaattatcaaaatcaatctccccctttttggtaattgatgacaaatacttcaactatataacatcaaacatgaaacacatggacattttgcaatgaaatgaaaatgatcccccgaaacatgtgcatatcaatcacaaatagcaaatatgaaacaaatgcactttcattcacatttcaacatagtacaaccacatatggaacatacaatgtgaacttcacatagggatcaaccaattgcataagatggtcataaatatatcaatgtcagatcaaccagccatcatagcacaagttcatccatagatcataaacatccaacttacaagagtttatccatatagggctcacaaataaacataggctattacaagaccacgaagggtccaaatgacatagagtttaacaaaacaaaaaaataacacacaagataaggtaatagcccatacccatacataattatagcccatccgccttaacctattagataggaggtagctaacctcactactcttagtcccatcccgcaaaataaaatgcaagcctagagttcttctcccccttttggcatcaaggacaaaaaaggcttcactcttgtggaggacaaggaggacgggtcgaagatgaagggcggggagcatcacagctgaagcatcttggcccccggtattaattttagtaattaatgataagcactaattgtggactaaccgttcctttgagctatatattttaagttaggttcacattatgtatgcgcatggatgtctatcgatggattaaaattgacggtgcaaagcaaaaggaagaggagtcggtaaactagtgttttcatttaaaattgatcgaggcgttgggcgatcaaaattgtgctagtttatttatagctttgtcgtactattaagaggggtaatgacctagcaaagagataattttaattgtcacattaggtcattatgcatctaggcttgtgctcacatttcacaacacacaccttttcactgagttcggcctgaccagggccggtctgaccgcttgctccaagccggtctgaccacaggtcagaggccagtctgaccagccacctagtggcggtctgaccggcgtaactggtcggtctgactggcggcacttgtgcggtcagaccgccccctggtggccgggatggtgttgctctggtttgggcgatacagagccgacggagccgtattcgatcagactgagctgagggtggtctgaccgagccgaggccggtctaaccggccactcaacgtcggtttgaccggccagggcaatggggcccaatgtcaggcctacaacggctagaaaactagccatagagtagcactgtctgaccggccatacacctcaggtcagaccggcagtgcactgagttgggggatgtcgcccccaacagctagttttggtgggtgggagtataaatactcttggcacccaattcaattgtatacaccccttgcacctctctcacacacatttgagcttagtgttcatccattgtagtggttgaggttgttatagccaagagtcaagtgcattgctttccacatttctcatgagaagcttaagaaagctcatgacaaccttctttccactactcaacatggagctcacattgatgttggcatatcttgtgatttgcttgatgatagtgcttcttgtcatattcctcatgttgcatcatctagcatttctacctcttgtgatgatcttatagatatgcctagctctaggtcttgtgtttctatttgtgatgtctcacttgttgttgagaacaatgagcttaaggagcaagtggccaagctcaacaagagtttggagagatgcttcaaggataagaacactcttgacaagattttgagtgaacaatggtgcatccttaacaaggagggacttggattcatttcaaagaagggtaagaaaccttctcaccatgccactcgttttgtcaagagcaatggtaagtattgctccaagtgtcgtgaggttgggcatttgatgaatgatggccccggtggtaagccttctaagacatgcatgtttgattctcattatatgtttaggaagactcatgatggtagtattgttgctagatatgtgggttcccctatacttggtggtaaaaagaatgccatttgggtgcccaaagctttggtctctaacctccaaggacccaaacaagtttgggtacctaaaagagtttgatcttcttttgtaggtgaactaccacaccggtgggagctattgggtgcttaatagtggatgcactcaacacatgactggtgatagggctatgttcaccacattggaagtaagagggaaagaacaagagaaagtgacatttggagacaatagcaacggaaaggtaattgggttaggtaaaattgctatttccaatgatttgtgaattgaaaatgtctctcttgttgaatatctaaatttcaatttgctttcggttgctcaaatttgtgatcttggctagtcatgtgctttcttcccccaagaggttattatttctagtcttcatgacaagtcttgtgtgttcaaaggtttttgatatggaaatctttatttggttgatttcaattctagtgaagcaaatttgaaaacttgtttagttgcaaaaacatcattgggttggctttggcataggaggctagcccatgttggcatgaatcaattgagcaaactttcaaaacgtgatctagttgtgggcttgaaagatgtgaagtttgagaaggataagctttgtagtgctagtcaagccggcaagcaagttgcatgctcttatcctactaagagtatcatgtccatatctagaccattggagctcttgcatatggatttgtttggcctaacaacctataagagcattggtggtaatagtcattgtcttgtgattgttgatgattattctcgttatatttgtgtgttctttttgcatgataagtctattgttgccgagcttttcaaaaagtttgcaaaaagggcccaaaatgaatttagttgcactcttgtgaaaattagaagtgacaatggttccgagtttaagaatgccaatatcgaggactattgtgatgatcatgtattaagcacgagctttccgctacctacttacctcgacaaaatggtgtagtggagaggaaaaatcgtacattgattgagatggcaaggactatgcttgttgaatatgatgtttctgattctttttggacggaagccataaacatcgcttgccatgcaaccaataggctttatttgcatcgtctcttgaaaaagacttcctatgagctaattgttgggaggaagtcaaatgttgcctattttcgagtttttggttgcaagtgttatatttaccgaaagggtgttagactaaccaaatttgaaagtcaatgtgatgaagggtttcttctaggttatggctcaaatagcaaggcataccgggtctacaacaagaacaaaggtattgtgtaagaaactaccgatgttcaatttgatgagactaatggctcccaagagggacacgagaatttggatgatgtaggtgatgaaggcttgatgagagctatgaagaacatgtctattggaaatgtcaagcctattgaagtggaagacaagccatccacctccactcaagatgagccatctacttccgctacgccaagtcaagctcaagttgaagtggaggaggagaaggcacaagatccacctatgccactaaggatacacaccgctctttccaaggatcatccaattgaccaagttttggatgacattagtaagggtgttcaaactcaatctcgtgtcgcttcaatttgtgaacattactcgtttgtttcttgtcttgagccaaaacaatgatagtgccataaagatagccaataacccggtccaacattctagaaccaagcatattgacattcaccatcacttcctaagagaccatgttgccaagtgtgacatagtcattagccacataagaaccgaggatcaactagccgacatctttaccaagcctcttgatgaaacctgcttttgcaaattgaggaatgagttaaatgtcatagatttctctaatgtcgcttgacattgtgcaccatggttgcctcttgttcatcttgtagatttgctcttatttgctcttatgctttggatttattgccatttggttcctctttgcgaaaatggagcatgtcacattaagagagagttttgcactcttgcatgtgctctacttccttttatgtgtgggcaaatcaactagaagtgctagtagtgctttcaaaatgcctaagtcaacataagtcaaaacttttgcaaaataaatataatttgaaaactatctcttggaaaatgtttcaaaaggttccctatatgttttccaagcctcacattgcaagaaaaatggtgtttgaatgaaaatgtcgttttggccctcttttgaataatttagattcttatttttggccaaaatgggatttatctccaaaatgagattgagagagaattttaaaaaagtttgaaaacaaagtttgtagagaagaagatttgaaatgtttttggtattcaaacctatttcaaaaacaaatatttcaaaagttgtttgaaaatcaaattggcccaaaaacccctatagaccataaaaggtcacctcctagcacttaagtgagtttagtcatcataattttcaaatattatagatggttagcaatatttaaactcacacatttcaaaaattgctctaaaaatcaaatttttattggattttattgtgtgggggttgccggcttgtgcaagggctgtacacagccggcagggacccgacggtctgaccggcgctatatgtgcggtctgaccgaccgggtggggcggtctgaccggccgcatagggctggtctgactggccaaggtgggcccagggatttattccccccttcttctccaacccgacccctactctctccttctcatctccattcttccccaactcgaaatttccttctctctcacctcccctcaaaccctaactcatccctccatcaaatcccctccgcttacaccgtaagtgattctcctccgcttcctctctctattccatgaattactttgcgtttttattgattttttttatccatggcatggaaccctaggtgaagcacgaggtgttcttctatttgcaccaatagagggtagtttcttggtgtgattcaactccttcaaccggtaaatcacactccctcttgtgcattacttcaaatcgatctatttcaatcttagggttaatggtagtttccccattgttccaatcttgatgaaacagttcctaccctttgttgctcttgttccaaccttgtgctgtattgttctagaaaattttagactcaaatttgtagttgtgaaaatttttggatgcttgaacttgtgggaggtggtctgcccggagccacaggccgtctgaccgtgggtcagccgccggtctgaccgacttgtgctctcggtctgaccggccgacacccgtcggtctgaccggccacctgtgggcggtctgaccggcctgatgccgtcggtctgaccgccctacaagctgcagtctgaccacccctccgcaggatataggcaaaattttcaccgcttccaaaattgcttctaaaattcttgctaatatcctatcctctttgctctttgtcatctatgcctccccacactcgccatggtcgtcatacgcccactctgaatcctgtgagtgagcatgaggagtcgagcggagaggaatatgcttaaagtgatgaagaagtcgaggaacatgttgagggggccagtgaggaggaaagtggagatgatgacagtggtagtggggaggatgaggaggaagaagatgatgagttgcaagttgatccctctattcagtttgtagtcaacatgagaaatcctgctcagtataccatattacggcataatgatcagttcttgagacctagagacaccacggatccccggttccacaccgcttttcagaagacagtgtatgagtagatttatgtggggaaagcttttgcggatcacaagtggatctcttggagggatatcaatgagaccccagaatttcaaagtttgcatgatctcttcaagatagttggcattgaccggattatgaccctcaagcaagattacaatgaagacttgatccgccaattctacgatacagtgtgggtggctggagatttcagtgagatgaagtggatgtctgacaccctccagtgctctatctctcggaggcagttccggaggcagctcaacattcactttgattttgaagatgatttgcatgaggagcacactcacaacccgctctccattgactatctctctcagttctctgaggatggagtgcggtacacccatgggaaggttgccggcttgaggactatccctggtgtggtaaacagaattgtgagagccaccatcctccctcgccttggcaacaatgatgacaatagggggtggcttggcacgtcattgatgctatcattcaaggtcgtcagtttgatgtggtgaatctcatgatgcaagaaattgctatctccaatggcacattcactcagggcatctactatgcgccatatatcatgagattgatactagacaagcttgggggtgccgggaacaatttgaagaagcacaagcagtacaagccctgccttcagcttggaactccccgtgctcctaggacgatgccctcttctcaccctggagctagctcaagcacggcacctcctcgtcctcatgggtttgtttatcctaatgctttctttaatcctcaatatgcttacttcgggttgcaaccaaatgagtgattcaacctggtacttggggctatcaatacccttagtgagagcattcaacgcttaaccatcgggcatgaagcgatgcatgaggatgttcgcggtttgcgaacggatgttggaaatttgaatgcatctgtgggaagattgcacactagggtgggtgtattggatttacgggtccaagtgttggatgcacactacggcgatggtacacaaaagcttgggtgctctccaacacttggatgtgaaaagtgcttttctaaatggtgaaattgtcgaactcgtctttgttgaacaacctcccggttttgaagatcctaaaaatcctaaccatgtttataaactttcaaaagctctttatggtttaaaacaagctcctaaggcttggtatgaaagattgagagattttcttttatcaaaggatttcaaaattggaaaagttgacaccacccttttcacaaaaatcattggtgatgatttctttattgaaaaggattctaatatatttaaagcattcctctactattggcttgtggtacccaaaaggtgttaagtttaagtttgttggctattccaattcggattatactggttgcaaagtggatagaaagagcacatccggtagttgccaaatgcttggtagatcccttgtgtcatggtcatccaagaaacaaaactccgtagccctctctaccgctgaggcggaatatgtttcggcgggtagttgttgtgcccaattgctttggatgaaacaaaccttgttagactatgacatatcctttaccaaaacctcactcctatgtgacaatgatagtgccataaagatagccaataacctggtccaacattctagaaccaagcatattgacattcgccatcacttcctaagagaccatgttgccaagtgtgacatagtcattagccacataagaaccgaggatcaactagccaacatctttaccaagcctcttgataaaacccgcttttgcaagttgaggaatgagttaaatgtcatagatttctctaatgtggcttgagatggtgcaccatggttgcttcttttgcattgtgtatatttgctcctatttgctcttatgctttagatttattgtcatttggttcttcattgcgaaaatagagcatatcacattacggggaggtttgcactcttgcatgtgcactacttccttttatatatgagcaaatcaactaaaagtgctagtagtgtttttaaaatgcccaagtcaacataagtcaaaacatttgcaagttaaatgtaatttgaaaactatctctgggaaaatgtttcaaaaggttccctatatgttttccaagcctcacattgcaagcaaaatgatttttgaatgaaaatgcctttttggccctcttttgaagaaactagattcttagttttggccaaaaagaaatttatccccaaattgagattgagaaggaatttgagaaaagtttcaaaacaaaattggtagagaggaggatttgaaatgtttttggtattcaaacctatttcaaaaaccaaatatttcaaaagttatttgaaaatcaaattcgcccaaaaacccctatagaccataaaaggtcacctcctagcagttatgtgagttttgttgcaaatcatcatagtcttcaaatattatggatggttagcaatatttaaactcatatattttaaaattgctccaaaaatcaaatttttattgaattttattgtgggggggttaccggcttatgcaagggctgtgcacagccggcagggggcctggcggtctgaccggtgctataagcgcggtttgaccggccaggtgcggcggtctgaccggccacatagggccggtctgaccggccggtaggtggtcccaggacttttgtcctttttcttctcccttcttcccctacccgactccatctcctcccattcagttttttccttccccaactcgaaaactctctctctctcacctcccctcaaaccctaactccttcctccaccaaatcccctcggtttgatcgcggatttctctccggttacaccgtaagtgattctcctctgcttcctctctctattccatggattgatttgtgtttttgttgagtttttgatccatggcatggaaccctaggtgaagcagttctttgatttacaccaaaagagggtagtttcttggtgtgattcatctcctccaaccggtaaatcactctccctcttatgcattctctcaaatcgatctatttcaacctctagggttaagggtagtttcctcttttgttccaatcttgatgaaataggtccaaccctttgatattcatgttccaatcttgtgcaatattgctctagcaattttttagactcatttgtgtaattgtgaaattgttgtggatgcttaggccaatgtcagtagtggtctaactggagccaaccgacggtctgatcgcggccttgccgtcggtctaatcggccgatgcgcgcggtccgaccgccgcatgcacgtggtctgaccggacgttggccgttagtctgaccggcaggtgtaggcggtctgacgggactgatgccgtcagtctgaccggcctgcagtctacggtattggatgtgagcacaatttcacttcaatcaagtggcttctaaaattcttgtaatatcctttcatcctttgctctttgacagtgatgcctccccgcactcgccatggtcgtcgtgcgcccactccggatcccgtgagtgagcctgaggagtaaagcggagaggattatgctcaaagtgatgaagaggttgaggcaaatgttgaggggactagtgaggaggcaagtggagatgatgtcagtggtagtggggaggatgaggatgaagaaagtgatgatatgcacattaatccctccagtttgtggtgaacatgaggaatccagcgcagtataccatcttgaggcatcatgatcagttcttaaggcctcgggacatcccggatccccagtttcacaccgctttccagaagactgtttatgagcaggtttatgcagggaaagcatttgcagagcataagtggatttcttggagagacatcaatgagactccagagtttgagagcttgtatgatctcttcaagactgttggcattgaccggattgtgaccctcaagcaacactacaatgaagatttgatccggcagttctatgctacagtgtgggtggctggagactatagtgagatgaagtggatgtctgacaccctctagtgttctatctctcggaggcagtttcgacggctcctcaatattcgcttagattttggagatgatttgcatgaggagcacacttacaatccgctctccatagactatctctctcagttctatgaagatggagtgcggtacacacatgggaaggttgccggcttgaggactatccccagtgtggttaatagtattgtgagagctactatcctccctcgccttggcaacaatgatgacattaggggggtggcttggcacgtcatcgatgcaatcattcagggacgtcagttcgacattgtgtctctcatgatgcaagatattgctatcaccaaggggacattcactcagggaatctattatgccccttacatcatgaggttgattcaagacaagcttggggctgctgggtaaaatttgaagaagcaagcagtaaaagccccaccttcagcatggagctccccgtgctcctaggacggtgccttcttctcaccctggagctagctaaagctcagcacctcctcctcctcatgggtatgatccaaatgctttcttccatccacaatatgcttactttgaaatgcaacccaatgaatacttctacccggtacttggggctattaataccctaagtgaaagcattcaacgcttgtctaccgggcataaagcattgcatgaggatgttcgtggcttgtgcaccgatgttggagacttgaatgcttccgtgggaagattgcacactagagtgggtgcattggattctcgagtccaaatgttggagagcacccaagcttttgtatatcatcgccgccgtgatgctcctcatccttcatcttcggcacgtccttcttctcctccacaagaatgaagacatttttggtacttgatgctaaaagggggagaaaactgtccttaggtgtgctttatgtcttgtgggttgggactagtggtagtgaggttagtcacctcaaatctaataggttaagttgctttgggctatattttgtatgggtctgggctattactctatattgtgtgttctttatcgttttgttgaactctatgtcatttggtctattcgtggtcttgttagcctatgtttgtttgtgagcccttttaggatgatttgtgacttatgtgatttggatggttaagtgatgtgaacttgtgcgatgatggatggtgtatgtgatattgatatatgtgaccatcttatgcttatggatgaatatttcttgaagttcacattgaaatattggttatgtgtttgtgcttgttgaaatgtgaaattaaaatgtgcattggctccatttttgttgtctatgattgatatgcacatgtttagggggagcttttgatttcctttgcaatatatgtccatatgttccatgtttgtttatatatgtttgagtgtttgtcatcaattaccaaaaagggggagattgaagcatcaaggcccccttgttaattttgttaatgacaagcgctaattgtggactaaccgttgctattgagatatattttaagttaggtccacgtcttgtgtgcgcatggatgactatcgatggattaaaatttgatggcgcgaagcgaagaaaagaaaacgttaaaactagtgctttagttttaaaattgatcgaggtgacgggcgatcaaatttgctagttttttttagtttcgccgtactatcaagggggtaatgacctagcaatggagattaattgccacattagatcattatgcatttagacttgtgctcacatttcatctcacacacacaatcaccttgtatttcacttgttcggcctgaccaggggcggtcagaccgaccacatagtggcggtctgactggcgtgccctggccggtctggccggccacaagacggcggtctgaacggcgcataaggccggtctgaccggccctctagtggccgagatggtgctgctcggggtggccgatacagagccgacggagctgtattcggtcagaccgagctgatggcggtctgaccgagccgaggccggtctgaccggccactcaacgtcggtc

SEQ ID NO: 40954 - DNA, 12748 bp, Oryza sativa
agctatggcactacttgtaggatcgaaatgtcgactagagggggtgaataggcgatttaaaatgaaataacacaaaatcaaaactaatctaagttgctaggctcggtgagggacaagtctaactaagcaactcagttatattttgcaatcctatggtgaaagggtctcaagtatgtctctaggaatgtaaattgcacaaatgtaaatgcgacaaataaataagacaaggagacaaaagatttttcaccgaggttcggaaaactcgccagttttctactccccgttgaggcgagcccaactccaccgctcaaccacgaagccaccgcacgcacccttcgtcaaggggtgggcaaggcagaagccgcccacggagaggactacccaagcctcgatcactcggggtagttcttccttcactccgaacgtggtgaactccaaaccactcacaaccggtaccaggcctcctccacaatcttctcggagaggtcaccgagcaactctgtagaatcgagatgtcgactagaggggggatgaatagacgatttaaaactaaatgacacctaatcaaaactaacctaagttgctaggcttggtgagggtcaactctaactaagcaactaagttatgttttgcaaacctagggtgatagtggctcaattatatctctaagaaagtaaatcacactcctatgtcaatgtttagcaatcctagggtgaaatgatctctagtatgtctctagaaatgtaaattgcacaaatgtagatgcaacaagtaaatgagacaaggagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaccagcgccggccctcctccacaatcttctcggagaggtcactgggcaacttctccacaagccatctaggaggcggcaacctccaagagtaacaagcaatgacccggcgtggagatgatcaatcaagtgccacactagctctacaaatggaagcaatgcacttgactcttggctaattaaccctctaacacactagatggatgaacacaaagctcaagtgggtgtgagagaggtgcaaggggtgtatgcaattgaattgggtgccaagagagcccccttgctgatggagggcgaaatcccccacctctgtgctctgccggtctgaccggaggtatgtgggcagtcagaccgtgctactctgcaacggctagaaaactagccattgtaactctgtcagagggccccataggcctgaccggtcagaccgacgttgagtggcgggtcagaccggcctcggctcggtcagaccgccatcagctcggtctgaccgaatacggctccgtcggctctgtatcggccaccccgagcagcaccatcccggcctccaaggggccggtctgatcgcgcatgtgccgccggtcagaccggccttatgcgccggtcagaccaccgttttgtggccagtcagaccggccggggcacgccggtcagaccgccactatgtggttagacagcggccggtctgaccgcccctggtcaggccgaacccagtgaaatacaaagtgattgtgtgtgtgagataaaatgtgagcacaagtctaaatgcataatgacctaatgtggcaattaaaatcatctcattgctaggtcattacccccttgatagtacggcgaaactaaaaaataaactagcaaatttgatcgcccttcacctcgatcaattttaaaactaaagcactagttttaccgttttctttttttcgcttcgcgccatcaaattttaatccattgatagtcatccatgcgcatacatgacatggtcctaacttaaaatatatctcaatagcaacagttagtccacaattagcgtttgtcattaattaccaaaattaacaacgggggcctagatgcttcaatctccccctttttggtaattgatgacaaacacaacaaatatatataaacaaagaaggaacatatggacatatattgcaaaggaaatcaaaagctcccctaaacatgtgcatatcaatcatagacaacaaatatggagccaatgcaaatttcaatttcacatttcaacaagcacaaacacataagcaatatttcaatgtgaacttcaagaaatattcatccataagcataagatggtcacatatatcaatatcacatacaccatccatcatcgcacaagttcacatcacttaaccattcaaatcacataagtcacaaatcatcctaaaagggctcactaataaacataggctattacaagaccacgaagggtccaaatgacacagagtccaacaaaacgataaagaacacacaatatagagtaatagcccatacccatacaaaatatagcccaaaccaccttaacctattagatatgaggacactaacctcactactactagtcccaaccgacaagacataaagcacacctaaggacatttttcttccccttttggcatcaagtaccaaaaaggtcttcattcttatggaggagaaggaggacgagctgaagacgatgatatacaaaagcttgggtgctctccaacatttgtagtcgagaatccaatgcacccactctagtgtgcaatcttcccacgaaagcattcaagtctctaacatcggtgcgcaagccacgaacatcctcatgcaatgcttcatgcccggtagacaagcgttgaatgctttcacttagggtattaatagccccaagtaccgggtagaagtattcattgggttgcattccaaagtaagcatactatggatggaagaaagcatttggatcatacccatgaggaggaggaggtgctgagcttgagctagctccctaggagcacggggagctccaagatgaagatagggcttgtactgcttgtgcttcttcaaattttgccaagtagccccaagcttgtcttgaatcaacctcatgatgtaaggggcataatacattccctgagtgaatgtccctttggagatagcaatctctcgcatcatgagagacacaatgtcgaactgacgaccctgaatgattgcatcgatgacgtgccaagccacccccctaatgtcatcattgttgccaatgcgagggaggataatggctctcacaatcatgttaaccacactggggatagtcctcaagccggcaaccttcccatgtgtgtaccgtgctccatcttcatagaactgagagagatagtctatggagaatgaattgtgagtgtgctcctcatgcaaatcatctccaaaatccaagcgaatattgaggagccgccggaactacctccgagagatagaacactagagggtgtcagacatccacttcatctcactatagtctccagccacccacactgtagcataaaactgtcgaatcaattcttcattgtagtcttgcttaagggtcacaatccggtcaatgccaacagtcttgaagagataatgcaagctctcaaactctggagtctcattgatgtctctccaagaaatccacttatgctctgcaaatgctttccctgcataaacctgctcatacacagtcttctggaaagcggtgtgaaaacggggatccggagtgtcccgaagcctcaagaactgatcatgatgcctcaagatggtatactgtactggattcctcatgttcaccacaaactggatgaagggatcaaagtgcatatcatcactttcttcatcctcatcctccccactacgactgacatcatctccacttgccacctcactagccccctcaacatttgcctcaacctcttcatcattgtgagcgtaatcctctccgctcgattccttaggctcactcacgggatccggagtgggcgcacgacgaccatggcaagtgcggggaggcatcattgtaaaaagagcaaaggatgataggatattagcaataattctagaaacaatttggagaggtgaaaatttgcctatatccagtggaggggtggttagaccgcagccagtaagtcagaccacccatggtggccggtcagaccgacggcatcaggccggtcagaccacccatggtggccggacagaccgacggcatcagccaagttagaccgcccactggtggccggtcagaccgacggttgccggccggtcagaccggcggctgacccacggtcagaaggcctgtggctccgggcaaacctcctcccataagttcaagcatccaaaaattttcacatctacacatttgagtctaaaatttgctagaacaatatagcacaggattggaacatgaacatcaaagggttgaacctatttcatcaagattggaacaactacccatagccctagggtgaaatagatcgatttgagtgaatgcacaagagggagagtgatttaccggttggaggagatgaatcacaccaagaaactaccatctattggtgcaaatggaagaacacctcgtgcttcacctagggttccaagccatggatcaaaaactcaacaaaaacacaaaccaatccatggaatagagagaggaagcggaggagaatcacttacggtgtaaccgaagagaaatccacggtcaaaccgaggggatttggtggaggaaggagttagggtttgaggggaggtgagagagagagttttcgagttggggaaggaaaaaactgaatgggaggagatggagtcgggtaggggaagaagggagaagaaaaaggacaagaaaaaggacaaaagctgcctaggcccacctcggccggtcagaccggccctatgtggccggtcagaccgccgtacctggtcggtcagaccgcgcatatagcgccggtcagaccgccaggccccctgctggctgtgcacagtccttgcacaagccggcaacccacacaataaaattcaataaaaacttgatttttggagcaatttttgaaatgtgtgagtttttaaatattgctaaccacccataatatttgaagattatgatgatttgcaacaaaactcactcaagtgctaggaggtgaccttttatggtctataggggtttttggtcgaatttgattttcaaacaacttttgaaatatttgatttttgaaataggtttgaataccaaaaacattacaaactttcttctctaccaactttgttttgaaacatttctcaaattccttctcaatctcattttggccaaaactaagaatctagtttcttcaaaagagagccaaaagggcattttcattcaaaaatatcatttttcttgcaatgtgaggcttggaaaacatataggaaaccttttgaaacattttccaagtgatagttttcaaattacattgattttgcaaaagttttggtgaaggatatgcgtgcgggaggggaggaggtcgccgccgcttcgctccgcccgtggccctcctcgccggctgccacgtgctggcttggagagaggggagtcggcggcggcgttccaactcgaggagggaggcgtggtctggactagactggaggccgccggatccgcccgagaagcaagggcgggtgcgagcgagagtaacggtcagtttaacggtcagggagagcgaggttatgcgtgaccaggcccgatgtcaacgaggcccatagatccatgttaatttatcattccaattaaccctttttcgtttttttccattctagccagatcatgcaggtgtaaggctggaaaacatgggctgtgtttaggctatgtttagttagatccaaagtttggattttggttgaaattgaagatgatgtgattgaaaagttgtgtgtgtatgacaggttgatgtgatggaaaaggactgaagtttggatccaaactttggatctaaacacagccttagttccacgtcaaaattgaaacgatgtgacggaaaagttggaggtttgtgtgtgtaagaaagttcgatgtgacggaaaagttagaagtttgaagaaaacagttagaatctaaacagggccatggtttttcaacagtgaaatcaggatctttgtgggcaatggggaaaacaagccacaaataaatcctaaaaaagcagagtagcagagggttttacataacctgtatatatactcagaggttaaaaaatattcagaaatataattgtcgttgacaaacacaggatagcattaacggtacttattcttgattaaattctcaaagttacccaaagttgtcgtattcgtgaatttgggatttgtagtatgtaacatatgagtttcttcattgctactttagggttaccggcatgcaacatactattatgccctgaaaatttcaggttattcagttagccctatagttatcatgcaagagtgagaacatagttttatccagttaagactgagttattactattggctgaattcgtcaagaaacatatggatagctatacttattgggttttctcgtagcatgtgcagtaaaccagaatatgaaaaacctatagaaaagatccaacaagcagtctagtgtggaggccataacggccaatcataaactttcaactgaagcaacaactttccttatgaaaagaatcaaattaatgatatttgacgtactgatggccaatttttcgccctttgccatttgcctctattcctccccaagaaacaagatgagggcatacctcatttcaatacttgtatataatacaacatcgaatttatagctacaaatttgatagctgcataatacgttgtggaaaggctgtaacaaaatttacgtcagaaggagcaatctgatataagcaaccaaagctcattcatggttcccctctcgttgaaacctttcatgaaaccttcctgcttttagtatttaactattctttttgaaaagaagtatttaacgattcttcattgttccctgaacttgttgacctcaaacaataagggcttcaggttggatccagaagtctttgaagcattcaagcaactgctgtcaggaataattgacctgtataaagttaacagatcagaatcacacagcgtataatttagaggaaggattcaatgtgtactgcatgtctgcatggtcaggtgagagaaccacctctcgacataccaatttcctgaaaataacactgtcttgatccatactatattactatgtcgatcagttaaggtgtttgtgtcaatgttgaatgtgaccagctgaacatggactgatatagatggagaaactaaatgagatggatgaaaaatgaatctgatgaatgaatgaaaaactaaaagtgacagtatgctcaccgtagggagaggtggtggcggtgtgagccgaccccagctctccttcctgttcatcgcggcgcgagcagggaagcaggggcggctccggcgggagacagcggcgggaaacggcgggcgacaacgttcaagaggatcattctgcagcgagacgggcaatattcacgcaatttgaggtgcggttagggttagggggtggaggggagaggcggcggcgcgatggcgatgggcgaagcgggcgacgaggcggaggtttgagccggcggtgagggcgagggtgcggtggagacggcggtagcgatgcgattgttccgcggcggcgatggggagccgacgggagttagcgcgatggaaaaggagtggccccaaaaaatatcgaacttgcctggaccgtgggagattgggacatgggtgtgggggacggcgtgcgctaatccaatctatctattaatccaagtgctaatccaacttacaatgtgagacgttagatcgagggatccaatggttaggaaacttctgggtacacttttctgggtggatgtagaaaagaaacaactgatgttttttatattagtatagactactagcattggtgtgcttgttgaagatccggtggttgagctagtgggtgaaggcgtataagacaatgctgatgtagatcaacatggcggtgggcacgagcgtaaagagaggcacgacggcgccccacgcggtggcgttgccggcgccgcagccgatgtagacgagcttgacctacacaacaccgacgagcgtcatcatcaggaacccgcacacagagcccaccgccaacgcagagcaccatccggttcatcatcgtcgggaggaagaagatgacggggcagcctagttagtgcaccacgtatacaaaagtggtaaaaagtggagaagttctctctacgaaaatataagaagttatttaaataattaacaaatctaatagtggcaaatagttaaattccccgtaaacggataaaatgggagagagaccgtgagagcgagaggataaggatctcaaccaccacataggtcccgtaatgtacaacagtacaatcttttttgtttcttttttgaaaaaaaaaaataggagcttcagactggaattaattactgtcaagtgccactgtgatctagaatgtgctaatcaatgggattcagttccgctcaaaaatattttcttttattaagactttttattgttggcatcaaaatagcctaaacttctactttaatatttatttgaaataaagaataataattgtgaaaaaaaatagatttttttcacgagacatgttatattagagtccgcacgctatatattgtccacacatcacacgaccagtcaaactctacacgtatactgtatacacgtgttggttcttatacatgcatgcgaaatggtttactcaacatagatgacatttttattatagactaaagcttaaataggaggtcacatacagggatcagataaaagtagacgctattcaccgacaaaatgaattactttttcaaaaaataaaacaagcatgcttttcttttttaaagaaaaatacaatcatcaacaaaacgaattgtgtttgcatcaagattgttttcctcgtcaatttctcatttgtcgtaggacacctaacctgatcaccttttttttctattcatcatacaatttacttctgattttttttagtgaaagcgattctgctatttgagtgcagtgagcttgctgtgatagctagcgaaaaacatttcttctactatggctactctttacgatatgaaaaaactgtttattaatatcaattaaaaaaataaccatgcattacaaccgactcataataatacatgataaaattaaatactatatatggtttcaaactttagtctatgataaataattttattttaaagtggtattaatagttttcttataatcatccatgtaaatcgacccgcgacccgatcttcgagctccgttactacatgagccacaagagtcgagagcgaggcgtggctggttggctgctctccccaacgttacgcttatcatattgaccatacggatgacatttttattatagactggagaggattatcgaatggacatgctcttaaccatttttagctctaattccacctacactatgaatattacaaaatatacaatgtatactcccaagaaatttgcgctatcgtagccaccatgctcattgaaacaattttcttcacccattacaataaccattacaatgcacgggaattttgctagtttgcactataaaatttgtacatacgtatccctaagttttttttgtgtgcataacaaattttggaccggcccaacacgctgctagttgggcttagggcccagaaagaaaagaaggaaaaaaaaagaaaaaacatgtgagagacggggggtggcctcggctcggattcatgctgtgctgatgccgccgaatccgcctcgaccgatcggtcgtcgtgccctgatcgagttctagtccgtgaactcgaacacgaatctgtttccatctacgcactcgacgcgggcgcgaatccgactcgccgatgaactcgacggatcgagccgcgcccgtctcctcgccgattcgtcgttatatactagtcggacgtcgtcgactcgtcgtgagatcgattcttctcgtgttcttgcgttggtaagggacaagggcttcttcttcttcttcttgatcccaaccaagccggtggtggagcggcggcggcggaggaggcggaggcggcggccatgaggatcaacctggggaacaaggtggaggcgtggtgcggggacccgtcgatggtcgggtggcgccacggcgtggtggtgtgggggaacgggcaccagtacaacatccggtgggaccgcggcgacgtcgtctccggccgcatacggcgggtgtcggtgcgcccgccgccgccgcacctcgagatccccaccgacctcgaggccggcgacctggtggaggcgctcgacgaccgcatgtggaagctggccgagctcgtgcgcgccggcgacggcgacggcgagggcgagttcaccgtcaagatcgtcggctcgcccagcgccatcacggtgcccccgagcatggtccgcgtccgccaggtgctgactgacggcgacatctgggtcgccacctacaaggtatccatggccgccgccgccacccaaccctcttcttctcttcttggaatcttgcttccgtagcctgacacctcgccgcgccttcttccctgcagggcgaggagatcccgggcgccagggagccgacggcgcgccccaacgccgccgcaaaccgccgcgcccccgccgccgccgcgaagcaccgccccgccgccgatcagttcgccccgccgccggccccctcccaccaatgggccaagatcaagaggagccgccacgcgacggaccacgacgccgccggcgaggtccggagggtcgaggccaactcgaagcggatccgcgccatggaagaagaggagggggagctgctcgtaggatacgcaacgtggaggtggtgcgcgcgaacgaaccaccacccaccgccgtgttcgtcaacaagcagcaggagatgagcgacgaggagaccgacgacgacgccaagtccgtctcgtcggccggcagcggcagcagcagcaacagcgagagcagcagcgacggcagcagcagcgagagcgacaacggcgaccgcgccgcgccgaggagcccaccgggggacgcccaagtggcggcgaaccagccgccgccgccgccattgcagccgcaatgccaaccacacatcaaagaagagcgcgccgacgacgacgacgtcaggacgaagtcgcgcgccgccaccgcaatgaagccgcgaccggccgttgcgccaataatgcagcggcgcctggccaacgagcaacctccgccgccgctggcggcggcggcggcggcggtaggcgagcaaatccaccgcctggaggtggacgcgtacggcgcgctgatgagggtgttccacgccaccggcgcgctgacgtgggagaaggaggagctgctgacgcagctccggctgcagctccacgtgtccagcgatgagcacctgcagctgatacgggccctcaacggtggcaggaggcggcttccaaagcctgagaattaacgctgctgcttgcttgtttgaagctgccattatcagcagtttcgcattgcagattctgtgtatagatgtctatatgaattctctcccatctattttctacatgctgacagggagtggggatgtccccgaacatcatgtaaatagtgttgggttcatttgtgattaactctgaaaagttttgagaatagtgatgataatatatactagatccgatttttaatataagactcgaaggtttttcacgtaacgtttgattgttcgtcttattaaaaatatagtacaaatatgtagaaatataagttaaatatgtagaaatataagttaaagttatagttcttttattgataaaacaaaccgcaacaaaaccgataacatttatataattttttaataagacgaatggttaaacgtcgcaccaaaaatcaatagcgtcgtacatttaaaaaaacaaagggggtacgatagtgttttacgctttagtacatttacatgaaaatgcccaatcaaatcttgcaaattcttgaccgttggatcaaccatctaaacctagatttcatctccaccttgctatgtaaagagccaaccctagccaccgcccagatttcatctccaccttgctatgtaaagagccaaccctagccaccgccctgctgatgggcacatccaccgccatcccttttcctattatccttccttcaacgatctctaccgccagcccattccgtattatccttccagcagcagcttttccgcgtgccactatcacttctcatgcccattcactaccatctttccattctccaacgattcccatacccggattcgtcaccaccacctgttgccacctaaccactcgtcagacgaggtccctctcaccctgccatccttctctgtctactatccccacaacaccttcgctcaggtgctcacctctacgctcttttccattctccaacgattcccatacctggattcgtcaccaccacatgttgccacctaaccactcgttagacgaggtgcctctcaccccgccatccttctctgtctactatccccacaacaccttcgctcaggtgctcacctctaggctcttttccattctccaacgattcctatacctggattcgtcaccaccacctgttgccacctaaccactcgtcagacgaggtgcctctcacc

SEQ ID NO: 40955 - DNA, 12199 bp, Oryza sativa
atttttctctcttatcgtgttcacttcatcacttgtagaggatggcagtggcccgtcgagcagctttgaaagcccaaaaggttttgccaagttgggctcccgtccagagtccacacacctctcactcgatatcgatcatctcccgcctatattgcaagggaatcccccaaactcatcaaacacgtgcggttgtaaagaaatcccaaattagtttctcatcaggttaactccttcgaacagaattagtagtagcagactagcagtaatcgtgccgtctatccacgtagaatttgattatacttcagagattaagcgcgatccatacagcataaataagcgacgcccgaatttacaggataaaatatttgcttcgaaggcaaaggaagataaatatttgctcaaaactaacgcatcacgcagaccttcctccaaatatcgagagcggatcatacacattgatcatacgacagctataagcgcaaatatgttaacccgaagtaaccttatagcatcaatcaacgataaccaaaacttgtctgaactggtcaaatatccgacaaaactcccatatttaaccttggacaccacgaaaatttctccgaggcaaaaaagatctcttaggatataactgtgcttaaaaacagggctcctcgcaagacgatgtaaagtagcacattgcaaatctactcgatcaggtcatcgtcatcatctggcagtggttgggctgcagccgctgccagttcagcctcgtgcctgcacattacagagcaatcagaaatcgttcaacaatttgaaggcataaattaaacacccctggtagagcaatttcgtaagaacactcactgttgctgggctgctagatcaattgtgacatctggaggagcaagagcaggtgtttccacaaagtggaggttaccatcgctgacaaagacagagaacagagttggtttaatccagtaattgggttgctgaataattaaagattgatgataactgaggtcgttacccagcaagtttcctggcaaggtacaggaatggcttctcaaagttgtagttgctcttagctgacacctcatagtactgcaagttcttcttcctatggaaggtaacctgctttgctttaacctgcctgttcttcacatcaaccttgttaccacagagcacaattgggatgttttcacagaccctgtaattaatcaagacctattagtttcaaccatcagtttgtggtaaatgtatttgctcagttccactgatatacctgcataaatcacggtgccaagttgggacattcttgtacgtcagccgagaagtaacatcgaacattatgatagcacactgcccatggatactacaatgcggaatacatgattacagttagtacaaaataaatagaatttcagagctttgttacacacagcatacagtaactttacccatgagtgcaatcaaacagcagaatgccacaagataagaagtcttctcacaaatttagtagtactaaagttgtataaaatgcatggcatatgatgctcaaatccagcattcatgcatattatgagtcaaagctaaactgaattctctccataagcatatatcagcatcgtgtgcatcacaaattgttatagaacacaagaactaaacaaagaactatatatatctttctaattcacccactaaggcactatcaacaaaatccaggattcacataaagtgtcatgagaatacaatagttaaatacaggattggaaaggatcaactaaaatcacagaaatagtctcacacaatagtaaaattctaacagtgcttatattcctcatacaaattacaatgtactaggctaggcatagcaaagaatgacaaaatggctgaagatcctaaataactaatgagacaaacttcaaattcaatcgatgtaataatacttactagtaaccatccctgagtccaccaaatttctcctgaccagctgtatcccagcagtagaagcggatcttgccgcagttagtgaagaaatccaaggggtggacctccacaccgatagtagctgcagcaaccacagtcaaattaacacgaaaaacacaatgatccaccataagaatacatgataatgcaaaataggagcagatactcacgctcatacttcttctcgaactcgccagtcaaatgcctcttcacaaaggtggttttgcctgcaaatcaaaaagattgcctggtttcagaacagacagaaattttcgagcctggcaatttcgagcacaggaaacaagaaatttttaatcctataaattttcgaaaataaaaaccagagagttcacattcatccgtgacaaatcaaatctaacacagtcctcccttccccaccatccccttcccgagtcccaatgctatgtactcgaagaggagcgagtctgccagattaatcggtgccagatcaaaactataataacacagccttatttctctatctctaactataataacgatcttaatttatttacaaatcaaaacaaccactacaacgatcttaatttacaaatcaaaacaaccgtggctgtatctctccgttcaatctatctagggttcagcgaaccattatcaaggtcgcatcaaccaagcatcaccacacctataccgcaacctagaaccaaacagatcgaaaaaaatcgtaagagaggggagggcgatcgcgaggctaacccgtgccgccgtcgccgacgatgacgagcttgaagctggggtagtccaccgtctgctgattcgggagcgcctaaaaaaaagtaaaaaaaaaacaaacgcaacgacggtgagggtgagattggggggagatcgaaggattgatagggcgagagaggccatggaggggagcggggcgatcaccattggcggcggcttccgtgcgctcgagattggggggaggcacgcggaggtgtgggggattagtttcgattcgaaggtggcgaaggcgagagacgaggagagggggggttggtgggatttatgggggaggggaaggcggcggcgaaccctagcggggctagtagcttctcgacgtttggactgttccaacgtcaaagggcttttttttttcttttttttccctttttttctttggaggcctttttctccttttttttaattccgtttttccttttgttgccttttaataatctgagtacattacttttgttgccttttaattatgactgcacttaaaatgagacaaagagagtatagttttttttggtgatacgaaatacctaagagattatatcgggctaaactaatatgcatgcttgttatttccctagtcgcctgactttaggcgatctttctaatctttctatgggagaagttaccatcacttatataatatgttattttaaacttcttgctatcaaataaagtacataagttcttaaaaaagataaacaaactaatgtacatccactaataataaggtaactaaggaaatttccatggatgatggtttgatgtgggtgaatatcatgttgctcattaatcccctgatgaggcacgtgtgtcctctgcaagatgcgaggatcctctaagggacatgggcctagcctatgtggagcgacaacatagatggggtgtgaggatctcgtcatgttgttgcactatgaatgatctaagtatgcgcgaataaaaatctatgagaaaaggtaaacagagatagtaggataaagaaaagagagaatccactcactaccactgagttcagcatagttcaacaatatgccactgattttatcaacattcataatataccattgcctttcacttaacctctacactttatcatcgccgtccacagtctgtcagttatacgccgtttgtactgttatttttttcccgtaatgaccgaaataccctttgagccatctaaccctagcactgaccaggccgccccaatcaaccattctcgagcgccgccatcttcccagcgacgccgcggcttttctccgcccgccgccatgccgcatcagcgcccaccgcgacgccccatccgctggctgcccccaccgacccctcgccgctatggccagccctaatcctacgggacagccgcctccctccccatcgtcggcgcggccgccgtccccagcgtcgccccgaccaccgtccgcatcgtcggcgcggccaccgtccccagcgtcaccccgaccgccgtccccatcgtcggcgcggtcgtcgtcgccagtgtcgccttgacagccttcctcagcgccgcccctgccgtcctcagcgccgcccccactgtcatccccagcatcgccccgaccactgtccccagcggcgcccccagcaccattcccagcagcgcctcgacttccgtcctcagcgtcgcccccaccatcatccccagcgtcgccacaacccactgtccccagcgacgcccccagcaccgttcccagcagtgccgccccctgctgaagagccgtcgtcgcagatgggagaagacgccccttgtggagagcagccgttggtgctgccgtcgtcatcagcgccgccgtcgcaactcgcaactaagggacggcttcccttctgaagagctggtgttgccgtcgtcgtcatcgaaagaggtcgtgccgattgctgtgccacttaacttgtttatttagccatgtgttggtttctgtcctggaacatgttgtggtcgaacttggttatgccaaacttggacattggattttatgcactgttctgtcaaattgtgctatgcaccttccatggatgattttccttccaaacccctcactgatacactactttgtcctatgatgtgagatctcatatgatttagttgcacaatttttatattgcacacgtgctgtacataattcatacttaaaatatgttgagctatccctattttttacatgtttattcatgttgtagattattctttgtatagttattatcactctcagtgccctacatggcatagtctcagtgctaatggttttcacgttcctaagggcatacttgtcttttcctcgttgcaaactaacagtgtgtgacggtgatggtaaagtgtagaggttaagtgaaaggcgatggtatattatggatgtcgacaaagtcagtggcatattgttgaactatgccgaactcagtggtaatgagtggattctctctaaagaaaatcatagttctttctcttttttacggaaaaggaaaccaattgtctcaaaagtaaaaaaaaaaaatcttaggaccaaatcaattgtgataaatttagcaaactggtactccataatacaatccaaagtttcttaggccctgtttgtttcaacttatgattattataatctagattattaagccagattactataagctggattataataagctggcatagaataagctgtgagttgtttatttgtctggattattgaaggcatggattattgggtttgaatggctaaagtctataatgccctcagctatctgttcggttgatggcataggtgggtaatttttctcaagtatgtaggggtagtgggtctttagccacttaataatctgaaaaaagctcctctagagtagcttatcagattataataatctgacttatagattataataatctacttgtttgtctcagcttactcctaataaactagattataataatcctaagctgaatcaaacagggacttagcctacttctgttattcatgtatctattactacaaacaacaaataggggacggccctataggtgtcgggaactctagacccaacacctataagccttccccgaactcctaacaccacatgtgggtttaaaattaaaaaccaatacatgtagctctttataggtgccggtttattaaaaaaaatctatgacaaaacggtgtagtaaatatttgtacctgcttttacgataaaccggtacatataagaagagatagaaaaatcgacaccacttatgatggagccaagcagagccgaaccaaaccgagcaagccaagcttgaccacagtgcaacatggatggagcttgcgcaaagtctgaactcaagccactcggcgccagtggcgtgtgtcccctcttgtttccagttacccgggttttgggtggggatgaaatagatgtatagtgaaggtggtccaagatgcaaacaaagaaaatgttatctggtccgaagtaaaagtatagctaaacaagcgatccaaattaaaacttttctaataagaaaatgtggctaaatataaaacttactcttactttcatacatcatttacacatgtttaagttcgtttccgattgattttcgagcatagctcaaatgtatgactcaactttcaaaaaggatctggctttttagaacagaattaaaaatacacaattgacttataaaaaagtgagcactagtaatgcttcccattcataatgtctgatggtgcgtttaggttggcacctccggttaagttgatcaaccaaaccccttgtgacagaccttgcaccacgtatcacctctcctcttcacaacaaaacaccaaacgagcgcagctccaaagtataaccatgcaacgcgcgcacacgcgtacatataccagagtacacaccaaaaccaaaaaaacgagcctagcaatactacccattttagcacccaactttggtcgtgccaactgcccccaagtttaaccgcgccttgtattcatatattcatagaatggagggaatgcgacggcgttcgatgccacgcggccgttcgtcttacaggagcagccgccggccggccgtcttcttgcggaggccgacgagggaggcgtcgtcgatgaccggcccgcagagcgagccgtcggtcatggtgtggtagaacgtgctctggaacacgacgcgggtgcggttggcgatggcggcgaactcgaggacggcgcgcttgtacccgccggtgcccttggactcgtacggcaccttgatggaggccctcgccgcgtacgcctcggcgaccatggagcccgcgcacccgtcgcgcgcgtcgcccacggcgaacgacaggcggtacgtccacccgggcacggtgcgcacctcctgcaccagcgccgactccttgccccccaccagctccacggcgcgggcgccctgcggcacggcgaagtgcgcggcgtcgacgtacttgacggccttggacgacatgatcatccacgccgggagcggcgagtggtcgtcctcgatgttgggcgggacgagcaccccccacgacgcgttggggaggaagtaggggccctcctcgaacccgccgttcttgagcatgttccccttggccagcgtcggcgggtacagcgccctgatggcgacgccgtcgatgagcgggccgcacgccgggtcctcctccacgcccgggttgtggatgacgagcgccacctcgtccatcttcgccttgaacgcccacgcgtacgagtcccacccgttgctgccgtagatggtctgcatggggagcaccccccactcggggctcaccgacacgttgagctgctccgcctgggcgcaggtgcgcgccgcgctaaacgtgacggcgtagtaggcgcccctggtcacggcgagccgctgccggatggacgcctcgttgccgaggcgcacggcgtgcgcgccctgcggcaccaccagcagcatgtccccctgcttgtgcccggactcgatgtactccacgaacccggacgtctcccaccgcgggatggcgttcgcgccgcgcaccaccgtgccgttcaccaggtccgacttgggtgggccctcctcgaagttgccgttcggcaacagccctgcacaacacacgtcgttaatttttttagtcaccattaatttaatcagattaatccactaaatcagatattcaaatcggccgctgcactgcgagcctgcaactgaagaaagttgttggaggtgatgctgcggttagcagagatcgattcagagcatcagatcaggcacgcaggctgtctgtctgatctcgtgttctgttaattaatggaactgcgaccggtatactgctaagctgacagggtccatgttagtgtaacatgcatgttctgggctccggcagctagtagggctgtatgaccgtgtcagttcctctggctcggccagggcccaggtgcattcactaccatcccatctaccacatgcaacgcaaccagggccgcggccggcaaaacaaacgagaaaccaaatcaagagagcgcacaaaagcactctcgcatcaaacgttgcctaatgctggcagacgatgatactccagatctgattattgcatactactagtccagaacactggaccagagaacatatctgattatgcatctaacacgttcacgactagtactaaaaagcaagaatagtttcttgcaaatgggctgcagctgcatatgctttaatgcttgtatagttgtactactactacttttgctcggtcggcatctggtgctgcacaccacgacaccttaataggagattaactatacgtgtacttcagtttactttgccagccatgcaacatgtagattgtgattatgcatgcatgccccaatgcgatttggccgtgtggggttaaccaaactacagtataccctgtatatggtactccaatgatcaacgcatgatcgagttcgtggcttcatgctatgacagcgaccgggggaaacatttcgtcagtatatggataatggagggacccgggtgatctatcctactattcactccatgactccaagatcgtaaatcatcacggggcaggcagcttagcttgattacgagcttttagacactaatggcacatgccgcattgccgctgatagataggatcgatcagaacagcaaaacagcttatacagaaaccgcagtaacttcctaacagtatgctacataaatggatgcttgaagtgaaattagagctgagcctgcgcagtgattatcgagcagagttagcgagcaagctaggcactcaccgtcggtgacgacggcggcggcggcgcgcgccgccgcgcaggcgaggagcagaacgagcaccgtgacgcgacgcattgcgctcgtcttacttccttctcttctctcaacggtgaacgcgttgctctctcctctcctctcctcccctcccctgcttcagttcagctcgaggctgctgtgccgcttgggatgatgaggccgagcagggcagagcagcaacttatagaccaagctgccggcgaaacgggcctagggttggtcgattactaccacgaaatgccacgggatcttccgccgtacgcgtgtccccgatcggcgattcggctgagcggatgatgggctccctctgccctcgtggcctcgtaggagacacgccctgcgtgcggtcacatggccccctgatccgcttccgtttcctaccgcgcgcaccggctcgtgtacagtacgtgcggcgcgccgtctctctgcacgcgcacgcgactggctttcggcccggtgaggcggtgcacgacgaggggcagtttcgccatctcgtccgcgtttttttcgtcggttacgtatgcctctgcggttcccgtgataacacagatgccgccgtatgtaatcaagttggttaatggttagcgttcatcatgggattttgcgaggggacaagcatcgtagtcgcacaaccgggcaccggctggacgctgtggcgtgccggtgtttaggaatctttcaccacttttgtcactgagtgagctggttaccatggcacttggaactttcttttttccctttgcggtatggaccatttttcgtgatgtaggagtaagttgcatactcgcatgcaattcgaacggcttcacgtgaaaattcttgtggcccgaggttgtgaagctcagtttaatcatggaaatcgtaggttcagatcgtgtcatcatgtcatcacatcatttccaggatcatgttgtaggctggaaggccggacagcatcatgtatctggatcaaaccctgacaaggatactcaaccgacacatggcgcccatgtgtgcgcgcgtcttaagtatatacgcacttgattgcgcgaggaaacccaaacccccctcgcaaattgcaatatacatgtaccgagtatataccgcgactccgcgagtccgcaacaagattacaacacacccgaacaggggaaatcgtaacgcaagacaaaactagaaactcgattccacccaaaccagcacgcgacccagatggccagatcgacccgaggatgtgtgtgtgcgtgcaaggcgattgaccggcctgcgtgcctcatgcatgcacgcctgttcgtgtgaccgaccgagctcgagtctgcctgactggacgcagtattcgcagcacggcgcacagcaccaaccgtatctctcccctgcaatctggacaaaatttttccctggtgcagagagtacaaatgtacaattccagaccaatcgtgatgctgcaatttgcatgcgcgtacgtgggacgttgcagggggctaccacgacgtagctaggcatgtgctcgccgtcaacctgcacagggacaggagtcaccgcgcggtccgcatgcgcgcgcgcgccgcgcggtccataaaacaagcgatgggtttcttccatgtgacacgatgccttgttccgacgcgagctgtgcccgatcatgccactggtttttttttttttttgcccccaccacttgatccccatacatatgccggacactgataactgaaaagaccagatcttttatccatggggagggaaccgtggtcttcgactcttcagtttgcagcatgccctgttgccccatgtgaggggtcgcaccgcatgtgtgcatgttctggcctccatggcgctgatcattttcttggtagagtacgtgcagacgagacgatgcttcctttgcctgatctgggagttgtttagggagcaacacgctacgcgtaggtagtagtaccaattaacgaacggaaacggacgatccgtttcaatcaaccgtcaggaaaacggtcgtcgtcgcctgcatgtgctgtcggcggtctaacttaatgcgttggcccacatgtcagtgacggtcagtggcgaagataatgcgatgcgagtgtgtcgacatggtatggcacccgagataaggcattgctcgagaagacgatcgatcgagaagctaagctagctgccgtccgtgcactcctatctggctatttccccctccgtttcttgatgtgaaagtgaccgcccggagctggcggatcgatcacccgcggcgccgcgagtaaaaacggcaccgggaagggcgcgcgcgccaggaaaaaccacgcgatcacgcatgtaggagtattggcgagcgcgcgccgcataagagcaggtacaatagcacagactataagccagctgtaaatatattttaagcagataaatgagaaaagagaaggacagcgaactatagatttgtagccagttataacacggactctaagacgaagtgtgatagtagttagattggctataaatgaatttaagctagtagttagctatattattaaacttgctctaacgtaccgacaggcaaaattccgcagtagccctgcttgtttcatcgaccaaaccgaagcacatgcagaactgtctggggattaaagctttccgttcctcgatgcgtcgatcgacgcgtgtgcaaaacaaaaaaaaaaaatccaaggccgcgcgcgtcgtccggctttcatgctgtggtctgttctgtccgtcttctgtgtgtgctttggacttgctcacttgattgaatccttcgtcagttttggatggatgcgtccgtccatcgaagtgcctgtatgccggtcataagacaagagatagcgctggtacgtgtatagcgcgtcgtatctttgtcgatcggcacgtctcgcttcggatttacggcatggaagaacagaaacgctgcacacctcgcactcgctgtcttaatttggctgtacgcgcgtgcaatcgaattgtttttacaagttgctgctgcagtgcagatggacaagttgttgctgcatctcataattcaaaaaaatggtgatgggagggaggaattgtacagggccatgatcgatcgcctgcagtgcaggaacgttcctggcgggccctgccggccggctgcggatcgatgtgtggccgcgtgcgtgatgcggtggccgagggcccccggcgagagagagagagagagaggagaagctag

SEQ ID NO: 40956 - DNA, 1506 bp, Oryza sativa
atatattgcttagaacttgtgtggagctagctctgacatgagagccaacactctccacttttatttatctctctcttccacgtaagtatttagcttgcttatagttcaccattatccttgctctgatgtccgctctgcgcgccccatcgcgcggtgacgcggtgcgtggacacttgcatttttcttgtgtgcaaatgttggcattggcactggaggatggacgggcgtgtgttagatattgatcggtgtcaccggtcgctgtctttgtctcactctccccgcacctgtagtgtaccggtgtcactgtcagatctagaagggaagatgcatggaaagagtccgtcatcatcaccccaaagtagggacccctctccgagatcgatccaccatgttacatgtaattgtgctacgagtagtagtctactggaagtactccctctgccctaaaataagtgcagccatagtttttttacttaactttaatcattcgtcttatttatttttttaaaaaaaaataaaaacataaatcacgaataaagtactattcatattttatcatattataacaacaaaaatactaattataaaaaattttaaataagacagatgattaaagttggacgcagaaactcatggctacacctattttgggatggaggtagtactactgattgcccttgaaaggtcagggcgattccgatatggatggccgtgccagctcaagattagcctttttctcatctgacgaatagagccaattgggggacctactgatgcctgtttagtttttaatttttttttcccaaaaacgttatatcgaatctttgaacatatccatgaaacattaaatatagataaaataaaaatactaattgcacagtttatatgaaaatcgtgagatgaatctttttagtctaattatttcatgattagccataagtgctacagtaatctacatgtgctaatgatggattaattaggcttaataaatttgtctcacggtttccagcgcgagttatgaaattagttttttcatttgtgtccgaaaacccattccgacatccggtcaaacgtcagacttgacacttaaaaattctcttttcacgaactaaataaggcctgagataaaagaagctaacacggatgtacaataacgctaaaaacgaatatcgatacttgaacgaggaggaattctaatacctcaagtaaacatttactcgttatttatatgtaatttaaatagttataaaaaattattcaacaagataaattaatatgtgatagatcactccacaaacatgcaagataaaattcattctacacgctgtgaaaaaaaaattaaactatggctagttaacacatattcacaatcaaaattggttttttacttgtataagttaaatctgacattgtatgtttctagagtgatttatcacatattaatatcttttgttgatttttttaaagtttcattataatcatttagatgacgtacaaacaaggagt

SEQ ID NO: 40957 - DNA, 1133 bp, Oryza sativa
tgcagggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgg

SEQ ID NO: 40958 - DNA, 718 bp, Oryza sativa
catatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgagttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctc

SEQ ID NO: 40959 - DNA, 1705 bp, Oryza sativa
  unsure (1)..(1705): unsure at all n locations
cagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttctgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgccttagctctgatggcatcaatacggatatgactgctctttgtggtaactattctaaattctataatgtattaaatgtgatcaatatttagtagcacaacccaaaataaaaaaaggccgattatcctgattgtgacacgcattaaaatgcaatctgcgccccgaattgattgacagacaattaaattaataaaaagaaaacccatatagaaaatgaaacggtcgacccagacatagacggtcgacccaggcggatataccctataaaatataggacgtacgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctagtcagcttttttgtctgaatggaaccaaggctctctgctttctagatgatccctaaagagtaggagatagaaatttgcctaaatctatctaatctaattacttcgttccctaatttcatttaagcgatcctgaggaaaa

SEQ ID NO: 40960 - DNA, 1996 bp, Oryza sativa
caaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatttagggcttcgtgaatatgagttaaatccattttttttctt

SEQ ID NO: 40961 - DNA, 3344 bp, Oryza sativa
cgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgata

SEQ ID NO: 40962 - DNA, 9248 bp, Oryza sativa
tggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcacccctaccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattga

SEQ ID NO: 40963 - DNA, 2588 bp, Oryza sativa
agacttaagcaaaactcagattgaggaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccagaaatagctgatttgaggatgatcaatttaaaggatatgttcgccgccttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaa

SEQ ID NO: 40964 - DNA, 1696 bp, Oryza sativa
tcctcttaatattaatctagtcttatatgggtttcggtatattgaaatataaacagaaaagagagggtagaggataggctcattacattaaaaaaaatatggaagtagccatagcaaaaaaagaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctgga

SEQ ID NO: 40965 - DNA, 27036 bp, Oryza sativa
  unsure (1)..(27036): unsure at all n locations
acaattcgcctctgctctcgataaaacaagtcacaatcaattggcaaggggccgacgattacgaaaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaatccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttcccggagaacccgtaaaaacttctgcacaaaaaacgggtgtgataaaaagcgctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattctaattaccgccgcccgaccgtatttttcctgagtggaaagaaaagataggaaatctctcttttaaaagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatctgggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaat

SEQ ID NO: 40966 - DNA, 14675 bp, Oryza sativa
tcatcaaaggtcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 40967 - DNA, 1262 bp, Oryza sativa
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaat

SEQ ID NO: 40968 - DNA, 1652 bp, Oryza sativa
  unsure (1)..(1652): unsure at all n locations
aagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttactcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 40969 - DNA, 1566 bp, Oryza sativa
gaccatcctacaaaaacaaaacggtcccttcgtaaccagtcgtccataatatcaaataaagcattctcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctcccttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggtt

SEQ ID NO: 40970 - DNA, 5173 bp, Oryza sativa
  unsure (1)..(5173): unsure at all n locations
gggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaatagaaataaacataatactgtttattagtgtcgcataaaacccgaaatggggcgtgnnnnnnnnnnnnnnnnnnnnnnnnnnnnnnnnnnnnnnnnnnnnnnnnnnnnntccgtcccagattttttctgatgaaacgaaagatgaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattccttttttcgaactatatttcattcatatgatagaatatgggtttaaataaattggctctttgcggagtctttcccgataaatacttaatttcttttattcatatttctccatagatagcaaagcaagtttgaattagatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaaccgtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactctttcaggagtacatttatgtgtttgcccatgattatggattaaatggttccgaacttgtcgaaattattggttctaataacaagaaatttagttcactacttgtgaaacggttaatgattcgaatgtatcagcagaatttttggattaatttggttaatcatcctaaccaagatcgattattggattacaacaattttttttattctgagttttattctcagattctatctgaggggtttgcgatcgttgtagaaatcccattctcgctacgagaacagtcttgtccggaagaaaaagaaataccaaagtttcagaatttacgatctattcattcaatatttccttttttagaagacaaatttttgcacttacattatctagcacatatagaaataccctatcctatccatttggatatcttgcttcaactccttcaataccggatccaagatgttccatccttgcatttattgcgattctttctcaactactactcgaattggaatagttttattacttcaatgaaatccatttttattttgaaaaaagaaaataaaagactatttcggttcctatataactcttatgtatcagaatatgaatttttcttgttgtttcttcgtaaacaatcttcttgcttgcgattaacttcttccggaacctttctggaacgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtggcaatattctttctctttttggactcaaccgcaaaggatccatctaaaccaattagaaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactggatcggggcatcctattagtaaaccaatttggaccgatttatcggattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcggtatttttagaagaattttttac

SEQ ID NO: 40971 - DNA, 2081 bp, Oryza sativa
ctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagatgtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagata

SEQ ID NO: 40972 - DNA, 5116 bp, Oryza sativa
  unsure (1)..(5116): unsure at all n locations
tctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtat

SEQ ID NO: 40973 - DNA, 7380 bp, Oryza sativa
ggcaaaaaaaaataaagttcgttataagaaattaatcagtcagttggatataaggagcggtaatttcatcgttccaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtaattatgttagaattgagccgtatagcttctcacttgttatggcttggaccttttatggcagatctcggtgcgcagactccttttttttatatttttagagagagagaattaatatatgatctatttgaagctgctacaggtatgcgaatgatgcataattactttcgcatcggaggagttgctgccgatctgccttatggatgggtcgataaatgtttagatttctgtgattattttttacgaggagttattgaatatcaacaacttattacacagaatcccatttttttggaacgagttgagggagttggttttattagcggagaaaagctgtaaattggggcttatcgggccccatgttacgagcttctggaatacaatgggatcttcgtaaagttgatcttcacgagtcttacaatcaattcgattggaaagtccaatggcaaaaagaaggggattcattagcacgctatttagtacgaatcggtgaaatgagggaatccatcaaaattattcaacaggctgtagaaaaaattcctgggggcccttatgagaatttagaagtccgacgcttaagaaagcaaagaattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaatgaaattggctgatatcatgcgatattaggtagtatagatatcattatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaacgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataataaatattctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatccatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgc

SEQ ID NO: 40974 - DNA, 1118 bp, Oryza sativa
gccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 40975 - DNA, 1697 bp, Oryza sativa
  unsure (1)..(1697): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaataatctctacatggcagtagccatatgttatcccggttgttttgaccattcaaatgtttgctttctaggcctcctttggaggacttcttgtgggatctgtgcaaatttcatatttgctacagcaatcatgtattccaaaaggaagctcaatccatacagtagacatcagaactagaaattttacaggagttccacgtgaagtctaagggcttgtttggcacagctccagctccacccctcctggagctggagctcggtcaaatagtttcagctccaccaaaactaggagtggagtaaactaggagtggagttgggtggagctctctcacaaaataaactagagtcatttccacaactccactccagacccaatttctggaactaaatttaggagttggagctataccaaacagaccctaaattctcacaaaattgcactcgctcctgctccggctctggctccggatctcctccccctcgccgccttcctccaatcgagggcgcttgctgcgcgcgccgtcgtgaccaccagaggagctgcgccatctgctcgtgcggcccttgcccgggatctcaatccctcagatgggccaaccctaaggccctgtttgtttaggcttatgtttagctgggcttttctagttaggacttattttcttcctggctttaaaagtagctgtttggtggatggcttactattgaatggtaaaaaacacccatcaggtttgggtttcttgtttacaagccgaggacattgtaggagtaattttctcacgtaataatattacttttttttcttgatgtatcgcttttaacactttaattgtttccttatttttaatatatacgaattagagatacaaataaatatccgttcctaaatccgattgaggaataatatgggatagatacgagatgagtgacatgttacctggcaccgtccgtaccaggttccaaatttgaagaaaaatatgttaggatatgggaatatcgtgatccgaccgaacccgcccgttttcacccataccattaccttggcagtagtatattagtgaaataatacaatcacaaatatttcatgataatatacaagtaaaataatataagcacatatccttcttctgtaaaaaaaaactggatgtttttaaggtttctcaccaaaattagtaactactaaaaatgatttaccccatgattcaggtgtcattttaataagtgtatatatacactcaggtactggagaatatttactgattgcaaaaggtaatgaatgctttcacagcttgttgccacatggtacatgacttacacattgcgccatggccataaaaattagggataagtccatttttcacccttcaactcttcgctttatcttaaaagggttaattggaatcattccattgcaacttcggctatttggaaatatgccattataattagcgaaaccggctaggtgccatc

SEQ ID NO: 40976 - DNA, 5846 bp, Oryza sativa
atttcatcgtatttacatgtagattttcagttgatgttctctcctttcatggtaggcactggttttcagtagaggttagggttggtgcttatgtcacgatagaaacagagcgaccaccgccactggtatagctcgcctccatcgccgcctccaacctcgttgccacgttgatccatctgcgccgggagaagctatcggtacagctgccgccgtatccctagcccccgtcgtcgtcgccggcgccgtatccctagcccccgtcgttgtcaccggcgctgcaccaaacgccgccgagatctctatcggcgagctagggtttgcagacaatggggaatagggaatggggaatggggaacagagatggttaagccggaccgggatggctggcttgtatcgtctcagccaggggcacaagcgtccatatagaaatacgtacaaggacaaatggcatggatggtgattcagacgtacataatggcatggttccaatttggaagaaattgcgatggcacctagccgatttcactaattgtaatggcatatttccaaatagctgaagttgcaatgacatggttccaattaaccctatttaaaatacaccagagcatttctagcagggaccctaaatatagcccctaaacagattttgggtgttgaggcttaaaaaactcaatccagcagagcccctatcaaggatcctaaattaggcaggcacccaaataacctttccaagcccccaggggctctactgcacagcccccatccacggttggaaaagcgcgggagctgcccgacgtggtcttggtccgtcggcacctcccctgcccagtgcggcagtgcttatccccggccggtgcggctcctccctgcctaccgtgtcctccttcaggtgccctcctctacccgacgctcctccccggccgacgcgtttgccgtgcctggagtctcctccagcctgcactctccacctgaactcgatgaaaaacatggcccagtgaccgagtcatgcgatggcgtcaaggcactggatggtccaagtgctgctgcgggctgcgaaattgagacagtagtagcagggtagcactagcaactgcgattgtgggacgaaagaagaatggggaaagtgatacatgcgatgtgctatgcagcttttttgttgctttgcttggttgttgcttcgtgagagaagtagcaggtctattggtggatgagaggacaggaaaaatcagcacatgtgagaaactgcatggaagcgcgacagcagcagaagctcgtttcacccgagctatgaatacaggctactaggatttgtatttccattttaatttttttttaaaaaatcgaatttgaattgtgatgttttgaattgtgaatttaaatatggttggattattatggttttatactaggagtagcgtagagtatataactatagattagtactttaaagtatatgttaaaatagaagatgaaatgaaataaggggtgagaaaagggactgttgttggagttaaaaggtattttttaggtactcagaaaatggggaagcccccattatacttttaggggttgtaaaataggagctattgctggagatgatattttacactctcaaactttctatactgtgtagattatcccctttgacggtttctagcatggtttttgcaattaattatggggatatgcaatacagggaagaaatcgtacgaattcatcagttatttaatttattgatgtgtttcgctgtgcaattgcacgccgctggaacagctagatgacggagcgcgctgcgagcaggtcggcgacgatacgtgcgcgtgacgagccgtgatcagcggtcggcaagcggtttcgccatagatggtccgtgcgtggatgatggatcggtggtgctctagaggcggccgagaagtgcctcgtgtgctagcttctgatcatcgatcctggcgtcctgcggcggccatggctgttcaacgttcgccggcggcgcgcggggcggcatcgacggcgaccagtcgaccaccatggcagcggcaccgacgtccgcattccgcccagcgcgcgtgctcctcctatgtggcgcgcgcgcaccacaccgtcctgagagtgaaaacggtcggaaataattaatcatatttatcatttaaactgtacggggccaccattaatacgatgcagaaagaaattaaaaaatcagaatatataaatagccaataatgttgcggtcggaaacgataacctttatatggaaatggggtgctcgatcgattgggaattttcttgacctttttcaccccactgcagatcgattcgagggaggttggggaggctacctacctccgctagttgccagtggaaggaaatcccaggctcgaggtggaaatggagcttgtggaagggtcgacggcagcaatgtaggaatcgtagttagccagcagtttttcccgccggcgagcccctgcaaagttgcgcatttaccgtataaaggtcggtgtcagatgacaccgatgactttcggtaaaacctatgagaatttttacggtacaatatactatcattatatactaccaatatataaaagggtatattcggaacttaaaaaaaattgaataagggatttttagtaattcgtcagatctgatggggagcaggggcggatccaacgtgagtgcaggggggttcgagtccccctgcacccacaagatctatggatacccctggagcacccccttcaattttttcaccatgaatgataaattaaaggtccttatatggctggagattgaagaaactgtgtaattgagcactctcaattttttgtttctatatctgccccctgatggggagtaatcggtcttggatctcatcatgcatcgcgagcgcgattagattatggcgcgtgtggcggctgcatggtttgatgagcaacgagaagccgaggagacgctggacgcaggccccaagcattcgcggtggcctgtggcctgccttccggctgagcctcaccggccacggcaagaaactgcgacgagctgattcatagtgtacattgagcgatcttgttagttcaatgtagattctactcaaaattgttggctagtacggacaacgtgaggcaaataaatcaggtactgatttagtgctcttgggcttgtcttgcgttcagtaccagatcggcagatgaacatggaagttcataaaaccgactgtgtacattgcccttacaattttatactggaatctcattaagtggggaggagaatgaatctacaccattggatcatttatgctagcagtgtatactggcagtatagtgtaccgtctaaacataattagcatactatgacatcgataaatacgttatgacaccaacgaatcgattttctatatccgccaccactgcaaacctcacacaaacgctacagcgtaacaacttgcttttctgatgcattatatatatcccctctacttaaaggaaattacatgcaatgcgcgcgagccgcgcacgactgaactcctgctgtcctgcacttgccgcgcagacccacgactcaaaaaagaaaagatgccaccgcatgaactcggatacttaggcctatagctgtgcacatgaacgtgttcgtgcagatcctaagaaggatactgtggtacatagcgtgactcgcctgaaatatgtcaacaattctcagtacgggcccacctctgacggtccacaaactatgagccaaagtgctcaaggatgttcacagctttgatgaatccattgagagatcgtaacaggtgaagccaccggccgaggctcgtcccaggtatctagacacatgtgacgggccggcacccacacctaccagaaggatacctctgtcaggtgccagtgcaagcccatcacaggtgaccaaatacctgtgacgagcctcgcaattacgtctcgtttgaggtgagtataactcatatctaacgggcttaaaccctaacccgttggagttgtcttgtcgtctataaatacccccaaccactatatgtttttcatcccaatcctacgcactgttcacattttgggcgggagaataaggggggtgaatttttgttgcaagaaaacgtgtgataattatttgatgacgaatattatgtattttgtctgatacttgtcatcttattgtttgcagatggaccaaagttggatgtacggtattgatagttggtcccaagagtatagggatggggtcgctgaattcctaagaattgtagataatgataggataattaggatgagcgaatattagaggatgttctctgatagttcatgggtgcattctgtaacatcctgaaaattcctgacattaaaaatcactaaaatttcaaactttttaaaactttttgcatcatgctggaagttatggttgttattgcttgccaaaccataaatcgacgcaatggaaaaaaaatcaatctaaagatttacacccgagcaatagttacgatttacaacgatacgatatttattatcaatcccataaatatttatgcacatggaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggccccatctataatagagtatctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaatttttgatttaaacctcatttaaataatacaataggaaaatatataaaatatgggtaatattaaattttggtcaactttcatctaaaataaaacatatattgggtaaaactctaattgtgtgaaatctagaaattatgggacaagttttaataggaaataggcctcaaaagtggataattaggaaaaagtcactgttcattatggcctaggtgtttgatgtggttccctagcccttcccccctccactgccgcgctccccctcgcgccccgtgcccctgcacgcgccgcgccgcgccgctgccgcccactgctgcgcgccgcctcgcgccccgcgccgctctcgccgccgcgcgccgtcgcgccgcctcgcgccccgcgcgccgtcaccgtcgccgtcacgttgccatcaacaccgcgccgcgcgccgtcgacatcgccgtcgcatcgtcatgatcgcctgtcaccgtcggctgcgcagcgccgagccccgcgccactcccgtcgccgcgttgcgtcgcccgtcgcgtcgccatcgccatgcgccgcgagccgtagccgtcggccttgcaccccgagccgccgcacgcccgtcctctcgctgcctcgcgcctgcgccccgccgcgcggccgtcctgtcgccgtcgccctgagccgctgccgcgccccgagccccgtgccgctaccacgccttcgcgtcaccgccgtcgccatcagcgcctcgagcccgcccgcgccggcactgtcgccgttgcgccgcgtcgtcccgccgccgcacgtc

SEQ ID NO: 40977 - DNA, 3938 bp, Oryza sativa
attttgtttataaataaaattgcatgcaatgatgaacatcctacttgtgattatgccatgccttgattattgtttgcccttattccttcgtaaccaggtttacgtatgagtccctagtcaattatgacaaatgcttagaaatgctattctagaatcatgcatactcatatttatcaaatgctatacgcttgggcaattacctttgggaaggtaattgagatgcggcatgtggagacatgagcgccacattgccatgatgttgatgacatgatttgtgaaaggagaaataaaattaaacaatttttttcgactggggcggacggaggatttgggtggtatctggaaaaggctagtaccatccccggtcaattaaggaccgagccatgaagttaagcatgaaacgacccccgtacaaccgcacttctcgtatgggtatagacctagcggagtagatagctgagcggaggcagtatccatgcgtagtggtcttcttttaggtgtgtgatacggcaagcagtctgctggcggatgcccggttcggatggcctggtggatggcggatgcccattccggatggtcagaggctggcttggcaatactacaagaggatacccataagagaacaatcatgatggactgggttcaacgacaagaaacaacgtaggaatgtgtgtgtttttcccttcccgggagcgccagaactcctctcactgctagaaacgtatgacgcctagagtgcatgagggctaaagttcatggagcgggtactgccaatgcgaggttatcgaaaagctttgccgtgacgtgtctcatgtgttgggacgaggcttatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacttcctgagaggagggaaggtggacgtcctcagaaaaccatgacgactcaatggcgggaagctatccttgggattacaatggatggtggatagaaccgtcgttgtttaatgtgaacactggtattaaaacttgatcagtctatgctaggtcttaggcttgtgaaaagatttgcaaaacttgttttgcgcaaaggaacctgaagccattccttgaaataccctctatcatatgcatcgttgctgtggtggcttgctgagtacggttggtactcacccttgctattcatatatcttttaggagagtgttgaagagaagcccttgtcggtatgcttgcgtatccaacaagatgatcggaatgcggtgttgttctaggtctcgttccccagtcgactgcctgtggcatgttaaccgggcccttatattattttgtcttccgctgttgttctctgatagttgttggcctacctagccctaatgtaagtatttaactcttttagcatgaattcattcgtgatatgctgtgatccaactatgtatgtgtataccaactactgatccagggattggtacggataaacacagaagatttccgatttccaaaatcgggggtctacacattctcatctaattcatagagggttcatgaagcattacagttgttggagcaagcatgaagaacaagagccacatgatgttgtagctgatgaagtagatgtagggaataggctagatcgagatgacatgtttgtccattcttcatttggtatagataccataaattttgaccttaaaactctgtccgaaatgtttcgtgatattgaagacccatatcacgataagagagattttgaaaaattcagtaggttggtggcagattctgatgcacctttgtatcttgggtgcaaaccaaagcaaaccaacttatcatttgtgttggaactctgaagcttaaggaaagtaatggttggccaaacaagaatttcacaaaatcctctcgagttgttgaaggacttgttgctagaggagaacgaaaatcccacaaattgacacatgaagcaaagcgaatcttatgcccattgggtctagaggtcagaagaattcatacttgttagaacgattacatatgtattacaaatagtattacggcttctagatacgagcaagacataagtgaagatgaaggtcatcagttaaagaggagtggctccgtaaagatagtgtgatatcttccaattgctaaccgcatgaaaaaaaactgtttgtgaatcctaagcaagctaagttagtacattggcatgctgaggacagtaaaccgaggcattccagccaacttagtgtagtgaaggacaatcgataggttttaccccaaatttgcaaatgacccaagaaacattttattttagccaaagtaagaaagttgaggcgtcaatacattggtactttagagtgacttcagtgcttcaaagacgacctattcacagggagcaaacatttagaaaggacacaactacaccgagagtgctagctggatagtgctgaagagagacaccattctttccaaaaaaaaaaaagctactagtacactcaatatctatatatttttttcttcttagagaagtttctcttaaattactcatccgatttataatccgattacaccgttgtgttcgtaacaattaaatatttacaacaagaactcacatgattatattttgatgaaaaagcacaaattactttcatgatatgtctaaattacttctagatttcactaagttacttattaaacatataaaagtaaattcagtaaagcttaaaagtaatttacatatattataaaagtaacttataacaaaaagaaagtgactttaatttagaactatatctagattcattaacattaatataggcaatactaaaatgacttgcattatgaaacggggggagtaactctctatagtagaaataattatattgtgagtgagctgaaataagaaactatgtagagtgaattcgcaagtaaagtgtagagaagatttataaagtccacaaattatagaattaactaaaaacaataataaaaataatcaacttagagcattatgaatgtatagaagtaatttagtcaaatctgaaagtaacttatatatattataaaagtaacttagtatataataaaagtaatttacaaatataaatatttttttatcgtaatataatcatgtaagatcttgttgtgaagatttaattgtaacgaacataatagtgtaattgaattgtaaatcggataagtaatttgagagaaaactttataagaagaaagaaaaagacacacatgtctaagaggaaaacagcacgcacatcagcatgtgtagcagtaattcttctcacaattgaatcgtcgctggttaaaactaaaccgagaggcttctcggtttagattttaccatttagaaagcttactagcacaccacaatcaaggttcacaaaaccgttttagatggagtttccaccacccccaccataaagcgtaataaaccatgtgggtaaccacacgactaccgtgaaaaccataaggttaccacaatttaaggttaccacatgtttaaggttaccacaaaattaaacatggattcaaaaactaaggttaccacatgtgatgatcgcgtggttttgtaaacgctggtgactcacaggatttccaaacgtaaccaatacggctcccaccgttcagtcaagagcctgcacctcaacaaaatgtcaccattcatgagcacgattacatgactacccaaatacccaacaaaacttaagccttcaatccagagaacaaataaaataggcacttgcaatctggtactaaacacatgaaaaacaatcgcagcagaacacaggccaaatatagtattatcaaaacatgtg

SEQ ID NO: 40978 - DNA, 4887 bp, Oryza sativa
acagaacatttgctctcacggttgtggaatcaaccacgcagaaaacccatcacgggtttaccagcatccagccagctccataaaatgacagctgatccaaaaaagaaaatcacgcgatctccatcaatgactacaagctctagcattcgttctttcaggcaagatcaccaaacatcatttctgtgaacctaaatatcaaaaactataaagaaagcatacataatgttcagataaatataatggccatgtgcgagagttctgaaagggctggccaccccccatctatacccctatacaaagccaatctgcaagcgttttcgtggtaccatggaggcaggcgatagcggctgcaccttagacttcacggcgccagccaatcctgaagtattgacatcgtaccactataagctccattttgtcttctatacaggtgaagcgatgtgggtagcgtcgtcagcatctctcagtgcacaagttgccacctcttgttgtcaagccccactgtgaactaccatgacaagaaagagatgtgttgcaatccttgtgctcctcagcaatggtcaatggtcgacagccatagccatcttgtacaaagcttgcctcaataaatatccatgtagtgctccaacatatgcttgtgcccaatacttgcaactgatgtctatgcaccatcgtttctgcattacagtgcagaaaggcacaaccaagctgctgtgggccaaggatacaacccatcaaacttccaaaacttaatgcggcttcagcaattatatcacaagctttcctgatcactggggaggaggttggagagactgcggttgggtgttgtaatgagcatatgactgagagtagagcgggttcatcatgggctgcaaaatatcatgttacctacacactccctgagaaagataaagttacaattaaacagataatgaaaaaggataaaccacctgagactgaagaccaggaccagccattccaaaatgcatctgtgatgactcatcttgtgaagagtcattgtatcccgcttgtgtaaacattccatgtgaaccatgggccatgtgatcctggataacactaaaaggttactcacagaacatacacataaagaaggcttgaaaaggcagttacttttcgtaatagttatgaccgagatagaacagacctgagagacaatgtcatttgctgcacccatatgggaataccctgggtgtgcattttggttcaaataattcccaggatatccagattggggtccttgagagtagtcaacaccatagcctccttgagaagcctatatatgaacaacttatattagaaaactcttccccagagtaaacgcaaactttaaactttacggcattgccataatttactttccaattggttgacaaatcagatttaactgaataaatgaattggcacagaaatacaagagacatttgaaacaatgggtacctgagtggaaaaatcagcaatgttgtatgccacatgagatccttggctcttgaaatcatctccaaagaagtcctagaaaacaacaaaaccaaattttgtcatcaaggatagaacaagatagtaaatggcatgcatgcatcattaattgctagtacctgagacatcccaccaatggaaaacccatcgcggaatgtttgactgagaccttggacaggcatctaattgcaaaaggcaaatattactagacaggtacttttttttgtatgacatatattaatagaaataaacaaacctgtgtcatcaatccagtctgggacattggacctccaccagaaggctgactgctcggattctccaggccaggaaagttaaaagctgaccccatgcctcccatagcttgctgagaactctgttggtgagcaaggtgcccaccaatagggccaccagtatttccacgaggtccaaagtttctgtttccaggttgaggcacaggtggaacagctccaatcggtccgtgcaatgatccccgggttggaatagcatagggttgagaatgagccccagcaaatggagggaaaggcatacgaggtaaaggatagccagatgggtgcacaccaggtttatgagccccatttggtgggccaaatggaacaaaggaatgccctgcatttcagaaaagaagaggagcgttaagagaaaagagggtaaaattagccaaaagttacttagaagcagaaccaaacaaaattaactatctacctttccccctaccacttctcttatctgccactgggtttgtgcctgcagcaccaaaactagctccttgcataacaccttgaccgccacccaggaagagtgtcgatcattgtagatctactcaagcatatactttgttaatttaataaaacaaaaggaaccataatgtttccaacaagtatctataagagtggaagaaggcacccaccttttttggcttttgaaattgcaccatactctgctttaagttgttcaaaggtccttctaccaaacactcatgctcctaaacacatggagattatcgagtgaaaattcaaaaactcagaagagctccttactttcaatatctactattagatatgcttatccaatgaacaggaatatctctcaaatagtaccaagcatcacgtgcttatagatttacaaaatttaggctgagtttggtgcaaaaattgtataagtttcttaaaaaaaatcaataaaatcattcgcaaatgctccgtctcgttttgcatgaaacaaattagcccagccaaacgtccagctcaaacacacctttagttatataaagaagcaagaaataatactgaaacaggacaattggaatggaaccacttatccgtttgtcaaatactcaaatgtaaaagaccttgaacacatgcaggtagaaaatacacatgttccatcaacactacaagcattcaattctactgtcaggaaagataacctgttcaaaaaacacctaacaatctgggcataaaccccaaaaataagcaacctgaacagggtatgcaaagcattgttatgtactgaaggaaagcttataccttataatgtgtcaataaactattccagagtggctgcttgcttagaactttagggttcccaagaataactataccgtaccgagcacgagttaatgcgacatttaacctgcgtggatcattaagaaacccaataccctgaaaggtgaaaaaaaaaatatcatgtcagttaacacaaatttgcgaaacaaaaaggttgttcttcaagcaggaaaagctagaatatgcacagacaacacagttcaatccttgcacaaaatatacaacagtctgcaagttaaactactgcctagatgcttaacataagaatttacaaagacaggcttaccaccctcaactgtcattgccaatgagtttgaaaacataaatagaattttcactaaatagaaaaggccaggtcagagtacatctataacgccctctagaagtcaatgtgaaatactgtcaagaatattatgctgcaaaccaagtaaaacagcaaagattacctggtgctcattgcttctaacacaagacaggattatgtaatctttttctcttccctggaaggaatcaacacttgctacctgaaataagtataaatcttatatgacaaggcagctttcaccttggtaggtttaacggaacagtatacatgattggtggttaacctcaatttctttgtatagttgttggcgaagagagccattccttgacatataattcacaatatatgccctttgtccttcataaggtgtgataactccaatctacaatacattccacaaaatgtgatttctttttttataaaagaatcaagtgctgcaaaatgttactagtagatgaaaaagggatcatcactgcatacctggcttggtacaacaccactccttaaaaatgtagttacaatcttttcaacatttgcagcttcagttctattgaggtatgatgtcccactggcactgatctcttcttgtcccatctacagaaaatcagtacgagtctcttgtgtaaataagcaagaagagcttttgcagttaggaagtacagaagaacaaagatcaattggtggtggtccaagaaggtacctgcacgtagaagaacataggccgatttggaacaggccaaggaaaatcaatcccaggtgtctgtctctcgtttacagttactccattttgcagtgtgccttcatagaagcagttggacgggaagtctgaaagacaagggtgcatcctatattgtacctgtaataacagatgattatgttagaactattagctttgttcccaaggaatgttaattttcgaacgcaaaatacttggatataactcgtttcaatggttacttgggtataatttggtgaattgattgtgtaaaaacaacgacaatatcgggatgaacaacagagatttgatgattcatccccaaaaaaggcttaaagaaaaaccagaaaatgcaaagtgataagtaatgttggaacatgtactattcttaataattcaaagttttgtccaatgatatgacaacgaatattaagcaagacagtttgttcaaattagaatgcctgcactaaattgtacctgacatacacatacggggggaaaccatttttcaaagaatcctcacaaaagtaacatgatttatgagcaatctcaggataacttaaaaagaatgtatcagttaggctttaaatccaccgcttccaaagttttgacatcaatgtcacaggacaaggcatggtaagcatactcacaccatggtaataatgtggagaaacagaacaccagattcaacaattacctgtagcctgaaaggcttgactccaaggataacaagccgttcaaagagcgattgtgctaatcctgcacga

SEQ ID NO: 40979 - DNA, 6686 bp, Oryza sativa
catcacctcaataaagagcagacatcaaaattaaactgctattagaaagaaagtattacttgacggaatcggaagtttgctaaacgagggtctccagcaccaacacaagtgcaacaaatcacatcagcactttgtaatatctctctctcagtagctcgttttaatgccttgtactttttctcatcactgcttgacaattcacctataaaaatagaatataagaaaattttctaattcaaccaaacagaatggccgagagagtttaaggaccttgttcatctttgagttgctgtagcttatgcaattcactcttttcagatgtatcaaggtgccgaacctacgttttatgcataaaggaacatcagtgacatcatcaagcgtatggctatttcacaggtaaacaactagccaagaatcaagaatgtacctgataatgaagtgtcaaatgctcaacaggagatgaaacagcttccctagattttgcacatagcctgacaacctgcaatatgcaaccacagttactaactggaaatgtaaatagtaaagaatgtatgagatgtactagtaatttaacagtttcaaaacgcgtatatattcaacatggcaaaattactcctgcgaaccacaggagcatacaaaaaaagctcagtatcaacatcgatagaagccaagcatgtaatttgaaacttctatcttaaaatggttttactactcaatggactgtgtcaaacgggatagcagacaagtcaaaaatacaggaaacagttgatacttaaaataaaccataaattattgtttaccttgagaccagtagagcttatcttctctgccaactgatcaacggctacattacttggagcacatacaaggacctgaaatttcaaatcagacaaggttaacaatagcatcaaattatgccagcagagcaaatgccatgcactcttatacctgtccttggccttgttttgccatgtgatacacgatcgcagcagatgtgacagttttccctgtgccaggtggaccttgaatcaaactaattggcttctggagaacacttttaactgctaagacctgaatagatgcaccacaagatcagaatagaacattagatcaacatatagtgtttaattctacttcagtgaagctatggcataatagctgaacacctgaagttagattaaaaaaaataggttttgcacggagatgaagaaagttggtggaattaaatggggaaagattatgattggtgaagaagaggatgtagatggagaaattaaatgggagatggttgtgattggttgaggtgaaggagtaggtgaagtaactatgttttgggagaaattttgaatgctaaaggtagctatattttgggatggagggagtagataagaaacaacactaaactgatgtatcgacccatttttctagaagcacaaaaacatacctgtgaagcatttagttctggaagtcctggtgcaccaaagcgtctcggtagtgtattacgtattatttgatgctcaacttcatgtcccaaaaggtgatggtatatgtacctacgttgaagcaacagaagagtaagaatttcctcatgagacatttgaaaagattgtgattatccaacaaagaatccaaatacagactagggatattttgcgagagttcttcccaattcatcagggtcctatcaacctttaaccatatccccaaaaaaggtaccaacaaccataaacttaaaaaatagctaaaaatatacattttttacttaaacactttgttcaatcgcaaagaaatgtgtgttcatccttaagcagtaatcatagtaaaagcaatataaatatgactagaggaccagaaattctaagtatacacgatatagatgcatctaactcacccactgacacttgtctcatccacagcaaaagttttcattgccccctgcatcctatcaaagctagtactcttccagacaaaatccacactgaatccatggttcaaatcaacaggaactccctgaaatcaggaaagtttatgatggaaaatgggagcagtaaaaggttactaagaaaaacaagtgagagctatactcctcatacctgactagcacgaagttcaagtgctacctcctcttgtgccgtaagtttaatctgaaggaataatgcccttaccattagcactaaagtagaagtgaccctgttggtgttattgtagagctatcaattaacatgtttctagggcacataccacatgacccacagactgccatgcagggtgtgaagaatcaccagaatatcgaagccgcagctcatctcctgggacaagtctcaattcattgtcttcctaaaatataaaattgattccacatgttagaaaaataaaaagtgtaggtgtattaaatgatataaaaagtccatgataattacaaggagcaagggaaaaatggttttgacaagattccaggccctatgttatcagatcttgtgcttccaagttcttaatctaacctttggaaacacgaaataggctatgcgcttcttgttcagtccaatatcccaccgcacggtcaagctgtccttgctctgtgactctttcatcatctacagaaaaataacaggaggcaagaaacttcagtacatatacatatatcatagtctggttccaaggaacaaaatgttttaagaactatcagcacattcaggaaatattatcagaacatagtaccttgtcataatcagcctcaagctttatcagtggagcaaacacattttgatactggcaaaaaaaaaatgaaaacctgtgttagttacaatatagaaaaacatggaagatttgagtgttttaaaagtgttagtatagaatcaaggtgcaagatatcaaaaacaggctcaggaaataaatgcccaaatgaaccaatgaacattccaaacctggtaagcatcttcatacttcagagccacttgttggggctcatcatcgacacctggtttttcaagatcttcaagagaggcatcagggtttgttttccagagctcttccactttgttaatttgttgcgcactaatttgacgagccctcagctgctcctgttctgagggaacctggtagaacaaaagattgcaaatttgtgaaaagacaaataacaggacaacactcaatgcacaattgcacacacaacccaaaataataaatggaggaagcattaaccttgacaagccatgataagaaacacctgtcatcaataagaggacaccactgactgaggtcccaattcatatccttcaatgcattaacactcaaacagggctctctgcacagaagaacaacgacattctctgcctttgctgagataaaaccaagaaggaatacattccgacaaccacaattgtagcactcaagaattgtttcacccaacggactatccttgtgtaggcaaacttccttatgttttgctctaacctgtgtaaaatacacagcggtgtaaaaattaagtcataaaatatgaaataaactgaacgaaagcagtaacaggctaaaaataagtgacaccaataatttctaccattaaatttctatgtagtctgtaaagcctaagctggtctgcaaaaaatagcataggtaattcaggaacgcctgagaaatcccctatagaagaccctggattttttgaaccaaagttgaattctactaaccacccgcagacatgatagcaaattgccatgtagcacaattgatttcaaaagaaaagatgtaggattgcaatttatcataaatttttgtattgcaccacagataacaaaattaggaacaaataattttagtggacaaggcatcctgatgacataaatgcccttatgggacaaagcatgctatcaagttttaaacatgagtattctacactaaaatgccaataaataaaaaaaatcgtttcgctactgaaaattttcattgtatgagctggcaagctaatcctcagaatttccatccagcatgctcataaattttaccaaaaatgaggggagaactgactggttgagcaatttatcaaaacaatcaaatttgattaacctaagcagatgaaagcaattcaacaatcacaataattcatctcttcaatatagttgattgccgcatcctgaactaaatgcacttttttggcaccataggccaccaaaaaatgttatcaagctacaagagatcatcatctgcgagacaaacttgtcacctacttaggttggcggcaaactcctaccgaattcacatatgatcgatggattgatcttaaaactgaaagaaactaagctgttatgaccctaagctgttatgaccgtaattagcacgagaaaaagacagggacacgcaccaggtggttaacgatgtgggagccggacgtgttcccccgcgagttgcagaaccacttgcggcaggacggcacgttgcagcgcgcgacgcacgcggggttgtggatcccgcagtaccggcacgcgtgctcgacgaagtcgcccttgccgtagtcgtacccgtcctccccggcgccggcgccgagcggctcctcgaagctgagcgccgcgaccccggaggcgagcccgtccgccgccgcggcggacgccctcgccttggccgacgcgcgcggcgacggcgaggacgaggaggccggcggggtggtggcctcccgcggcgcgagatcggggtcctgcgaggcgtccggcggcgggggaggcgggggcggccacgacgaggacgacggcgacggcgagcccgcggagccaggcacccccggagccgacgtggggggcgcggatcgggccggctgggagagctccgggaagtccgggtagtcgaagtcgtcgccctgggtgttgaactcgaggaaggtgtaggcgtcgccggcggccgaggcgggcgggtcgggctgcgaggccgtctcgtagaggtcggcggcggcggaggaggagggcggttgcgtcgccatcggagcgggcggggcggggatgggggcgaggggagggctccccctcctccctagggttagggttttgtggttcggggagtggggagagacgaggcgaatcgggggagggggagagacgggagagagaagaggaagaggtgaggtggtggaggagaagttgatttgattaaaaccgtctcccctctgtgggatttcggatttggactcttcgcgtccagccgtctcgtgcaggaggagtttggactttggagggtggagccgtggagaccggtttggagaggtttggagagcttttacgtacgtacctttggtacaactctaatttatgatatggacgtgactagtcacagctagataaaccagcgatcacttcatatatgagagactctatctacctatactttaaataaaattttctcttaaactatttatccgatctacgattcgattacaccattgtgttcgtaacaattaaatctttataacaagatctcacataaatatattttgatgaaaaaaatataaattacttttacaaatatctaaattacttttagatttcactaaattacctcatagacatataaaagtaaattcaataaagtctaaaagtaatttacatatattatagaagtaacttataacaaaagaaacgtaactttaatgcttgacttttttcattggacgtgactacacaactagtcatgtttttaacccaacaacgaatttacttctaatgtcgtgacaaaattacttccgttttgttttaagttacttttataatatgtaaattacttttagattgtattgaatttacttttatatgtctaagaaataatttagtcaaatctaaaagtaacttatatatatgataaaagtaacttacgtatataataaaagtaatttacaaatataaatattttttcatcgtagtataatcatgtaagatcttgttgtgaagatttaattgtaacaaatacaatggtgtaatcggattgtagatcgaataagtaatttgagaaaaaactttataagaatgaagaaaaagacatgcatgtctaagagaaataaagcatgcatgtatagcagtacttcttctcacaattgattggtcgttggttaacactaaaccgagaggcttctcggtttagattttgccttatgatatactagccctaaaacatattaaattctaattaattgaaatacatttttttatatttagatatttttttaagtaggtaggtaaaatgatatggttggatttaatttttattaaattctccatattaactacactttaaaattttcttgaaatttgttgtgcttaattgctaattttaataatacaaacatcatttcagcattaatttaaataaaaatcattctttctctatgggccattttcagcccattttcttcttcagcccgcaaccgagccgacccacttttcttaggccgcaagcgactaaagtctaactaacatccccatactcctcgtctcacttccacgtttgtgttggaccgccggcccgtgtacggccaagtgccacggtccggtgacggaggccagcccgacgctcgatcgatgttagccgtttgtttcgatggacggctcaaatcagttccaaatcaatcaaaaccctggtgcaaccctaaccctagattcattctccccctccctctccctgcctccccctgcccaacgccacctccgcct

SEQ ID NO: 40980 - DNA, 12641 bp, Oryza sativa
tccccctctccctctccccgtcggcctcaatggccgtccctccctataggcctctttatttctgtcggtgatgacgccctctccaccctcaagatccggcggtaccctcccaacgtcgtgtcgacagcgacggcgacgtcggtggcttcctgcgagcggattcagtgccggcggcttcctgcagcggatacaacggcgacgtgtcgatccggcttcacagacgacgccgacagcttcccatggacagatccggtggcgacgacggcgttggcggcttcacggtgatgtttctatttttcttcccgttctttttctcaatcactggattgtccgattagattgtcatgtggaatcctttgtatttatagggttaatttcatccgattttgagtacaaatcaagtttgtatccaattttcgtgtggtggcggaatcggacagggcgaagattattttcgctcttttttaattttaagacggaaacgttcacaattttttaagtagtagtctagcccgattggattgtcatggaaccctttgtatttacggggttaatttcattcgattttgagtccaaatcgagtctgtattcaattttcgtgtggtggcggaatcggacagagcgaatattttttgttcgctctttttttattttaagacggataacggaaacgttttcaaaattttaagtagtagagaaaagctagtttttttaaaaaaaagaacaaacatctataatatatttataggtcccggtttttcacaaccaacacatatattgatcatctatattagtcttatagatgaatgttctttgaagaaactgacacctatttaaaaaaccggataccgacccctattagaataaactagtcagagccaacctaccaatcaaccaaccttatcctcacaatcctagccatccatccttattgccacaatcccaaccgacctaccacccgctcctcttcctccctcggtacctccaccccacaccgtcgcacgactcccgcccgacccccagcgctgcccacctcctcaccaccacccctacccctgccacatctgcctcccgccaccggacctcaacgcgtggccgcgcctcctcagcctcctcgacgtcgccttcttcctccctccctctcggcatctccctagtttagcagcggcacaggggcacaggtcgacagctcccggctcggtggctccccggcggcgcggcggctcggggcctccatgacggcgaggtggcgaggaggaggttgggcgaggagcagcaaaagcgtccgctcacccctccctctctactcctctgtgatgtgatttattttatgatttccacctcttctctctaattggatcgtctcctatcctggatgatttcgattggattaggattgggatttagtttttgggttagatttacaatggtttgggattggttgtgggtgcattgatagatgaatcggagggaggaggtccgctactaagacggacgaaaatcctgatttgtgcggttcattttctcttcctctacgttctatgtccgattggattttgtatcgatccttcttctttttttttcaccctcttgacggggttttttgttttttatcgccctttcttaccggctttttttatagatttttttctgcgtcaaattgaatcggactttccttttttgttttaatgtttttttcacctctgttattacggacaacggaaacgttttcaatttttttaagtagtagagagtagagatgtggcatagctctagttccaacttcatcctttttgaagctggagctcaacgaaacagattcagtttcatctaaaatgagagtgcagttgggtgaaacattctcacaaaattaactagagaggtggagcggagtttaggctgctctgcaactctattctaaactcagctcctagagctaaacttaggagtttgagctctaccaaacagacactaaatttagctctagaagttggatctggagtggacctgtggagcactgcctaaacctagctctaccttgctagttcttttgagagagcgctccacctagctccgctcccattttaactggagttgaaaaattagtagtagtagcttctttcgtctctactacttcccaatcaattcagatttttatttagattctgtgaatctacaaaactaaaaattagaagctaaaaaatctaagttttctagatcctcacaagctagctatcacctagttgcttctcataattttaaactcccctaaacaggtgaatgattgtagggttcgtgctgatagtcgcttttatagggcccgctcgttggccacttagagggagaactgaaataaacagtagtaattatcattatcctctcaattataagaatgtgttttggagattgaaaaagaagaagattaagaaggtacaaagaacgagatgagtcatgatttaggtggtgcttggatccagagactaaactttagtccctatcacatcgaatgtttggacactaatttggagtattaaacatagactacttacaaaactaattacataaatgagagctaattcgcgagacaaattttaagcctaattaatccataattagataatatttactgtagcatcacataggctaatcatgtattaattaggctcaatagattcttctcgcgaattagtccagagttatggaatgggttttgtcattagtttacgtttaatacttctaattagtgtccaaacatccgatgtgacagggactaaaaagttttagtcacatccaaacacccccttactaactatttcaaacttaaaaagtgtattaataggatttttttaaagcaacatttctatagaaacttgaaaatgcaccgtttaacggttcgggaagcgtgtgggcgaaaaatgagaaacttttatcttccttgtgcttgtctcaaacacagcctaaggacccatttgaaactcctcaatagcacatgattaattaaatattagctattaaaaattgataaatatatttatttgatattttcttaagagacttctatatataatgttttttaaaaacaccgtttagcattttagaaagcctagaaagagccattttggatcaattgataccaaaaaaaatgttatttattattttgaaaattaacacccattttatttaaatgaaaagcataggaattttgtagtatttcatttatatagatttttttttcaaatggccctttgatatttcaaaggactagacattgttgaatcttatggaattcatatataatgcctcattctatgtttgttttggagaaaattcaacatgaggtctaaccctatgtaaagttttctttatatttatctatcttcaaattcatttgatctaatcaaacagtcatttcctctctttttctttttcctttttatccctgtcttttgcaatcgcttgttgtacttcttattcgtgtcaaaatcatgtatttttttatatccatctactttcccaattctgcatttcagaagagagctaaatgttagtgtgattggtttggattagaacaaaatcattggtaatacccatgctctgtttgggaacactttataactttccaaaccatatcaaacatactgtctgaactccacactaagtaattagtaggtccagggaaacaaatctaacatagagtatttttttcaaagtgaaagaaaatcaaggtttctatggaaaacttcatcaaagtccaaagctaatggaatttagctcctttgtgccttgagccttgagactgagctccctgccactatattcaagtcttgaagaagatcttttattgcctccacaacaacacaatcgaatgtgagggagatctcagaaataagatagcaatgagaatcataataccataggttgagttgaggaggagaactgaggaagatgagtcctttacaagaaaaagcaatatagaggcaaaagaagacataaaaaaaaatcaatcgaatcttacctttggtagatcccctcctcactttgaagtgaatcgacatttgagatgccctacatttcgctcgaaactacctttttatttcttgctttacccaaaatactaatattgaaattaaagaatgttttcctacaattcatgttaggttaaaccagaccaactaatactagactatcatattaaagctatataaatcgaaacaaaagccatcaaaaagtaaaagttgagtaaacaaaaataggacaacatggccacaaagttaaaccaagcaaagaaccatggatgatgcatgacatcatcttctctttggcacgttcccacaggtctcaactctcaaggtgactacactaggcacaaaggcctcaatccctgatgttggtctgagtggtgtttggttggtgccctgaagtgaaaggactttgatgtcgcctagagtgggggggtaaataggcattcctaaaaattatcatatcttcatagcatattagaatgatgggaactttcaattcaaattgaaacttccggtacgggattgtaagttccggtctcaatcaaaaagtttggagaataacagaataaaacactagctatgaacttatagctcgaacaaacaaaatatatatggatcaaaaggtgacaaacaaggtatccaagcaagatataaggtcaccaactatatcaattaagcatacaaatagatcaggtaaaaccaagctcaaacataacacgagagaaggcaagaacgagcgaaccaagagaggagacgcgtgacttgtttcccaagtttggatccacggattacgtcttcgttgaggggccacaaaggccgggtctctttcatcccttttctacatgaggttgcacaaatgcactcctcgatttcactcttaatttcttcccttgcagagacgaaattgaagccttcacaaactttttgtggcacaccacaaccttcggtgctcattggcgaccttagtccccaagagtaacaaacacaatcgaaaatttacttgctatgtactccaatgctcaaagtatagagtgaagctcactagctctcaaactctcttcccaactctcttctcttctcaaatcttactcacaaagatctaccacttaggctggagattggagatgggatatttggctttggatatatctatttcatgcctaagaacaacagccactcaaggaggggatggaggcgtttatatacccgagcctatcaaaactagccgtttgaggcaaatattccatttttcggaactttcgaaatgcattttcaaaaatatccgaaaaacactagagagcaaacctgagatttctgtctttttcggaatttttcaaaatccaaaaaacacgagagagcaaaactagaatttctatcatttttggaatttccgaaaacaccaaagagtaaaacaaccataacttttttctcgggagtcccttttttatgatcttggactctatggaaagctcacttagaagactaccaactcaaccagaagcaaggtttaaaaccactcaaaggataggttaaagtttggctttctctcaaggtagcactaggataggttattttgaacactgagatatacacaagcacaacaacattgcgtccctattaatagtacgatattcttatactcaaatataaataggaaaataattataccaataggaatgcctttataccatcttcctttctttgtcttaagggataccaacgctaaaaccgtttcaccgtatcctatatacctatacaagtcatccccactaattctattttcctgctctctcgctttgccacatcactatcgatttccatccgttggatcactccacttcaaccgatcaggttgcttttagcctgcctcagttctttattcatggatggctcccaaatactcggcccagcccagcccacatgcctgccgctcccgcaccggattggctccctctcccgcatcacgctactgccacccccaccgcatgtctctcgccgtatcgcatgccctccctccccgcatcgcacttctccaccttccccgccgcatttctcgcaccccaccccatccccttcctatctcgcatcgcgctttgccaatcccgtcgcatcggcgccgcacggccctccctaggtctgtttcgcctccctcctcccagtgctagccgcatcgccttcctcgccccatcctaagagaaaccttcgccgcccactaagagcagacttatgattgccattaacgcgttaatttcattcgcctctaattaaagccatggcgatatcattgcgggcctttgcttattaccgacgaagttctccagtccatacagaagcagaagcagaagtaggttcttggttgttctccacgaactgcttggtttcatatgaatcttcattgcataggtacatattattggattggtttaaactacagtgatcgttttgtagctttattttcatgcctttgaatctttcatatctaccgaaggtatttgatggtgtggtacctactccttccttctgaatttgttatgtgcctcctgtggattttcattcaggaaagatcaatccgtatgtgcttccttttcaatttgacctatcatctctttggcaaattcatgaataagtagccttcactgtactcgaggattattgggtgcaattggattcaatcttaacaaggtctgtcgtcttacgacagcttcttttcggtggatctcccatctgtactaaacacaccctattctcctcctcgctcagtaagtatgacattttattttgccttagactctcatctcttggttttgttaggtatcatatccgtatcttctatctgaagataagggaatttgttgatttttcatgacggacctcacaactgattgtataagttccattgtattcctgtacgtttattcgaggatccagagtattcaactccgttgtgttcctgcccgtatcgaggattccaggtaatcagatttgctcagattcaatcagctttgttctaatcaaatttgctcagattcaatcagctttgttcttgcagatttaattggttattcatccacagtttatccttatggtcttgcaaatccaacatggaagaattaaacatcttacaggtatgttccatcttagaatcaaactgacgaaagtttttccctcagcactttcagtaaattttgtcatgttacaggtttgcagtgaagacacaagaagactggggaaaatacatttaacagcttgaaataattgaaattttattatattcttttccctgcttgaagtgattgttgcagtattcatctttgttcgttcaaatgcccttcatagagaatgttcttcacgtttcttaaaaatggccttcccctgcttgaaattttattatgttcttcacgtttgttctggcaaaaaaaactgtactcaaacaaaatcattgtatagaacagagaatggtcatgatgtgcatttgttaaaagcaaaatctaacaagacgcgtacagtttctaatcttacaaaccaatatttaagtaaacaaatttaattcttgggcactatatacatggcacgaactattccaatcatgcttcaactttaggtggaagctaggcacttcttatacttttgaaacttaatattccactaatgatccgcatgttgaaggaaaacttacacctatgatcggtcacaagtgtcatcttacttattttattccaagaggaaaaatactatcttatacataaaaaatcgctcaacattctagacaaaaaacttattatgtcatgtaaaaaataaaagaaaaatattgcctatgtttatggatgtgcatatactataatagtatatacatatgttcacttcatatgtcagtagtggccacacatgcagtacaatcatcttgagctaaaaattaccatgtgctcccgcaacatcacgcagggtatattctagtattctttaaagattgatgcgtgctccttgtagcttcaaatggccttgcacggtccatcagacatagtcgtcactcgcccttcaccactggatttggtccttcggtgccaagctccttgcttgccttcaccaccgcatggttcatcgcggcgagcatcacttggccttcaccgtcttgccacttcgtaccccactttccaataacttcactttgttattcttgatatcattaggtgtcatgatctctatcgagtatcagcacattttccaattcatgggacctatttttcttgttcaactcaatgtatttattagtccgaatgattcggttgtcaaccttcacttgttgaccaacagatcacatgtataaaagaatatgaataaatgatgagtattaatcaacaccataagtgtcatatactcaaatgtatgctcaaatgtaaagatcccaattaaatgaaagtgaataatttggatcaaatacttgtataacatataggatttgctcccctaaatgtatgcatacggaatatttatatgaagcaagactatgtatagatagatatgaaactttgagatcttatcttacatacaagaatagaagacgcttatcaaatatagacaatataaaataagaaaaagtacgaattaccccccccaactatcgtggccgaccgaattacccccctaaacccgaaaactagacatcgttcaccctgaactttcaataccagacaatttacccccctcgacccaatccagagcagttttgacctacatagcgtacgcgtgatagtccaatctacattttattgataaaaaatatggggcccacctatcatactcctcttccactctcccttctctctctatctctctctctcactatgaacgaggcggcggcggcggcgcgggatggacggatagaggtgggggcaagcagtgggcgggcgtggacagcggacacgtaggcggcatgcacggcgcggtggagaccctcctgcgccggagggagttcgccagagttccctcccgctccctcccgaagttcgccgctccctcctctgtgtcccgcgccaccaccaccttcgtgtcccccgccgccgccaccacctgcgcgtcccgcgtcccgcggcgccacccatcatctgtcgccgacccgtaagagagagaggaagagtgatacgacccaaataggggtgatgtcccgatcttcacggcgtaggatcaagaaccaataactagcctcaaagagacgaagataactagctgcaagtagccaagataacagtgcaatctgacgatcgaactcgaagctaaccaccatctctacacggcaacctaaatcgaggattcgcccaaccacactaagttaccaaccaacacaacctagaatcaatcgaggaaaaatcctcaaagggactaggagcaccaattgggaggcgtcgaacgccgcttctataatcccacaaggaaaccacaagaacaaaggggtagagatctctctctaaatttgttagcacgcagctaaacaaaaggggttcatattctcattgtcaaaagtcttctaaatgataaaacatgtgggacatttatactaggaacaaccctcctggatgggaatgaaaggtcttaggagtttactggacataggctaactcaaatatcatactaagtgaattcccgagaggaatcgcacatctgtttggcttctgagcagtcctcaatgatttatccattactccttattgggaagtcgaaatgacgaaccgttcgtttgttggaggtgaaactatattaatcacaggtagccaagtgacggtagtggttactgttatgattgataaaattagcaaattttggtcaatacctacaattaatacttataagacataatccaagtttatccgttctgaggcacatcaccaaccaaacagctcaaccaggcatattccatcaaaatctcagggaggcatgttgcacacggcaacaaccaaacagaccctcaaaatattttggaacaatgccttgtcagaagtttgtgggtgactactggttattctgcggactagtaatcttacacgtgcaaggcacgtttcccacattatattacactaatcatgtaaaatcacctaaagattattctaaattttccacaatatatatcacactcaacatgcaaacaaccaaagttcaagaattattgtagtgtaaattgcaatatcttaataactcttccgtagacactttctataaaaaaaaatgcaaagcagagaatgatacgaaatgtacaatgctgccatagctttgatatacactaaactcaactctatctacaacatctaatcgtgaaaaaggcctcccctatctcagtaatagaatgtcaaatggcccccaaacaatctgcaataaaaatatcatttaaatgatcaccaataaatacctcccgtcgcatcaccagtaacgaaaaccacaagccttagtattgtatacttgattaagataaatgtttacttattgatattgatattcaacagaaccttgttgaattctccagcttggtattctactttgtaatctcatgggaaaaaagcactttgctttgcagcaaagtctcaaaggggtgttgttccaagcagcaaacaacacaatttctatggtttttcctcaccgccgctcgcccgccacgcctcccgcgtcccctgcccctctgctccgcccgcgcccggagacgccgccgctccgcctgctctagccgcgcaccgcccacgcccagagccgccacttgcccgccgccgtgctcgccaaccgcttgccgctgccgctgccacgctctcccggagacaccgccgctctgcctgctctggccgcacgctgacactgcccctccgcctactccggccgcgcgctcacccatcgccgcccgccgttggcaaagagagagaagaggaaagagaggaggaggagagaaaagagaagaaaaaaatgcagctaacatgtgggccccatgatttttttttaatttttttttctgactaggatgccacgttagtgaaaccacccacatatactgccaaaggatctccgatgaatggtttgaatgaatttaggagcgaacatttctggttttaggttgagggacctcaaaaaatctcgctgttaagttgagggacctctgctgaacttattcctaaataatacgaaaagaaggcaggcgacctagcccaaatatagaaacggcccagcccaaagtcgcctccactcccactgaccacaccagggtttacgattccggtcggatttcgcgaaatttcgacgtttcgacaaggctcgaaagtagaaaccatctgagatttcgaggagtttcatccaaattcaaatttgaattgataaaaaagaaaaaaaatcaaataaaatcttataaatactatgatattcatgtaacctattgggatataaatttttttaaaaaatgaagtattgtgtgtatttatacatcatgaaagaatagaataaaaaattaaaaaaacacttacatgggccagattgcatgaaataggcccaattactgatcgaaatttcgatgatttcgatcgaaatttcaccaaaaccgaccggtttttgagaaattatcggtaaactcagggaatttgtattcaaattttggtttatgaaatttcttcagaagttaccggttttccacttgatttcgtgaaatttcgaatttcaccggtgctcgaaacggaacggaagggcatatcggtcgtaaaccctgaaccacactcatcacctcgccctccaaatcgcccacacctctggaaccccattccacccacccgcagccgcagcgaggagaggagaaacgagagagagagaaaaagaagaaaaagaaaaatgctgcgccacgccgcccgccgcctggccaccacccgcgccgccgccgccgccgccgccggccgcagcagcagggtgctctcgacggcggaggtgccggccgaggcggccaccgactccgccttcgcggaggcgtggaagaaggtggcccccaacatcgaggcccccgccacgcccatgtcgctcatgcagccccgcccccccacgccggcggccatcccctccaagctcaccgtcaacttcgtcctcccctacaagtccgagatcgccaacaaggaggtatgcgcggaccgtgtgcccccctctcctttgccctacattagctagagtttgtgtctgaacattcagtgtcaatgttcctgatgtaaatttctttggttgagaaaatctttccttctcaagttctatgaataaaactgcatattagtatagcctactattcacttatattttactatgctgcataagaagcttttttttttttaccgtgcaccagttatactccctccggtccaaaatcttgtaacctaggactggatgagatacatcttagtgcaatgaatccacaagtttataaaaaaattagtaacatctacacaaccaaattagtttcattaaatataacacggaatatattttgataatatattcgttttatattggaaatgttgttatatttttctaaaaacttggtcaaactttaaaaactaagtgtaactaaagaaaaatcaaagtggcttgtgacttattaacatgaaacggagagagtag

SEQ ID NO: 40981 - DNA, 3890 bp, Oryza sativa
atgggcataagcccctgcgacaatggccatctcgcccacgccggccaccaccacctccgattccaagctcaccgttgacttcttcatcctcccctccaactccaagcaggtatggcgcagccttcttgctgctttcctaaaatctactctctccgtttcttttagttcaacttttccttttaagtttgatcaagtttgtagaaaaatataacaacatttccaatataaaacaaatatattataaaaatatattccgtgttatatttaatgaaactaatttggttttgtagatgttgctaatttttttataaacttagtcaaacctatagaagtttgactaagaaaaaaacaaatcaacttataatatgaaacagagggagtataagataaatggatatattttcctttactaaaatctgtaaaaaaaaatgaaaatagttctcctttagttcatatagtttcttgttattaggctgattgctacgggtcatggaggaggcaatccgctctggccatacatcaccttcccatgggcacgattgcagccaagattctgccgtgggaagcgccatctcgtgagaccctactgaggacaatcaatgctgctctcgatgacggcaatgtcgacgacgtgctgcaagcatttgccaattacaagaccctgcatggccttcctgagccgcgggtgttggacaggatgatcgtgtcgctgtcctatgcgtctagcaggagatggcttcagagggcattcgacatggtcttgtcagtttaccaatgcaatggcaaccttcttaattgtggctcgctgatgaagctagctctggcgcttgccagagatcagatgccgattccagcctccacagtggtgaggatcatattggagagcggcaagcttcctgatgttgatatgctgaccatggtgtacttgcatatggtgaagtcacaagtaggatcctatcttgctgctgatgttttgtgtgagacctgcgagtgtttcttggagcagattggagatagaaggcagctgaaaaaactggatccaataaagagtaatgttaccttgtttaatatggttttgaagtcatgtgtcgatttcaaatgcatgatcaaggcccaaagaataatggagcttatgtcgctggttggggttgtggccgatgtaaatacagtggctatcgctagccttgtctttgagatggttgggcagcaagttgaattggtgaacatgaaaagaagtatcgattcttttgcatctttgccgttcattcagcactatctatatttttatggaagtctgctgaacctgcatttcaaatataatgacatggatgccgctgctcagcttttggttgatctgtatcgacaacaaaagcctcgtgcttttgttggtgatagtgtccataaacaaggtgtaatacagataggctctggcaacctgaaaactggattcagaataatgtttgaccccataaaagtggacaaaggtttcgttttagatacagaaagtcaatttggccttcttgctgttattgatggaaatattcgtcctagtgagaaggctcttgctaaattcattgttggctgtttgaaagcaagtaaagtgcgtgcattgtctagctttcttattacattacacaaggaagatctaaaggggccatctcattcagatgtaattagtgcatgcattctgatgggatggttgcatgctgctcatgatatcctggatgatttagagtcagctgagattcctgttctaatctgtacttacatgtctcttttgagagcatatgagaaggagaataaaccggaagaagttaataggtttctccaacagatacaaaagaaagcatatacaatggctgattttcataccaatccatcctttaccataaaggatgttgccaaaatagtcaaggatgagatgcccctcagaaattcgtctttgctttccagtttggttcaagaaatagaacattatagctctcgagagcacttaacttttgagttcaataattcaattcttttcttctgcaaggcaaatatgatggacgatgctttgagcacatataagcggatgagagagcagaatgtaagacccagtctgcataccttttgccacatactgtgtggatattcttcactaggcatgcatagggagattgccatgctgtggggagaaataaagcgcagactcgaatatggagagctaactgtggatagagacttgcttgactgcttgattttgaatttcctaaacgctggctattttgcaagagtcatggaggttttaagttacatggcaaaccgtaaaatgtactgtgacaagtggaaatacaagcaagtttttctaaagctacacaagaatctgtatagaaatttgaatttgctgcatgaaaaaacagaacaacagagtaaaagaatagaagatgtcagagctttcagatcctgggcaggcgtcaaataggtaaaatgactgcagcactgtaatccttttgcatttagagaacactcttcttgtgcatgcacatctgtacagaattcttccgatgtaacatcatccgcatctgttgtataattctgtattgtcctttcaagtctttccatttattcttgatggttagttccaattccttagtactcactgtaacatcttacatgcatggattttctcttctttgacctctaaatccactttcaaggcttctaaatcaactttcaaggcttcaactatcgattttttttttatataaattgcccgtcttttcttcatctgttttggcatggatcatgaatctcatagcagcacatatttcctcttcaggttccaggtggttgctaattcttacatttaaatatgttgaccattgataatcttattgataatcttattgtagtactggccttgtggcaatcttagactactgtcttaccaacagtaatgtttctttcttgtgatattctacaaagaggctatgctgatacagaagatcatgctgttgcttcaagttgtcaagtaattatttttgtgggaaaccgactccttgaccttacgtcacaagcaagatcaattgcatagaccacaaatggtatttattattttgaaacagttgtacactttgacatctctgacaatcatttattaccgatttcaagtttttaatgaaactgatgaacttgtaggcctgatgggagtttgatagagcacttgcagtccagaccttactggctactaaggtttgccatcactaataccagaattgtccagtactaccatgtggggtacacaacttgaacagtaactttttttagaggaacttgaacagtaacttggcatgcttaactagttgctgtggttctagaggacacagttatgaagttgaggcagatattctaattgtgatattctttttaatatagtcatatgacataagtcctggaaactctctatttcctaaatatgtgcagataatagagcaaaaacaggaaaaatgtttcaataacacagttgatgttcgtgcttaatgattccaacttttacctaaaaacgctcacatgttgaaggatgccatattgctatgaatactaattttaggaagtttttccttttagttgagcatagctgtccatcagctgctcaattacaagaaatattttacttctaatagtttttaggctttaagcatatattgcatttgactttgcacgttaaaaactgatgctaagtttccacatatcaatttctttactgttggtgtgttcattatttgattcggtgcctctttggaagcacgggtaattggtttggcttctttcttaactttagggctgacatcattgttggggatttctgcaggtgctgtgtttataaaacccaaaggatagttggattg

SEQ ID NO: 40982 - DNA, 19043 bp, Oryza sativa
actatggctatgtcacagtatttatctagtaccaggttgatgtaagcaggtgcattctgtagatcgtgtctttccgaaatacctagcttggttgctcttatgctaaatataatcaattatgatgtgtctatgctttctgggtgcactatcattttgccatgaacttgtgattgttcccatccaaaacgtggctatttgtgtagtctggttcagaaagaatgcgatcatcctcattgcaaacctctgctttgtattataacccataaataaattaaaaaaatatatttctttaccggaaaaaatgagaaaatgtttaaggaagaaatgagtttttttttttaatttagaagaggagaagaatggaacggtggcatgttttccgatgtaatttttgtaaaatatttttatatatgaacttcctagaataccattttaaatccatttttcgagttgataatagataattcatttgtttgtatcctctaataattgtcaaaacgcttcgtccattaagcatgaaaaaaagtagccatttaacatataagaactatgtgtgctgtggattatctacttgattatatggataaattaaacattttaataaataactttaacaaggtgttctaagcaatccaataaaaattctttttttagaaagcatattcttagaaacgcggagtaaataatccattttaaaaaatccaataaacaatatgaataagttcacttgagacccttaacttgttaacgaatctgattttcacctttcaaccggaaaccatatacccggtgcaacataggtcccataatggtttgaacggtggttttagctggcatggctagtttgacttgatctttatcccatatagcatccacgtgacgtttaaagtggcaatttgatatggaaatgtgttctcattcgctcctttctctctctctttccacatgatgaagagatgacagaggaggaagaagaacgaccgggagagagaagaggagggagtgagaatgacacgtgggcctcaccatttttaattattatttttattatagctgacatatgggtccacggtttttattatttcccagatcaaattgtcatggcaatgccacgtagaataaagaccgagtcaaactagccatgtaagcgacatggcagcgaaaaccaccgtccaaaccgccatgggacctatattgcgccggttttgacagttgtgggatccgttatatctatttttttggttgaaggaccaaaatcggattcgttgatcagttaagggacctcaagtgaacttattcctaaatgatatgaaaagaaggcaggcgacctagcctaaatatagaaacggcccagcccaaactcgcctccactcccactgacccacactcctcacctcacctcgccctccaaatcgcccacacccctggaaccccattccacccacccacgcgcagccgcagcgacgagaggagaaacgagagagagaaaaagaagaaagagaaaaatgctgcgccacgccgcccgccgcctggccaccacccgcgccgccgccgccgccggccgcagcagcagggcgctctcgacggcggaggtgccggccgaggcggccaccgactccgccttcgcggaggcgtggaagaaggtggcccccaacatcgaggcccccgccacgcccatgtcgctcatgcagccccgcccccccacgccggcggccatcccctccaagctcaccggcgacgtcgtcctcccctacaagtccgagatcgccaacaaggaggtacgcgcggaccgtgtttgcccccccccccctccccctctcctctgtcctcctcggtcccaagatctgtgcgtgtggcgtcgctagggtttcgggtatgtgcgcgatctggggtttgcgtcgtgcgattagggataggggttgggtgggtcaaggcagcgcgatccgattcgtcgagctggtgtggtagaggtctcgcatccagactcttcatccgtaggaatatatcatggtcaatgcttctatcctccgtttatcgtttgcccagaatgtttgtgatgtggccatttgttgggcgtgcgtatttgcaatcctattaacacgaatgtgtggcggtttacggttgtacatggctgttgaatcataccaggtatttccttgttttgttgctatgagttggagatgttctttcatgggacaaacataacgtagcgtgattctccaggtggctagatgtcatatgactatagaatttctgctcaacatttgattgctgttgagtgttggtagcaaattgcatttcttttttcttgtttggggtgcttgtgtgccttaattgcaaggagcatagagaattcataaattgatatttcctcgccttaaaagactgtgtttttagttagctatgaacctggctaaattcgtgattcatacaaccaaccaaacaaaatcttcaataaacacggtccgctccttggggacagaggtagtagtagtctagtgaagtatcttttggaaaccccgttacattttgttaatcagattgaggattccaggtcgctccttgggtgtttcttatttatagatttcaagtttctcttgctaggattgctgtgtgccaggccaagttttaattctgactacaacagtgtattcagacctgtttatctctagtgtttgtagtgctatgcggctttatgcattgtctggatttatcggtatagttgcagtttctcttgtttacattaactagagtttgtgtctgaacattcactgtcaatgttcctgatgtaaatttctttggttgagaaaatctttccttctgaagttctataaataaaactgcatattaatatagcctactattcacttatattttactatgctgcataggcagcttcttttttgactgtgcgccaattatagcttttgtccttgatatatgttatttgccctgtgataaccaagtctaatactacttgtttagttttgtggtgattttctttgtttcatgttgtttcctttagcttgcttgttggccttgatggtttggtactgtttacttaatggttaatggcactattaagaagtttcagatcatcaatttttccttaagtatgttgctgagcgtcatgttcttttgttgctattgtgtatgaaatataattggttgatggtgttcgaaggttgtctatgtttgtgttgttgcatttcaacagatgataggcaaattatctatcagttgattcacatagattttgtatgtcaatgcttgattcaacaatactactgttaatgtaccaattaattcttcccccatcatcaatattgtcttctgttgcttctttcccttgcttatgtctttgcttgtctatactcaggttgacatggtaattgtaccagcaacaactggtcagatgggtgttttgccaggccacgtttccacaatcgcagagctcaagcctggtgttctctcggtacacgagggaaacgatatcaccaagtactttgtgagcagtggctttgcatttgtccatgcaaactccatcgctgatatcgtggctgttgaggctgtccccctggaccagatcgacccagccgcggtccagcagggtctcgcggaattcaacgccaagcttggatcggcctcaactgaactggagaaggccgaagctcagattggagtggatgttcacagtgcgctcaatgccgctttggctggttgatcaatacgtttttaagttgctgtccctctctctcttttgcatcttcatttttagaatgtgagctgaagtttgcaaactcatggatgatgggatggagggaatgatcttaaataaattatactccatctcaaagacagaaccctgtttcttcttttaacttgactcctgcatggatttttgtaatagtgaatatttttctccgagcctacaaagtcgaagttttctggttccagttttccatcctgagtttacgcttggatcaaatgacaaaacacaaaagccgttctgtttctagcttctgatgaattctcttatgtggagagtgtagtcgtcaagattaaaatccacttttggtacggtacacatcctgtgttcaaactatgtggtgatgttaagaaatcagaaattgctgctgtttttcaaatgaagaatatcccaatgccgtacttaagagaaaccaaaacacttattttttgaaaaaaaaatgatatgcacagcacaggcttgcaatggtagtagaacaggcgagagcaagtcatcgaaacaaaatcaggtcgtaattatcccaaaaattagtactctttccatttcatttcgtattataaattgtttgattttttttctagttaaactttatttagtttgaccaagttataaaaatatttttttatctaatatatcaaattagtttcattaaatctaatattgaatatattttgataatatgtttgttttgtaaatactactatattttttttataaattgatcaaatttaaagaaatttaacaaaagaaaatcaaataacttatcctccctccgtttcacatcaatatgaacgtgagaaattctagcacatcaatatgaatgtgaaaaatgttagaatgatttacattgtgaaacggaggaagtaatatagaataggaggagtagattacatgatagaatagtagtgcgtttgaactttgaacacagggaggtctcaagtctcaccatgctgcgtgcctgcgttgcatgtagctgctgccttcgtcatcttcatgtgcaccagcctccgcgccgccggcgccgcgctcgcgccagccgccagcttggccaggtgcgccattcgccgccgcttcgccgtcgctgccttcttcgcctccggggaggaggaaccggagccggcgtggcagcgaggaggcgggggcgatccctcctccggcggctcggggggaccatccagctcgccgtgccgcgccgcgcgctccagggcccgcgccgcctccgccatggacgggcgctccccggcgcggtcggcgaggcacctccacgcgagcgccgcgacgtcctgcgcggcgcggtgcgagtacctccccgcgagtcgcgggtcggggagcctcgagaccaccgggtgcccgcggggtggcggcgcgcccagtcgacgagcttctggtcggggcgtggccggctccggtcgaaggcgcggtggccggtgaggagctcgagcagcacgacgccgaagctccagacgtcgctcctcgccgtgaggcggcccgtctccacgtagtccggcgccgcgtacccgtacgtgcccatcacctgtttgattttatgcccgtttcatacacatcacacgttgttgttgattgttcatgcttgcattgctcagattaatacataataatcctattattcctgtcctacttcgcactaaaattgatttctaatgtaccaatcttttgataaccataacacccaatgttaaaattgtacttcctccgtttcacaatgtaagtcattctagcatttcccacatttatattgatgttgatgaatctagatagatgtatatgtctagattcattaacatcactatgaatatgagaaatgctagaatgacttacattatgaaacggagggagtagccattagtctccgatcgaattttattttattttttttgcaaaagtttagccattagtttgaactttgaactaaattggaccgccaactctcagatcttaaatttctaggggttgcattggttagcttatttttgttgaaagggtggaagtttcgcattcgttgaactgcatgaatctttttgtgaaaacacatctctccaggtgaaaacagattatatgtcaggacaaatgcctgaaacgatggtttggccgcctaccaaactttctagaccgttttgatgcccgattcgaaccaaccatgaaattattcaagaaaatactgtaattctacttttttttttgtgcagattgaatgcaagtagttcttaaggtaaatggtaaccatcttgctagtactgatgacaaatgacttaccgctgtggacacgtgagtttgtccatccactgggccctcccttgctaatccaaaatctgaaagttttggtctgaattcctcatctaacagcacgtttgatgattttaagtcgcgatatatgacctgtaacataaagagtgtcataactacaagtctacaactctacaacatgtgaacacaagcatcaatagttcagaatataaacactggaaaactctgttaatttgcgctaacaagtatagaattatagatcagaaagccttctgaatcatagctcctgatacatatccctatgagactatcattgcaaaactggaacaactgggagttgtcacttaactctgagcacttgggttttgagatagcattaatgggaaacagctgtattatttgtttactaatgtaacatagctctagagccctaagcttctaataacaactaatagtaaggattaaagaaaacagcagaaaaagcagaagaaaagaggaggaaaaaaagagcactgctatttacattgttctctgaacttgtaactgacaatactcaatatatcgattatcgaagttgttagaccaatacctgaatttccaacccttcatgcaagtactgcagccccttagcaacgcccaaggctatgctaagccttgttttccatggaagtgttgggtatgctttattgaacaagtgatattctagggtcttgttaggcataaactcatacacaagaagtctctgaggaccttgttcgccgtcgtcagtcccgcagtagccaatgagtttgacaagatttgggtgatccacaacagcaaggaactgaacttcagccagccactgcttatgaccctgaaagtgatgtaattgaggaataaatcaactttttgaattgatggtcatactggaagaattgtagaagtataaataacatttaaacaaatttaatggaagaatttgttttttcagattgctactccaagtgcatgattcctcaaaatgttgtaattactgcattctagatgttaaaacttacaagccatggggggttcattttccttttttgcatataagacacaagaaattcgtgaggcataattttctataacatgcagctataatttgacagttatatatttgctgagtattatgcatgggaaatgcaaaatatgaactaaaaatgtattttaccagtagtctacatttgagaataattttgctaaaatccttgtcatcagtcatcctgaggctaacattcacattccattccataagtgataataattttgaccaaaccatcctgcccaactttttagagtactaaatgcgatttgtataaaaattgttacacagcctggaatcctacattaaataatatactcggcacgattcgaaagtaaccaatatgtgcagaatcagtatatttacttatgcaatttgatcccaggctccctgcatccctttgtttcataataaaaggtatgcttcaactccatttaacaattgcagtgtacatagaaacatgattatagcatctaacattcataaggtctatcgaagacaatcaatacctgcattccattaggattgagcttcttgacagccaccaccacattgccactgtcattcctgagccccaaatgaccgcaagaagtttttaggaagcccttgtacacactcccaaaccctccttcccctatcttgagctctctactgaagttaccggtagcacttctcagctcggcaaggcgaaaatcacggagctcatgcgcacgctcctcgtatagctccagtatgctccgtggtgatgaagcaacaaccaggctgcatgatctgttggccttcttggacatttcatctctgaagtcatctttgtctacggttagtgtaggggatgaccttgattgcttcttgttcttattcttgttcttctctcttgagtagaagaagcagcccattgtgattgtgctagaatgatttggataagtatggtagttttttcagaacagagtggagcattacaattgtaaatcttgtcacgattgcaagaaggaagagaaaacaagagaaaatcaaagtataggcagaatgatgctagcaacaaacttaggcatgtaaacaaggcaaggattctttgcaagaaagcagtggaacatatgaacttgcaagaccaactgaagagctggaagtaggatctcaggaaaatgagaggataaaaaaaaaagttaagaagaattcatgaatgttcaactttgtcaaagaaaggtgatgccaatatttcaccagaagaaaaacaaacaagtgaaggctgttcaaatagctcagttctggacgctcaagatgtaaagaccacctcctttcctagaagtccaatggagctacatagagagatttcagtagtagagaaagccatggttacaaagtaagggttgaagaaggttagttacttctaagaatgatttaggtacatagctctgctccaagaatgtgtgactttaatatgtagtgtatataatgcaagaaggcatcacaaagtcgcacaaaagagaatcaaggaaggctgtgcttactttgaccggtgaaactgatgtatatataatcttgtgaagaaggcatggagactgccaaaattcaaccactaaagttagaagacctcattgcacagaagaggagagatgtctggttctgaagcttggagagagactggagtgtgatttcatggtaagctctggaagaaatactggtcttctctgtctcttctctagtagcttagaattgtattttcactaacctaatctagagcactaaatacatagccttacaagttacaccaaccctcttgacttattgaccccactgatgatttcaacccctatcattctcttgtgatgctttcattttcagtaaatttggttgacctttgggagctgggacttgcaaacctgttgcatgtagtagttccataatgttttctgccaatttagttactaaaattattacatcacatggactgcttcttgttacatatctggcccatgcagtttatttcatttagtaactgaaggtttggcatgttttacatctacaatctagttattagtttgtggaactagaataatctccacattttgatgtcgtaaatgatactatttccaaaactaatcaatcatgtctagcaaattatgtctttttctccttgttagtacttactaataatcttgaaaaaataactagttgaaataattcatacatgattaaatgatattcagcaatcgttgttttccatgatctccctctcttaagtatgaatttattttgataagaattacaaaaaaaaaaaatctggtaggattctacttctgatgtacattatgctaatgtgagagcaacggacatggatatcaagcagttcgtttcagaacaacatgtgaaacttagtatcaatgtaaagtttcttagctgtccttcattacagctcattagattgatctaaaagtatacaattagaattaagaatggcaaagcatggtctgatcatagctgtccatggcttacaatattggttggagtcttcttaggacaccaagtaaaatgcttctttagtgaatatttttgtccttaaaatctccaaagatcaattcaactcatatattaaggactatggaggaatgatgccctgttttgtgccactgacactattgaactgcatgtttattgttttctgttatttccgaagtaactgctgaagaactgacatgtcagcttaaactggaacctggtatccattatcaacgtctccccatcgtcttaaatgctaggaatagtttcttttttcgtaagtcaaacagatctctgatcgaaacacatattgctctgttgagttacatatttctggatctgaaatttgcagatagcaaagctgcggcaatataaactgtctctgttgaatttgtgaatactaagagttcctttcttaaacattatctttgactcaacgagttttagctttatattaactctgttgttcaatagataacgccattaacttttggcatggcgtttgaccattttcttactaaaaactatataagtatcatttatttttttgtggcttcttttatcattaacataactttaaaataacttttttttcatatttacactagaatttgaaataaaacgaatggttaaacgttacactgaaagtcaatggcatcatctttataaaaatagaggtagtatttttctattcatcctaaacaatggttaagtctatgctaattggcatgcccacgagaggtgaaggtgtaaattgatcttgggatatgagagcatcaaacagctctttttaaagttaagcatgattaagcaaagtcaatcctacctccagaacctcatgtgacttcgatatattttccatgtattatcatctcccacatctttggagcttcagttttggtaagaggaaattactcctcttcattagtctcaaattaccgtaggggatattgtctattcactggcacaaattttaaggaaaaatatcctgaaattttatctaattatttacctcaatgtctccttccttgaaatctgaggcagtgaataagggatcatattttttaaggcaaatatgaaggatttgctttctaaagttcatggtactcaggatttttttaaaaacattgtattgaggatcttagaatagcaaaaactatcccaccaagtggaagcaccggcgggtagagtcgtgggtgcatgacttcacccaccaaggttcaaatcttcatgcatacgaatattatgcacatgtaagtagacttttaacatgtttttagtaagattagggatgtgtcgctagttctcgtctcttaacagcggagttgtctccattcctctcccactagctgtaagctgttagatctcaattctccttccatacctatctcctaccccattgacttgttagatcttgattctccttccatccctatctgctacccatcgatcgtaaacaatgtgactcatcctaattatatgggtccaagcaatgcaccaatgtctctgactcatcctaattatatgggtccaagcaatgcaccaatgtctctgttggtcgaaaattgtactactccccaaatataacaactttctagctatatatctttatctggataagagcatattcagatatatagctaaaaattactatattttggacgaaggtagtagttatgtctcaaataagtttatttttcacatatcccacatataccaatataaaaaaaagactacaatatcctcattttatcaaaccccaatgcaattattgctctctatctattcccaatacatttatcccctattttcacaaacttcggtacaatggttgctcaaaaataacttattttgggacaatagggaaagacaaaaaaaatcttagggcctgtttagttcccctggcaagttttttcaccctgtcacatcgaatgtttggacacatgcatgaagtattaaatatagacaaaaaaaactaattacacagattgcgtgtaaattgcgagatggatttattaagcctaattgctctatgatttgataatgtggtgctacaataaatatttgctaatgacggattgattaagcttaataaatttgtctcgcagtttacaggcgaaatttgtaatttgttttgttattagactatgtttaatagttcaaatgtgtgtccatatatccgatgtgacacggcaaaaatttttaccccctggatctaaacacatccttaggaagtgtttgagaggagggaaaggagaagattgagaagatacacaaaacgatgtgaaccattagcacataattaattgagtattaagtatttcaaacttaaaaatgattaatataatttttaaaagcattttttaacgttttcgtagaacttctcttttaaaaaaagacattgtttaacaagtcaggaagtatacgcgcagaccgaattctacggcgaagggagtactttctctgtcccgaaaaaacaaacatcgtctcgcaaaaaataaatattcagttttagattttttttttttgacggagggagtagtttgctaggtttccctggtaggagtatatgcttgcctggtcgaactgatgggagaaaaaaaacaaaaaaagggtactttttgtactgtgctatgaccagctggtactgcctccagcttgagcttacctgactctcagactgaaagcaaccattcatgccactagcctcccattctccctgtgtcttcgagtccctgtcacagtctaaagttgctggctggctctccttacaaagtctatctggtagtacagtacaagaccaaataacttatttttattaatcaagaaaagttgtatgagaccaaataatttggcctggatgacttgggagaatcgcttatcgcttatcgctaggccctatttagtccccaaaacaaaaattttcacgcaatcacatcgagtgtttgaacacatacatagaatattaaatgtagaaaaaaacaattacacagattgcgtgtaaattgcaagacgaatcgtttaagcctaattgcgtcatgatttgataatatggtgctacactaaacatttgctaacaacggattaattaggcttaataaattcgtctcgtagtttcctgaattctacagtaatttgttttgttattagactacgtttaatacttcaaatgtgtgtccgtatatctgatgtgacaaccaaaccaaaattttttttccccaactaaacaaggcctttttggaatttggaagtctttttacagccacggttcatgaccagcagcaaagtaaataaatgaatgattataacacttctactcttattttagcagttcaaaaggccgaggattgaaaaatggaaggcgcctaaaaccattacaataattctaaaataaaattctactagaattaccagaataccgagcactgaacatcacttccatccaccatgatgatgaattgtgtggatactccgagcaagcaacagaataccagatcaatatggaccagaataccggcctgcccctgtcatccctcgccttccaattgcaggcatgaaccttgcttacaacttacaagataaaataaaccaatgcctggggcagcacaccattttaatcaaggcacaaacaacatcggctactttagaattacgggatcccacagattcgctaattaaagaacaattggaattacgttacaacattgatcgattgatgtctttttatagctacacttcgaatgtggagtgggcctgcctgccaaggtgcatgcatgcggcaggcctgtggaggtggcagtggcggcatgatagagaccatcgctggcaaatgccccccactcttgcagtagtccaccagggtgtctccaagccctgcaaaactccagtctccgcctcatggcttgtggagcttgaatccaaatacacgaggaacgtagcgctgcgagggtttctgaggcttgaggtgctcgtacgtcatcagaaacaggtgcgggaatgttgtcccaaagtatgcgccgtcgatgtctgaacatggtcaagaaaacagcagaatataacaacaaaatggcagttctatgtaactatgatatcaatgtaacacagatgagagtgtgtggacttcatctaataagcgataatatatattggcactgagaacactaagaaagcaaaagaccatgcgttaaagattactgaattgtttatgtccttagtattgatattagtcgtcctaacaactgtatatgtctgcctgttaaaacttgtcaaagcatttgccaaccactcctatcagcgaattagggcaaaactattagaatatagtaatgctggaaatccaaaggaattctattttcttccagagaaaaacaaaaaaggaacgctcatatagacagtatgataagagagtggttaggatactgccttggtacttggaccgtggatagtagatgtcttcacacttggggcagtatatcttcacagtactagatcggtgtatatctgattgtccaactggtaaacagggttgaccacagcaataaactcgtgggcatcttccaaaatcatagtttttgtacttctccagctgtgacaaaaaatattaacaactgtcaatttatcataaatcggaagtacaacaatataaataccaaagaaaggtaccattgcagccaatcctttactggtcaaaatgtatcgtgcatgaatcagcccatataacatctctgcagctgactccactagctcgttttgttcttcggtgaacatgtcacctacatattgacacaatcaagaaacattagcaaaaagaatgagaacagtagaaaagagaacatggattaaagggagctactgcattatgatgccataaagaaggctgtgttacattactgatgggttatggcatttaaaatagcagacaaaacaacacacatatcctctccatgcttgctaattactaccacaccatttactgccacagaaacctaaagcaatctattagcaacatcactcttaataacattagggcacctaaacaggtgaccaagaacaaaacaaaatcacaaggtttaataatagtgagaattaattttccatgtaatagaacagaaagtttctaagcatgtactatgggtactatcaaggagcaaacgacaagtaacgcatgatggtgcagccatatgcagagttgcaaaagagacggtcatccagaatacaaaagcacaataactaacagtaaaagaaaaggccttttgacctgcactggttatttgttcataatcatagaagttgataacagagatcaattcgaggagaaaaaaaggaacatctatgttttgtgttctttctaggagaggtaccttaaattagtcatggtactccacaatatctaatatctagcttaagagttgaacaaatatctaagaattgtatgtacttttgtttaaaaagtctaagttgacctctgtttggacatcatcaatacaagataccagtttcaactattaagcagatcaaggaagaaatacaggaaacattttttgctcaaatacatccaccatttgtttcatttgcatacgtaaatacagggaacatttaccgtgagaagattcgatatctaaaatgagatcaagagcataatcataatatggaacttgactgctaagcccacagaggttgaagtcatcttgtatataatcatcatcaacctcacagaagaattcattccctcttagactgcagtaccatgaaatccatgagtgatcctctccgtcagaaccactaacatctgatgcttcactatcagattcagactcccctgcaatgtcaagcatggacttgtcaatgcaaaggcttttacaaacaatgatgcaaatgcagcatacctgtaaacacagtatcaaatctgaaataaaacatagcatgcttaatcaacacctcaaaaaacttaaaagttatactccagttagacccgcaatagcatagatgaattaaactaatggactcctcaacccgactggcaacattcatgcaaagaactgggcaatggaaccaaatttaagcaatcaatgaagcataaaaataagatattactgatcgtatgggccacttgatttttggttttggtaacggagaccactccaggaatgtaatttcaattaacctttaaatcaacaacacatgcaaaaaatttcaggattgtttttatttttgttgtccttggagttgtttttgttattcttgtacgtaattaagccacgcgttgtatttgcatataaaatcatgaagataagtgatgttagacaatgccgttaatcttttttgcggtgcacatatggaaagcccaatgggaggtaaggccatttaaggcatttgtgtgcttttacacaacattaactatgcgtctatgcctgaaacaagcagatggtaaatcggatacaacaagcaaacacttcctcaataagatcctacatcagcatcttcaaacatcatcaaaacaacagcccaattaacacaaccctgaaacacctccaaaaaaacttaaactgacatctctacacacatatagaacaaataaatcaactttcatagtcttcaacacatttaggatacattaaacagatcattgcaaaccagtcacaatacctccaacgctccaacaacttcgccgctaatgaaaatccacaatcaacaatcaattacattcctacgtcaaattagttattccctgttaagttctatagttccaaacaggttcataagctcatgccatcgatcaaacaccacatgtgacgaatggttccctcttaggaaagctccgcagacatcctaatcctaacgtttaaaatcaaacaataaatttctaccgcagccgcctgaatccccataaagacgaatatatgcaatcactaatcatatcaaacacaacggaataccaatccagaaccagttccctgctgccgcagcgcaatctatcccctcccatggccgcaaccgcatcagcgcaccacgcaaacgacggatttctcaatctcaggcacgacgcgccacgcgagacggccaataaaaaaaaaagaggagggggaaggcgagtcggtcgcgtcgcgtcgcgcgtgacgtcaccttcggagcaccgtcccttgggcatggacgacgcggaggacggcacgacgaggcgctggtggtcaccaccgcccctcccccccgccgaccccctcgacgtcgagggcgacgcggccgccgccgccgccgcgaccgccttctcgaggtgcttgtcgagcgcgtcgctgattcgcttccggtccagccccgcgccgcctccgcctccccctccccctccccctcctcccccctgcttgtacatctcctcctccctccctcccgctcccgctcctgctgctccggcggcggctcctcacgcgtgacgcgccattggggggaaggcgaggctagggttagggtacgccgcggaggaggcgacgcgaggcgaggaggaagaggagaggagaggagagcacgagaggggaggggaggggggcgtctgcaattttgagggggcgcgaggggtgtaaacgcaaaagcgcgcgaaggccaatgcgaatgctgcttgctgctgctgctattggaatgtcgcgtcgactcgtgccgagatatttttgcgggtgcgattttgccagtttgcgatcgcgatctcgcgatcggacgggacattgattttggattagcagcttgtttgtattggtttaggcaaggcaacccccgaccttgatttaatctggtttggctctgggtggtgtgtgtgattaagtagtgttgactggtcaagcatcaatttcgatattatttgaggggaagtgcagtttgtgatttgaatttttattatcatgagtgaaatattgtttgaattagtgtatactgtgtatgtgtctcgtttttcacgtggacgtttcctaaacagttaaactgtgtgtttttttttgaaaaatctatgtaggaaaatgcttttaaaaattatattaatttatttattaggttttttataatatttaattagttatatactaattcacagctccgttttgtttaacaacccctcaaacgaacgcaaccttagattattatagggatggaaatgatacgatggtaaggaactaattggaatggtaataatatattgatatagtattcttgtaagcggtgtcacattaaaaatataacatctatggtttcgaaaattccgatcaaaccatctggttgaacttgtcaactaaaagaagaaaaatagtatgttgattctgcttgaaaataaaaaaacctagccatgtgaccagtttcaagaaaagaaccaactccggctacattttgcgtgaaaatgtctcctacagtattttagtgcacgttaatacagcaaacaacgactaaggctgagtttgcgaaactccaccttcccgcacgaaaaaagggtgttcctcattaacgcatgattaattaagtaatacctccgcttcagtttataaaactttctagcattgccaacattcatataaatgttaatgaatctaagcacgcacgcgcgcgcatatatatatatatatatatatatatatatatatatatatatatatatatatgaatgtgggcaatgctaaaaagtcttataatattaaaagcaacttttttacataattttttttttaaaaaaacacacatttagtagtttgagaagcgtgtggacataaaaagtttgcctaaaaagaatgaaatgagttgggaaagaaattgaagaacatagcctaagggctattttgattatgttggatggtcgttgattttccgggcacgaaaatgcgaagagtcattacctcatgcttaatagtgtatcgattattttaaacttaagaagatttttaaaaatatatatatatatatatatatatatagaaacttttacatacaatgtaccatttagcatttctaaaaaagtgctaacgaaaaagagaaaattaaaccgtttcaagttattaaaaagaactcagcttaatacaaagaaaaatcatagtcatgtactatctttggttgacagttgatatctatcctcaatgcgtgctgctagcacaaagcacttgtttcctatattacttaggtctcgtttttttttcaacaagagttgaattaagattaaaattttagtggcactttttcaaactgctaaacggtgtatttcgtacgaaaactgtctatataaaagttgctctataatatcatattaatctatttttcaagtttataataattaaaactcaatcaatcatacggtaataccacctcgttttgcgtaaaaaaaacttcatcttcatcttcaggagaaaataacaccacagtttaatattacctccgttttttaatagataacgccgttgactttttctcacatgtttgaccattcgtctt

SEQ ID NO: 40983 - DNA, 2889 bp, Oryza sativa
gcgcgcaaggggaagtgtcgccagccgcgccccggggggaggggtcgccgaacgcgaccgtgcgtgcagggggaggcgtcggtgagctcagcgtgagcagggcgggcgcaagctcgatggcggtagcggggcggcagggcccgacaatgagctccgcgaagagaggaggtgagcttgttgaacttgagcagctgccgcagcaggctggagtggggggcctttcccctttccctcctcctttccttcccgtcgatgacatcgttgctgctgccggcctccccaccccctcgccagcctcgcggggcgttgacaggtgggtctcacctgtcagcggcagaagggagaggaaggaggcaaagtggagaaaaaaagggagaagaagagagaaaaaaagaaggaagaagggagaaaaaaattccatatcatcgtccacgtagcatgccacataggcaagactatggtcaaacgcagctttagaccgggatgatacattaaaccaagtttagagatctcgatgcacattttgcaagtttatggacctaagtgaaacttcgttataagtttaaggaccgcttgtgtaatttactctttaaaattgaactagaggagtgcacttattttgagacggaggagtattatttaaaaagtttacaaaataaaaaaatatagttgcctctcctgtaccactctctccattcaaaaaaatccaatctaggcaaggataaaatataacctaggacttattcagattcactgtactaggttatatttcaccccgtcttaagttgatttttttaatggagtggagaactctctcccttaaaaaaaaaaatccaaccaggcaaatatggaacataacctagtagggagaatctggaacctatatactcatgttcagattcatattcgttgtactaaattatttatgtctcattcttattaggttggatttgttggatggagggagtatgtggcagggacacacttatcaacacatcatgcatgtatatccccttatgattaagaatattatgttttctatcatctccttttggcaaagattggcacggcatttcaagagagtaaaagtaagcataatgtaattattcttcaacaacttgcatttccttcttagttttttcccttgacagcacgaataatgccctttcatagttcggagatcaagcttaacataaaggcataaaccaatcatagctcataagtttggagttcataaagccaaagagtaatcatgtttcttcttgcaaatattgttaaagcagttcatttccatttttaaaaggcatcttcagatacccaaacattgatgttcgacatgtcgccacatatttgatgctctgcaattaaaaggaaaaaaaaaggcactaatcttggaatcaggtacctggtttcattacagcgacgcattatttcgacatttcaaggggttagccaatacagatttccgaagagtcacagcatagcccagttctgtccagaaaatagtacagcaactttttttctgaattcatattgaccaataagaacaagtgggtagcttgaccattccatgtacagatctgagattcttgcgtcgattcatcattttgaagggttcatcagcgagaaagaagatttatttttttctgagatcatcttccacagggactcttcaagaccagcgtaatagctctccaatttgatctattaccatcggtcaggaaatgttgcattcctcatatcagtggatccctattgacatctttatacagcaagtacctcgtcttggtttttccaagggcagcgtacctggaacagcaaggcaacggtgatgagctgcctacaaaagccaattccatgaatgataaacactatgttgacagatactaaccattgaggcacaaacggtgccatccaaatggtgtcccctgattgcaccgggtacctgtattagcaaacagaacaaatattcagtaatcagctaagtaggagactaatatagtctataatgttacaactgtcagtaaagcatatacttagatgtgaagggcggcctctaaaaaaatgttgaggacagtggatggaagcagaaacacatgagtcatgacaatagtgccatgaagtagattaggctcatacgcacccatattttgtaaatgtcaagctcaataatgagccgttaatctatatacagtactcagtacacatcttctagaacttatattaaaataagattatgatatcttccttaaacagcttgtcccaggaggaaacaaggctgggaacctgggactctgaagtctgaacgttgcacaaccaaataaagcctaaaaggaaaaaaaagaataatacaaaaaaggaaatgttttagatcacatccttaccagctgtctcccaatcggtatattccttgtccctctaaaagcagcaacccatgttgattgtaatgaacctcctgtttataattaacccccaaaaaaaaagcagcttcagaatgtgatgggtgcatagtggctagtcactagtgacatgaccaagaatgtagttcacacattgcagattttctggtgggagcccctttgtaattaatctaatagacaattaaaatatgaacacggtttaaaacatggtactagcacattaggtctgaaatctcctaagaaatattaaaatattcacaaaccttcacattaagatattccccaggctgaaaatccattatctgcaagtgagaaataaggatatcagaaaaagtttagctcctttgtagtctagaaataacctacgaataagtttaaagactctgataagtaatgacttttgcaagctcaggttgccagtgtttcagagtttgagttcttatacaacacaatagcttattacacttat

SEQ ID NO: 40984 - DNA, 13641 bp, Oryza sativa
aggcgtaccactcaaatggcaggcaaaccaatttatctagatgcctagagattgcaaataatcggtatccaccacacaggtccagaatgtacctctcctggggtttcaagaaggggttgcttatcagttgatccaacaatgagatcaggatggtaaccctcaatggttgtgtacctaaacaaatatattcattaaataatgagaaatgtaaactgagaaaactaaatcattgacggaaaacaataattgtctgagatgtgcagatcatattcacaacaaaaagaagacaaaggaaaaatactgttcatcaaccacttaattggccttaagccaatccatttatattgcaaaagttaatccagtcttagcgactaaaagcctaccaaaatgggaagaacttcagctattcaataagatcactcagctagtcagctaggtcaataatagtggtaaaaattcttaaaacaaatgatgcgcatggattatgcgcattccctaaaaaaaatagtggtaaaaaacaaacaaaatttacatgaaagtgtgccatttaaccattgtacctcctctcaaagattacaagggtagttacttcatctgagatcacagagtgtttcatgtttgcaggaagataggcataagagtccacctgcactcagcaattacacaatcagtaaaccatattaatgctaggcaacctttacttctctaaagctggtaaaagatgatcaagttaaaacaatcaagtatcaggatcatgaaaagaattaagccatttactgcaggagtatgcaagaaacaagtgggagttccattcattcagttatgacaaacaatggaaattctgttgaatttacaaacatcagtatcccatatttagtacccttttatcatgtataatatttatattattgtcttttgacaaaattttaataacatcaccctacaaatttaacaactgatcatccataagtttaatttgcattatgttcaaacatgttatgccaatataacaacagaagcaggaatagacaaatccggatacaccatgtcgcaaaatctcattcaactacaatggaatttctgaacatggttgatactattcttcaggtattccttagtaatgattagaaatgatcttaaaaagcccatgcacattttgtaaatcatcttcatgcaattaaaaatattgtcaaccgcagttggcttaggctgcctctaaactttgaaaactatgtcgtatgatcccatcaagttatgtcatggaattagaaatgtttaaagtggattaacacttacataatacgacgaacatagagtatagtgaaaaaataactagatattcacaaaatagcagatactaagtttgatcgaatcttaccagcagagtatgggtattcccactctcctcagacaatagaatgcttccttggagtacaaagataagcctgaaaattgtttaccatggaccagtggaaacccattaactggatggtgaaaaaccaagtcgagtcaagtataggatgctgacaaatgagctacttaattggatgtgcatcacagtcaacatttattggctaggactaggagtgacccaatcattctgttctttgaaacagtgatgattacaagtgtgaatggttgctattctaactaagtgagaagcactgaacctttcaacaccttttggtggtagggctgattttgatccatctgcaaataaaacatataaaataagaactctctatcttgtcaacagattagtttgataagattgaacacaacatgtaccgatgtacaataataagaatacaagcttttaattgggagctaggcattcttggcccaatggccgaaatgaatccacacacacaaaaaaaaatgttcttgctaatccaatggttctgtggcaaacaaaatattctgaattcctagaatagaaaccaaactcggacctcaaagagaacttgttgaatattctgctatcatttacatttctacctatgctttgtaggtgggagaaattgcataccatgcatttttgccaggtacattgtgaaatgtgccccgatagctggactaattaaatatgctcctaatgtgttgatcctgaaaaaaaaagagtaaataaatgatattacatagttgtggaaagcaaagagaaagtacaacagaaggtggccaataccagtcaggcaaagggctgaatacatggctctctggtgtaatcaaagcatgatcccttttgtaaacactacgtgtgaagccaggtaaatctggagatacagaaaagtaacaaaattagcaggaacaggaaaaggaacgcatcctcttctgaaacacagatagcctacatgagtaaacgataaaatagctcagaagatatcctcattcaccgtgtaataagtaaaacagaagcataaaacataaattatctttaaagtgtgcttagcaagggaatacaagataatcttctcggccaatccaattcgacgaaaaggagtaactgacgagcgtgcatatcatatgccattctatttcagtcccacatgactacctactactacctacctagttcacagcctaattctcgacagcaagccacaccattcacagagaaattccttctagagagtatggtatcatcgtgaaactgaacgaactaaacactatcccgagcgtctcaaccagcatcaacatccatactccacaacagtaactccaaatccagaaccaatatcacgatattgcagttctaaaaaaacactgcagtgacgcaatccagagcacctatttatgcaataatctttaagattccatccaactcgcgacgtatcgctccgcctcacgctcactcaccctggaggtgcgcgggcgccagagtcgggttggtggccttccagtagagcggcggccgcacgccggagcagccgcccgacgccgccgacggctccgccgagcagaacccctcgccgacgccgacggcgcccgcagcgacggaagcgagcggcagcgcggaggcaacgacgaggaggaggagccgggggagcatcatcttctcgcccggcgcaggtggaggaagcaggcgcgcggcgtgctcgcggtggcgggttttttttttttttgggggggatttgcgggggagaggagagagagagagtggagtggatgtgaggcggcggcggcggcacactcgtggacggtggttggtaggtgggccccacttggtgactcggatgccattgcccacctgcccggctcccccaccacctctgttctctccattcacgattgatcattcacacttgtataaaagaatctggattttcatttgatagcccgttgagtcttgtcggattagtcgttttagttcgcacacgaaattaattaaccaccacgtggacgtttcatgagtactaaaccaaatcctagatttaaatctggacataatatatattcaaatttaaacacatgattaagttttttatgggacggagggagtacttcgtaaaagcccgttgcatatgtatgcacgagaaagtaatcatatttgcaattgactatagatcataccgataagtcttctatcactcattttctaatccaccatgtgcagcaacgcatccacgacaaactcttctttaccatcgctcctgtctgctcaccgtgataatttacagagtagatcatctgttactttcgttgttcggtggtagaggcagccaggtagggaggaaaagaattgaaaacttaagtcctttcttcaaccaagtgctatttaaatagggctatttgatctgctctttcaattttgttttggtttaggttgcatgggcaatggctaattactaattttcatctttagtaggcaaaaatagctgcaaggcatagtaaaacagttaaatttcgcgtgtgatcacaagcgctatgggtaagaagcatacgatcaaggatgtggcaacaacaatttggttgtgttggtgccaaagcgttgccacaggtgtgttggcctagagtactagattagtaggaatattataagcgtgtttggtcttggtgcgaagccagaatatgaccatcaaacttgaatgaagagagtattatgctcttttctagaggctagagtaggaagctaggaacgcgggattaacgaaacccgatcgaaaatcactcctgaatgattttgttgatttccgtaagatcatttgaaaaccggtaaaatatagatagagtaaaattttgttaaactagcaaaacaactgtgttttgcagtggacaaaaatgtattatacatgtgctaacattgtttggaacaattaattgtatggcttttgaaacaatttcatccttgtatatgtctttgcatgaaacttaaatagagatgaaaaaaagatattaacaatatgtgaaagacttttgtaatattgaagtacacaaaggtagttggtaaagaaaatataatagagttggtgggcaccaccattgctttcttttaaatgcgtatagaaatctaagctaaagaaaaggcaagggttctgtatgaaccgtagtattcatattggagtagcatattagcgacacacaaaacgaggtgactcactagcgtatgattaatcgagtattaattattataaagttgaaaaatagatttatttgaccttttcagaatcttccatatagaatttttttttgcgcaaaacacaccatttagcagttcgggaagcatgctaacggaaaacgcctaaattgtagtttggagttgtagaaaagaacgcataacaacttgatgatgtgtttgaagtatttttaaattttaactactttaccaagtagttcgtcaagtctaattatccccaaatctaaattactgtaagattgaacacaagtaaccaaacttaccaaagggggtgaattacgtcagggaaagtaaaaaaattgaactttaatagatcaaaacacatcccagccttgaaagccaatggaacacacttttgacagtctgaccggacctgtatgggacttagagctagtctgattgaagtacaattattggtatgacagtccgacaaaaacaacttgacaacgcttctataaaaactcgatatttcttaaactaaccattgaatcgagttgcaaacttgtcaaaataaatcagtgttcgcctagaccatggtctagactgttagaccgcgtctagatgtgagaccgcaggttttcgtcccgtttagggcctaaactgtgccctagaccattttttttgtctatagggtcaaatcgtctagttcaagtaattagatcatgctgagccaagtctagacaaaaaatgacgtgtagaaccgtgattagaagaaagaaggtattatgtaataaaacgttaaaaatgatgaaacctgagggagtagtatggttagaagaaagaagagggttcctataagggggtgtttagatttagggggtaaagttttgacatatcacatcaagtattatataggatgtgttttatggggtgttcgggtactaataaaaaaactagttacagtatccgtcagtaaactacgagacgaatttattaaacctaattaatccgttattagcacatgtttattgtagcaccacattgtcaaatcatggcgcaattagaattaaaagatccgtcttacaaaatagtcgcaatctgtgtaattagttatttttagcataaatttaatattttatgcaagtgttaaacattcgatgtgactagggtgtaaaatcttgggtgggatgtaaataggccgaggttatccatacctttcccatgatcccatctcttgcactagtagtaggcgcctagtagtacattccgttccgtgcaaatgtgcaggtgcaaagccgtccgtcgcacgcacgacgcgtcacccgccccagtgcccacccgtaaccacctccaatcttattattatcatcgcttaataatccaaccccgcgggaagtcgcgacacgagccagcagcggcgggaggaagcacgacgacgacgcgagccaccgaagcggaggaatcccaggcggggcccaccccgccgcggcgccggccatgccgttcctctcgacgccgtcgttcgacctctccgccggcgccgagcccaccctcggcccgcgctctccccctcctccccctgacgccgttcacccgccgaccccgcagcaggccgcgccggcgtcggaggcggcggcgcggaggctgcgggaggcggaggagcggctgcgggaggccatccaggagctccaccgccaccagcacgggggaggaggggatggggatggggacgggaagggggtggatggagatgaggagggcggcggtggtggtggtggtgggtggggttgcgggcacgagggggagtcgtgcgcggcgcacgcggcggggaacctgtgccagagcttcctgctctcctacggcgtccgggtcggcatcggcatcctcctccgcgccttcaagctcgcccgccgcagatcctactcctccctcctcgacctcaaggtcctccttgctcctctcctcctacctgaatttgcaaatttctttcggttagtgctcaactgcgccccatattagattagtttagtttggacggaattattcggagaatttggccgggaactgggattcggctgtgcgaatttacttcatcttgtttcggttggctaattggagtggaattgggggttttggtgcttaactgttggagcttggacacacgcacattagggcgtgcaaatgtgttagcaaaggacagggtcacatattatgctggtcttgattgtgatgttacatctattgctctatgttcatttacttgaatagttagtggtgaactggtaatgagctggtactagtagtacttgtgtaggaccagctggtagtgtttgaagcacatcaaataacctgttggagggatgtttcttgctatgcattaaatggttcgatccctgttgtgaggctatccagtatgatttttttttcttaaaaaaagttttgaaccttttgttaataatgtttgaaaaataacctctgccacaccgagataatagcatatggtgtagcatgtgttttcactgttttgccttgccatcagccgtgacatggccgaaaggttcatttaaaacaaaatactggatggtttatttttaaaatattactaagaaaaggttaaaaaataaaataattggtccagttcccaaacttccctttctgacaaatatttactgttctactactagtatactacaaagttcaaataagatgtcattgatataactttcttttctaatttgcagcaactggtttcggagaaagatctaatagtgagggaggaagcttgccgggtaggattactttttggaggattcactggatcatatcatgcacttcgatgtttccttcggagatttcggaaaaaggaaacaccatttaatgcgtaagtaactctatgcttatgctgttttgtgtctatttatcttgtctgattcactacaacacatctgcaacgcatgtgtacctctaaccagttcttgaatctgagatggtccctaaaaagtagataggtccaaagcatgttaattttttattataagattacctcgaataatgttcatggactcaactgaaggcgtgatggagcagaatattagcaggttcggtggcaggcttggcgatagtagcgctagatgattcaagtaggaggcgcaccctttctctatatcttctggcaaggcttgcccaggtcaccaactgctaaactgttgcattttatatggtgaagatgcatgtatggcccttttcctcatgtattgatgcttggtttttacagtgtgcatataattctgcaaagtctaagaacagatttcacttttggggaagccattggaggcatggagatgcattacttttttcacttgcgtctgcccaggtaacaagatgaagttgaccgatttgctttgggattattatcctgttatggagataagatctatataatcatatgaaatatccttccaggttatgtattctttcgttatgaggcctgaaagcttacctaaatcgtaccaagacttcatccaaaagactggaccagttgcggaacctgtttacaaggctgtaagagattgctgcagaggtggtcatgtggatctcattggtctctcagcctatttagctaacaagaagaattcaaatttgataaatttaacaaaaagtccacccattattccatgttctgtgatacatcctgacagagcatcgtgcttggctcataatgtcagtgtctcttcatcaacgttcaagaaaacattccctctgtatttctcattgacatttgtcccatttgttgttctacgccttcaaaaggtaactttctaatcttgtttcccacttatgctattgcttgatcgaaatatttttctttcaaataaaatttgatgcctcaagtataagccaattgtacaagccttcaaattatagcacatctctatctttgtactcttcatgcacagtgcacagacactttaattttgcttaatgcaaaatgcatgcattgctttttagttatatatgttgccagtgaaacaaaatattgagcaacatcccgagcactcaacaagattagcacaatgaatcttcttactttttcattatcctgtagttcatacatatccatcttctatgttaattacctaatgatggaatctctgtatcaaaaatatcagttcttggaatcaccagctgcaacttgttggcgagctcttgtgggtgcagttcgctctacgacctttttgtctgcttttgttacattcttccaggtaattgtcgaggacagtccttaacaaatactagtaaatgtttcatgatcataatatccttctggtttcattgctaggctgccatctgtttgcatcgtaaagttgcaaccaaagaccacaagtttgtgtactggtttgctggtctgatgtctggtctttctattcttttggaaaagaaagccagaagagctgagctagctctctatgtacttccccgcgcaggggattctttgtggtatatattaatcaaccgccatctgctcccaaatattaaaaacgctgaggtatttttcttcattgttcagtttgtttttctactttggacaaaaactacatgaggattacttgcaatactctagcttatttcaaagtaatctggtgtcgaagagcagtgtaaaccaacattagtcctaagttcttaattctacacaatttgcctattgccttgataactggaagggatcatgtttgaagtcagtgtgccccttggttagtagatgatcatatttttcagatccgctgacagttacccggcaaacattgcaggtggctcttttctgcatgtgcatggggggaatcatgtatttcctggagtatgagccagataccatggctccattcctcagaggactcatcagacggttcctggcaagcaaaataagcaacccgagcccaccgccaaatcccaatgcctcctactcctaccttcagaagctgaacgtgctggagcaaccaagaacacagcagggcccagagaatggcctgacatcatcagagaagtacaacctggaagcaattcccggactttgagtagagacgtcgcattcgtggcagtttgagctttctttgcttgtacactttgaaaaccaacaaatcctaaccgtaaagcatccaatatgtcaggatttagcatccttttgcacggctggtgtggtgttaatatctatacacaaggagtatatatagtgttctattgtgtcccttgcagaagaaaaggttaaatagagcgcaccaatttgttgggtgcggaatgattagaagttcttgaattgctcttatctaggcgtttttgtgcatgttgagtgtaagatactcgcaacaaaaggagctatcgtaataaacacaggcattcgttgctaatttgctctcgatagacatctaaaacagcacaaacgatgtgagataatactcagcgtctaagtttgtacaattgataaatcatttacaatcgacagtgcagttcacgaaaacacggtctctacatcagaactcaatatcacagttaccatctggcgcaatatctcgaaacgttgcaattgccaaaccggataacattccagaaaacaagaaccaaggtctctccaaggtcgcgagggttgtttgtgttgggtaaaactgtttttttatattattatttttgacacgggggtaaaactggatatcagtactacaccaaaacataatcttggacaaaaactggattatcgtccaaagcacttcgaacagcttttatattagtatcatagtgcattcgaactgtgcctccaagacttgcgcgaatcgtagtagaaaaccgcagcaacaatattatcactgtctaagttgactggcaaacatataatatactgtaacatttaagtcacagttactggcaacttggagtgacttccgatatcacaattctggagttatgagccacttgtcagcctgaaattacattgcaaactaaggtcctttttgtttgttttatctcattattaatttggctgttctaaagcctaagccgaaacaaagggcctaatgcattgacttgcaggggcaagggcaaggccgtcgctgatctttcaagatatcgtggaggcatcgtactaccttggccatggttggcctttctgtaacctcgggtgcaacacaccacgaagctagttccttaatttcctcgagatgatggcatatagcaaatacgctatcaaaatatttaattaccgtatttatgttgagcatttgaatcttgtttcctgtgaagagctccacaagaacccctccaaaaccatacacatcgtgttccttagtcatgagcccagttattaggaagtgtggatccttgtaatgtatgttctctgttagaaatcttgcatactgagccttgtccaaggaaaggagctttgttgttccaaaaccagcaatctttgccggaaatgtactagttctaggcatttcgagcttagatccagaaaaaacatccactattacattggcagttctgacatcgccatgaaccatgtcaaatgagtgaaggtgagcaaggccttctgcagcatcagtagcaatttgtagacgtacataggaagtgaaaggatgttcaatactctgccacgccttaccaaaaagagcgtcatgcaagcccatctcaccatactcatagactaatactggggcatcgacatgatctaggcagcagccgaaaagcttggcaacattccaatgcttaattctagattgcatgatcatctcataaaaaaatgtctgtttccaatcctcatcaacttccacagacatctttatcacaatcaatggagtgtttttcaaacgtcccatgtaaaccttgcccatggcaacatcactttttcctgaaaatgtctctgaggttgattcctgttctgggtcacctatgatggaatctatgtcgcttttgtaacaaatctttcaaagccagatccacgcaacatgacctttatttcccttaatgtcatgatccttctctctctcaactctgcaagccttctctcctgtctcaatatctctgaccttttgatactccaaagctgtttcaaaacttctttcatttgcggccgatcttctatttcagactttaaacaatcaagtgcaagatttgcaatttcctctataaagtctatattctcatcggctgcaatttccttgtcaaatagttcatgtcttttatctctacttgagcgagcaaacattcccgctagatttctgctctggtcatcaatccctttctttctggtgatgagctccaaaagaacaaccccaaaactgtagacatcacattttgggcttagtcgtccagtctcacagtacactggatccatgtatcctttacttcctataacaaagcccgtgtgttcatcattgtccatacagagaagcctagatattccaaagtcacatagcttcgccacatgcttgtcacctagaagtatgtttgatggtttgatgtctccatgaaggattggatgattttgggagcaatgcatatatacaagtgcttctgctacatccaatgcaatctggaagcgtgtctctaatgagacaggaagctggccactcttcccatgcagaagttcagaaaggttcccattggggacaaactcagtgaccagcattggagcatctgcctccacacaacaacccaataacctaacaatgttcctatggctacactgggactgtatgatcgcttcttttgtgaactccttttcctgtgttctccaattatattgtttcactgccactgaacggccattatcaagttttcccttgtacaccacagaaaaacctccttttcccaggacagtgccgtagttgtttgtgatgtgcttcatctgccttcttgtgaagcacctaacatttggatcaatatctgcttttgccaatacttcatttgcagtatccctaaaagattgtgaaagtttctcataccagtctcccatatgagtggcacagaatatgttgttatattgtgcctgcagattcatgaagatggtagattagtcaaagcaacatattcattgtttttctgtaatttatagtgtggagagccaataaaacgcatggaatacttttccgaggagatcatgtgtacgatttccagtttactctgaattttatcgaaaatagtagttgaaagccctactggagcaacaacaattcaatgctattttgaagatacaaatgtgtcaagacagctaatcttagcatgttgtctcaaaaatatactatatgttagaaattatttatggcagtacagatctaaaaaaatccttatatatatgaaagaatgatggccttgtatgcataaacattcctctcacagttggcctctgttttaagatcatagtacctttttttcattcttctcctaatcattatacgtatatgcatggcaaatatttttcacgttctcttaaaccaaattttattgcttttgaaaatatgtgagaatggttccgaaacagcactggacatcaagatgaaggaaaagaaatgatgtgggtccaggatgaagggtgacaggggattttgttttcatctaatagtcaaaattattgggtccaccactttatataaggccatccatttagcgtagcttcatgtgccccctcccccaaaaaaatctttcaattaatgaacaagatcaacctatattagtcttagctacttacagaaaaaagcaattggattctttctaaaaagaaaagttgactcatgaggtggaaccggtggatctcagattttttctatccttcctttagttttgatgtgctaattctaaagaaagagagagagttgaggagaagatagccccaaaatatttttgtacaagggaggattcgaatgtgggcgggctagtgttggagttgttccaaattcacttcaagatattggccgggcttctgacgaagcggagcggaggcccaagccggaggcttgggccggagcgtagcggagtctgaagcccggcccatccggccgcgccccatgcacacacgggggggtgcg

SEQ ID NO: 40985 - DNA, 4016 bp, Oryza sativa
cggtacggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaggctagcacaccacccgtgttgctagccactagaccccaagagtctcctcaatgtgctagttctgaataatgaattagagtttttttacggtcctttgttcctcctggtacgtacctagtatctcgtatgtccattaagctggatgcaaagacccaggtacttgccggtacagcttctaacaggaagtcacaggtggagggtataaccacacaaaggctaaaaaggtaacttcatgtaaagaatagatcaaggatttgactacatggaaagagattgcggcgttgatagacaagcgtgctgttcatcgtaagccctctccagtctccagtattgtttcacatcttttccaacagtgcccttgttgattgaacggttggatctcatttcatacttggtggtaccagtatggcagtagctagaggtaccaccttctggagcataacaaacctcaatgaattaagatactagtctgttggtagtaacaagtttggagaagatgtagtcttcgaatagcatcagttctctttcaagtttcaacaacctgttcaacttcaagattaagcgtgtcctaaagctacagccgcacacacattggacattgtacatttgtactctgtcgtgtttttgcaaaacaaatggtggggaaattgaactgaaatcgaaccctcgcaacctggagtgactgtgtgaatttccatgcgcatgtgctacatcttaaatccttgtaatgcgccattccattatgtaagaagaagaagcatatgatctagttcctaaagaaattaacatgatctcgctcttctgtcatgcaaaatgtgcaaataaatcaaaaatcaagctgcaacaagaaggtagaagagagtgaaatagcctgtgcacctgtagctgtagcttagtacttcacggacagtcggttcgccaggattgaagaaaccgtgttcttgaagaagagaaccaggcagatctgatgacgggagaaagagtgggcggacaaagaagtagggcgcacgtggtggttggggggagccgactagtcaaccatcaggtcaacccaaagcatttccctttctaaaaaaatatattgaaaaatcaacatctgcagctttctgagggctgaggcttggccgtacatttttttttccaggaagccgcaatcggcggcgggagggagcagggccgctccggccgccggcggccgctcggggccgtcgcgctggtgcgaccttcctgcctggcttgtcgatgcgccctcgaacggcacgtgtcccgggggcaagcaatctccgacgcgcggggacgagggagagaaaatgggcatttagccacttttaaaacacggttttgctataatactattctgaaaatgcgtttcgctaaaatgccaatatgaaatacgcactcaccaccactttgtcattttggccattttgtgcattttcgaaatcattttctctcctccaccggatgatgagatgaaattgcccttcctcgtgagcgcggcgagcaggggacaaaacaccatggcctcgccggcgtattgagtggcggcagtggcggcagctatggtcttctcccaactccgtcgccccatctcactctccaccctactgctgaccacatcgagagaacaagcatgggctgcctctttggtctcaatcccatcgccggacgagatgaagacgatgatcatattcaccaccaagccacggtcgtccttgtcccttttgcgttccatacttaactcatcttgccgaacaaactttcttttgacgccatcgcgtttgatccattgtagcaacgggaacaccgccgtgccatcgtcatgctggagcacgctctgaagtgccgccgcttcggcagcgtcgatgtccggttcctcatccatcctggagcaagccaccgcgccatcagctcctccttgaggtcctctttaaaacccctcaagaaccgagaagattggagcatcaaggagggagatcgacattgtcttctccaactttggctgccggcgtcaatcttcgattccctccgctccggtgaccccctcgttgattctttgcgcatgcaccatccctgggacctaaccaacctcatggatgcacatgcatggcttcacatcgaatggaatgagttgacgtcgtctcgccgaagctcggagccgccactgagacgttttcttgatcgctgccatcaaccaagccccatggcctttgctcggcctcgccctgtccaacaccgtcgtcgccaacttgttccaccgcatccccgacaggtcgacgcccttgtcagcaacgacgatgaccacctcgctgcgctcgaccatctccaccggcggcacaaaacgaagaaggagagaaagaaagagaagagatggaccttccattggccccaagggcatttatgtctaatcaccataaagaagaggcaaaatgattttggaattaagagaaaatgagaaaatggcaatccggcgagttgtgtggccttgatattggcattttatcggatcacgttttaaagatggcattctagcgaaaccgtgttttgaagatggctaaatgtccattttctcgatgagggatccctcgcccacttcggtaatgatgggcaacagaccgcctgatccgatccccggccggccgccggcggctgcttcagagagatcccccgaggcatgcgcgtgctggcaggatcacagccgcaactggcgctcgcccgcgccgcagccacaatcacccgacgaccgccattgctgcctttgaggtaaaggcaaaaccttgtttaccctcgccgctctcctctcccaatttcggtttttgcgcagatgaaagctttatgcacagtatagtgtcaaacttaaaattttgactaaacgacttatcatactctttttatattagaagaagacaaggatggtagcagtgaatctgtcaccactcaccaagtatagttgttttttttatttaccacctactttatcatattttctaccaactatccatgtactttaatgttataaaataattcctctaaatatatgattctatcatatttcacctgtacaatatagcacacatgggtacaaaattatcccaaaaatatcactattaatttgttttaatctattgcaaagcaggagtatttggctagtaatatgaaatagagggagtaacttactccgttgcattgtaggttctttttatcatcacttcatttagttcgactccgttgttgtatgttttttatgaacggcgtatatgtcatgctcacctagttaaatgtcatggagtgcttgctacatgtaactcaacatgcctgtaattttatatggcagcacaaagcaaataagattgagagagtgcattttagttagtcttaggaatataatggttaattttactgttatagcttatttagtgctactgtcgatcatttctacaagggtttatgttgagtgtacaaggcttatttggttccaccttttgagccttagactgatcgaactgttaaaacgggaagttaccacgtcaacgagatggctctcagtgttcgttgaggtgtagttacacaatttatcatgtttccctacctttcgaacttacattaatttttagtttatccaaattatttttttcctcgagtatcataaatcgacaatcatacatgagagtattcaataattattggtggactaaatttgttttttgatgtcatggtcggcatcacgtatgagcgcagacagcgtgcggcgaagaaggactagcagcgtgtcggatcagaaacagtaccgcg

SEQ ID NO: 40986 - DNA, 6515 bp, Oryza sativa
gaaggtagttatatattcttaaattcattataatccagaaatatatggattcttaacagaattccttgacagttgggcatattgatatttaccagaatttggaaggtggaatagagctttaagagaagacacatcagaatgttgatatagtgatcccatatcttttcaaaataaaaaagagacattcattgcataaaaaaataacaggggaaaaatatttgttcaacttctttaagcatgaattgacaaacttgatcctcactgaacaggagaggaatgccgagacaaagaacagagatattgcacagaaacacacaacttcactaacatggagaagctgcaacagagagtaaatataaatgtgtgatttttacttttactaaatcatcttaaagcctgcaaagttataaaatgaatagttttagcgatttctactaatgtaatttgttgagacaaaaaaaagagcatagatggttgcaatgctggaaaaaaaaacaattcctttttctaattaaacacaacgtcaagttaatttataactgtcaagttgaatgtctttctttgagataaatacgatttaataagagtaaatttaaatcagtgttttaaccaaatatcgcataagacatttaatgacatagccacagccggtcagctactaaacaaaggccaagagaaactgaaaaaaaaaatggcaactgagtgatacttactgcatctaaatgcagaagttttgcaaaactctgaatcctatgctaaaggctaaactgcacatggagaagcaggagaggagacaatttgaaagttatagcccttttccaacctgacttactcacaaaaatggttagctgatatgctagttctccacaaccactctttgcagtttggcctcccctaaggctgtcatttgctttgtctctaatcccacttttgtacagatttttggtaaagcaattactgtaattcagtgtctcatacaccagcattcaggctatactctgaatcagtaacttagaggttttcttaataggaacttcttgacaggctgactattatggaaacagaggtacaacaaataaaaggataggagtctgattacaaaaacagaatagatcagagccttcaagtgcaatttgtctaatttgaaatgtaatggaacttcttgaaatgcaccttgctttgggctccaaaactgatacttataaagaagcgaggaaagtggaagagctgatatgaggtaccttgatctggtgaatccttcctaaatctgcaggagaagccacagcattactttttagttcatgtatatcctgccaaaaaataaagcctcattcacaaaagctattatatgttagctcattagtgtcgaagtaccaattacgcataatatttcagagcatccacttgataaatatacgtcccaagtttcataacatcgattgataaataaggttagcagatgctgaattactaaccaagccctcatttctatatgtcctcaatgctatccatggtttcatgcacaagtaaatgtctaatagtagcatcagccatcgtcagcaaatgttagtttacacagatatagataaattgatatagagcatgatcgattctaatatgtgaaatgctagccctacttacattgtgaaacggaggaagtacatgatatagagagaagacaaacttgagtttgttccttcaaattcactagatcccaagctcaaaactatgatacaggcaacctgggaggtacaaatttacacgagctcatcaactcaagaagtacttatcacctccacagttacaattgtcaactcatttgtctcagaaggagattttctccaagagctacttcagctctctggttatctggtatacgctttctatcaaaagacatgaccactaccagctcccagctttgctgaggctgcaactccctttgacagcaaaatcatgccaactcacagtggtaacacagcactactggagcgcccattccgtgagaagaagaacccctgcccactgctcgacatcgatctgccaatcccaaaccgccctgcctgacaagaggaagaagacgtccctgttgcatccttctctttcacgctgaataacttcatctcttgccattcggaaattttcgatcaccccgcatggcatcgtcctgcgcttcaggcacaaccaccaggaataacggtgagtccatggacgccgagcgccgtattggcttgggcatcaccctcccaccatcctctggtgaagctgctgtgtcctcactttgagtgtccgaagaggtgtcagaatcctcggagacatcggcacgtgattccgatagcgagatttcatcaaacacctggtgctcttccgcttgcccaccaccctccgcctcaccttcggtagccgtggcggggagatcggagggaacgacgactggggatctgcagagcgggcagttgacgtgtgcgcggagccaggtgtcgatgcaaggcgcatggaacggatgcgagcagcgcgggaggaggcggaccaactccccgtcgcggaactcgccgaggcacaccgcgcagtcccctccccacccaactccggcgcggtactccgcggtggctatggacgtgatggtggcctcgtccagccccaccgtgcggatgtaccacacgtggtgcacatccccgccgccgccccccgcctcctcatccccgtcgccgaacccgtcgtcgccggggagcggcgcggtcgcggcccggcgccggcggcgcaggacgacgcggcggcggtagagcaggatcgtggagacagagagcgagatgaacaggaaggcggagaggagtgagacggtgaggaggaggcgtacggggaggtggtggtcgtcgacggccacgtcgacgcgcgggaccaccggcgacggcggcgggggctcggcgatctcgtagcagctgccgcctgggcagaccgggtggcagtcgagcgggtaggccgagcagtcgacggtggccgtcccgttgacgcggctcggccgctccgggtacaacatggcggcgcggaacacctagcgacgatccggcggtggcagctcggcggcggcgacggcggcgcgcatcggtgtgagtaccccgcggcggcggcggcggcggtggtggtggaattggggtggagacgtggagtggattggtcgttgttgttgggtttggtaaaggtttgggggggaatgcgtggaggtggagctggagagcacacacgctacgagtgccaaaaaattaaagcacagaatgacctaatcttttgtatgcagtcactgatactgtgggtccagattgccaagacacaaattggggcccactactcagtgacaagcaatcggttttgctgtaacgtatggtcgtgcacatagcagcaggcggcgacctcggtttacggaaagtcaaaggcgataatcctaattttgaatggaaacactgcaggcgaaaggaaagctgaaggagttattctcccgtatctgtagaacggcagtagcaagttgaagagatctaccccgttggttttggcatctgacggcctcagttcgttggtgagagaggcagcgagatttcgttagtggccctatttggggccatgacagtgaagtgtcactacttaatactacgagtaatggagaagacgacgactgcacgggttaattatgtggccgacagtggacgactttgtgacgccgccgctgtttagggtaatttttgtccgacggaatcgggttggctctgttaggcaatatatttaatccaaatcctaacgcaatcagtgggagatcaatcgcaaaatcaccatcatcgataagctttttctgaaactttccaccgccaagtatttgatggtctctgaattctccttgcgattttgaaacgacactgctgcgtttgactgggagtactggaccaagaggggaggactaaaatatgacccgggccagcataagaattgctgggccgtcccgaaggagtacgtgccaagtcggcccatcaggcccacgtaaacgggaggtaattaaggtctgcgtcacgaaagcgattgattgatcatcaggtaatcctcatgcgtaaattgtactcgttcctcttcctcctctactactccaagtcgtttttatcgaatttttaatgcggatgactaatcacttcatcagaaacacgatagaacacggcaataacatatgggtcgtttcttccctccgtccacctaccgcttgttcccctaattgatctctccccatggcaaccctcacgctgccggcgaccggagccgccgcgcaacccggccaggaagacccaaggtatgcgttcccttggttgcttatttctaaagaattttacctttaaccaaagttggatgtgaaatcgagtgatttgttggatttgctccgtctcgatgcagcgggatcaagaatcctggcgatggtgcgggagattcgagcggcatcgactccgggtatgtggtctctgagcaagaacagcgctttctcttgcttgatttttggagaattttaggtcaagggcttgtattaagatggttggtttgtgtggtcagatgggttgttctggggaaatctgacatagttccggcggatttggctgccgctgccgctgacgccggccaccgacagcttgggttctcgccgttaccgatgcttccaatttggtaggaattgggggaagaaataccgtattgtactgctgttctgagaaccattgcgattgatatctctcgtatttttctcagggtgcagatggtgcttggaggcgtagtctacacggccgtgccgttctacaatagggccaggaaagccgaaggtgcaattacacaaatccaatacctggttgctttagagtttagacccaatacaactgctaatttgcaaatgttataggagtaaatcatttccccttagctcattaattgtttgtgatcgctttagatccatacaactactaatcttgcaaatggcattggagtaaatcattttcaccatagctcactaattgtttatcagttattcatatcaactaccccttaaatggcatacccatataactctacttgtgttgctatgttagatgaggtgacaaaaaatgtggaaactgcattggaggttgtggagcacgccgcggaggtgacagagaagttagctgctaatgtggccaatgctctaccagagaatggtaccctgcataagttggccgaggaggttgagtacattgctgagatagtggataaggatgcacagaaggttgaaatcatcataaagaaggtatgtatgtcaattgttgtgtatatatatcatcatgtcaaggatatatatattagtaatgagaatgttatgtccacggtacatgattagcatgctttctgtttagatgtagtagaagttacagttagaaacatcatatgcaattacatgtttctgaccatttcagactattgaattggcttttgactaaaggttagtttgttgttgcttgcaaggaaccatggacagattcaattctttttttcagcagcttcataaactatgaattggacagattcaattctttttttcagcagcttcataaactatgaattagacatggctttgggctggggaaagcatagttcactttgtactgggaaagaaaacaaagagagttggacatggcttctctcgaaacaagctttggtagctcaattataaattttcaagagaactctagcatctagatgagatgaaaaacagcttgcttttgttactgtatacactatacatagtttcttgttgtattacctgaattatcaatattaaatttgactggtttacctattatctctgttctatgttgcagattgaagatgtcagcaatcggatagacgctgctgtggagcctgtcattgaagagctcgaaaaggaattcaacccatagccaagcatctggtggatcagaaggcccaaaattattcttgttgtaaatatcgttattttctattttgttctttctaagcatctattgtgtacatatatattgtgatgccctaaaatgaaaccacgccgtagttctagcaagactaggtgatggtgtgttggatgctcgaagctgaagcatcctgtaatctcgttgtaaaatacaactgaagatctaaaacagtatatcggattgaaacttgaaagaacatattcttctgctgttgtttcatgcgtgctaaattactcttttgatgttgctaattattttttccctttgtttgaagggaggccatgaaatattaatcagggttagcacactcaaaattcagactgattggattgtagtaactcgactatcaattgccttgccaccaaaaatctagtccagaaatctttatgtaaactggaagagaagtcaatcagatttattacttcaatattgacattccaagatcatacttctcacctagcttatgaattcaactgctcttctcacttcaaagtttcaggcgaaagagactctgta

SEQ ID NO: 40987 - DNA, 8495 bp, Oryza sativa
  unsure (1)..(8495): unsure at all n locations
atattcttgtatgttgtacgggaggagtgttgttatacaattattttcatgcatttgtaaccaactcctaaataatgatgattgctaattggtacgtgttgttttttcgtaagagtttcccatgtaaaagaatcatgtatctgctgtgtatttattttcataacatttcttgtgttagcaatactaaaaacttcatcccaaagataaattcagttgtttccactttccaacctaaccgaaccctcccaaaacctttagttccactcccacacaaaactcaactcaacccataaagtatatagtatatccaagcttttcaaaaaagggaaggtatagagtgttattcagtttcttccaacctaaatccttccagaacctaaaactctactctttcacaatgttcaacttgatccacaagataatttcagtgatttccagcctaaccatactaaacctaaacttccactccatcacaatattcatattcctgagcagcgtaaggtcgtccttattccaagcaggcccgttgcaagaaaccttgcatttcagagcaacgaacatcacgcgcaatttggcatcgcttccaaccttccggattcgacaacaaaatcacaattttattgttgtcgcacatgatgagttgctacaaatgtttcggtatgatccttctaaaaaacaaattcttcagaatgatccgaaaatatcgtccatggaatgatcgacatcgcaatctgtccaacttaacaaccaaattaagaacagcagatcgatcttcaaaagcacgagttcgttcgatcagttctatcaacgtgggctatgcccagggtgtaatattccagcagggatgtccagtgcatgctacgtgacaccgatgtaccaactatcctaccaggtgaacgtacgacttcgtggcgccgagccggctacgtgacaaccacaaagtctctgcaagatcatataagttgtgccaacatgttgtccatggcctgtacgcccatgaagtcctgactgtagtatgtatgtatatggtgtggtacagttggaatatttcggcgatgacgcgtggacggcggatgttagagtctggtagaggtcagcatacaggtcactagagtatctttatccccaagcatgttgagtcgctctatttagtgatttgcatagtgttttttctttctcgattatacggaagatgaattgtgactgtgagtgtgcccctaacaaaacgcgaaaagagaggttgatagtaaatcttatccgtatgttcgtcattcctttcatgacttgtttaggaataaccaattcgttgggtggttcgagtatttcaaaaggaatagtaccgaatctagatacttggagttatgaaggtgtgacatgcatgggcatatgttatgttttcttgcttgtatttcttggcagctatctgacataaggtatattgagacctcaaatacctcactaaattcttattgaaaaagcttgagttcagctgcttggcgccggttagtaattttgaggaacttagggagcaaggctggatttggatcaaccacactatcttcaccttgactcggtacctaattaagctattttctagagcctaaaacctcaggccgggctccaccagacagggttcaacctctaccagcaaattaagctgtgtaaagcttgttatcaattttattactagcagtgtaaagtttttagcagttggtatgattatgaaggacttatatattccccctgaaagccagttgggaaaccagactgacataattatgcactagggtggttccttggtcattgatgaatgattaggaatattttcctaaagaggttgccaaattccatactccataaactaaaaggtggttagcactaataaagcggctgcccttcgacatatataactagcaaatcataaggacagcccacagcttgcaaaggagtagtatgtcccacccccagggtctgggcccttcagcaacaggacagctgagctaagtacaccggccgttcatttccttcccctctgtttggaacctagctgatagaaggtggttgacaatgattgagataggagggatttttacctggctcaggctgcactgtaggcgcttgatattcaggtgagattggcaggagaggcgagttaacctttcacatgccttggttaagagcagcaccggctggcccagctctgtcaaatggccatgttatcttgtcaagtcgaagctggctcttctcttggctgcattggagaacaggttgtgcctgcctgggaacactgtagcttgccgccgttgcacatgtggaagctttccctccgtaccaaccggggtcgccgtcagtcgggagcctgccgccgcagcccgtaccgggaggtgcaggcgcagaatatcgcagcctctgcatcatgcaagaaatacacactgacatatgttcatacttcatgggactaatagcattgttcctttttttcatgaatttccagcaaaatagatgctggcatacattctcatgggagttgagtgtttgatgacacattattacgaaacaggaccttgataaatgatagggtgaccatagccaggtcacgctcacatgaaaccgagacgacacctcgagctttgctgcccccagagggccctaagccctagcccattcattcctacagtaataactggaagaaattcctgaatgccaaaagtggcctcatctgccaaagccaactatgattcggcagttgttattagacattctctatacctgttgcctttttgaagtgcagactgctaatgtgatcaacctgttattaaccaaccaagccagcattggtggcattatttttatgctctcaactactaacttttctaaggctttgccttgagcagaatggaagagtatggagcaattctgtattttggtcctgtaaatggcaccccttctggtacaatatcatttggtgattccaggttggtatccacctacaaaaagattattagagcagatttagaatgacaataggagcggaaaggtgtgagaaaagagtgatcaaatccagccagaccaatcattgtaaaaattaaaagtagctaatgagcaataaactccaaaccagttttagcaggattgctagcacaagtaacaaccgtatacagcttttggttgtagaactgtatcagtactacctatgtctattcctgagaaattttgtggaaacttgtatatcttcttttaagagttggtatttgtccgagcgtctaatgtagtaaaattcagaatgagtactggcagcacttctacatatttagaaattacaaccacaccatgctaggattatgtaggaatttactttactatacgtaagaaatttagcaatgctgaaaagtatccataccacacggttccaacatttatggtgtggtggtgggggaattacagcgtccacaaaatagtcatgtgcattgaatgccaaatagatatctccaccagagttgtgatcatgtactctacagtaaaatggcaatgaaagtcagaagccaagaatttggattttggagcatcataaacaaataccataataaggtgcataaacgaaagtgatcaacaaacttacgtgaatgccaaaaatttgctttcctggttctcccaacaatcctcgtgccaggtgacatcgttctaccaacaaggaagatcacaatacaatgaagaacatttgagacgaaaaaaaaactaagagatgcaactgcaaaagctgcaaagtgtatatttgctgtattatactattctaatcagacttgactgagaaaatatacttggaatttcgacagacaccagcagctattttttgagaagatgatgaaatgattgtcttcaataaaccagttaattgcaatgatagcacttctaggtattacttactttattaagaaacctgtctcgtcttaatattgggttgctgtgacgaaactttatcatctctgagaaaaacctgaaatggccatctcttctttgttccaactatattcacatggattcggagaaaacaaattatatatagatctgccaaattcataaacatattcctggttgaaaactaaaatagttacggtaatgcaacctgttcccattggaaattattaatgcaagtatcatgtccatagctattgttgttcccataacgtgtatgaccatattcatcgcccatcaacatcattggggtgccctgatatatgaaaatggtgattatgtgataagtttatacatgatgcacacataaaataaactgtaggttacttcacaatgtttacctgagaaatcattaaagctacatggaagtttttcatttgtcttgaacgcagacttaacacattcagatcatttgtttctcctgttacagaacaagagcatcaattctaacatcaaacatttcgcatagcattaggttaaaaataagggttaattggatccatgccactgcaaatgtggcaaatcaaaaaaatgccacacatattcgcgttatcggctggatgccactgcaaatttttaaaataagaaccatgccactccatcacgatttccgtcctcctctctctctctctcacttctgctgcccccggacgcgtgtgagcagctcaaccaccggagtcgaagccgatgaggcgcacgcgacaaaacgcatcggcttcacgcggcaaaacggagaagaggatggggagctggcgcgacggctggcacgggcggaggacagcccggcgcggtcgcggccgggcctgacggggttcggcgcggaatggagctcaggcagaaacacccaacaagctcagggagtagctagctagctgctacagatgcagcgcgcgaggctagctagctagctaactaaaccaatcaacatacaaccatcgatctnnnnnnnnnnnnnnnnnnnnnnncgcggaggggcatggccgccgccgaggaaggtcacggaggcgggcgcgggcgtaccgccgccagcgaggacgctcgcggggaggtcggggagggggcatagctgctgccgaggacggccgtggaggggacgcgggcatagccactaccggcgaggacggtcgcgagcgaggccgccgccgccgacgaggacgcttcgcggggaggtcgcggagggggcgcagctgctgccgaggatggtcatgtggagagaggagatgggcgtcggcagcactagtgacaaagcttggggccaacagcggcggagttcgaggctcgacgcctcctccatcggcagcaacgacgagcggccctcctcgccagatctgggcggaggcggtgcggctcgtcgacgaccacgacgaggacagcaacggcggcggcggctcccgagctctcccgcgcagatgaggtcaacggcggcgggtccaccgcggaaatggtcaacgacgacggctgcaacggtggagagagaggaagtcggcgaggaggtcgcggaggggcgcggggagcggacgcgggcacgaccgtcgccggtgccgtgctgccatccaccaccgtgctgccgtgccgccgtgcgccgtgctgccatccgcgcccgccttcgtactgccgtgctggtgctgccgtcgagacgaggacgacgagaggacgaagacggagacggcggaaaatgtgacggattggacggaaatcgtgatggagtggcatggttcttattttaaaaatttgcagtggcatccagccgataacgcaaatatgtgtggcatttttttgatttgccacatttgcagtggcatggatccaattaaccctaaaaataattatttctgattcaaagagggatagccatctatggttgcatttggaaagttctgcacagctcatagagctatttggatccatcttgacattgaagcttcactactaggggcaatcttttagttctgttgaattacaagacattaaatttcaacaaaatcaatacaagacactaaatttcaacaaaatcaaactatgtcattctctttatgactatacctttaattcatacaaagggttgttttaataataaactcgaccaagttttctatctttacagtaccctacatcagtcagatgtatcaatttgatgggatatgaaaataagcatctttttgcagtttcatggaatcatgatttcaatgtacaaaagaaaatagatattcggtaaagcaggtaccttcaacaccacagttccagctaaagttgtcattgcatccatcacagccaccttctccattagcatcattgtgctatatgattttgataaaaagaaggcagattagcatacacttcacagtataaataaatgatcttaactaaactgcttagcttactccagttacctttaagttgtaagaaacaaggtcacataaagtaaatccatcatgtgcaatcacaaaatttacaccatggtaaggcttccgctcgttcacctgccacatcaggtgaattttattttacatatttttgtttcttgacaaaaaataactgagtctgaaccccttcagtgtaacagtagttcttaaaaatttgtccacagaggttccttacacatcctcacaaaatgaaataataggtggcatcataccatactgtgttttgcactatcaaatggtatgtcactagaccctgaatacatttatatccattaaacaattggatactggagaaatcctactgaactaacacaattgacatgatagaatttggggcacgctaaatgttgataatgacctatgctctaacagtgatacaaaagtaacaagcatgtaattaaacctaaacttattagcaataactttggaagccgctcttgtttggaaatggatttttattttatttattttgtgtgtgtggggggggatcaaagttcaaaaacaagcgatatcctaagcaaatggataaaaaataacagtaaagggaaaataacatctaaaagagggggacctgatagagatcagcagatccagacacacgagtcgcaaacacccccttcataccagggtcaccctgagaaacaactccaaatgtttagcagcatccaatcagtcattcggtcgttattatagaaacaagaataaaagaacacaaacagaagaattctcatggctatgctaggcaagcactgataaaatgcagaatgttcagtaaattcagatcttcagttgaaaaaactcactgatgtttgaaatggttaaaaaaattatgctcaagttctgaaggagatcatctaaatatttggctcaagaatggagttatggatagccaagatcagagtttgggaaactgcaggcacctaattctacccctatgtttcagtaacctggtaatctttacacaactggtacagagctattgcataaaagtatgttgccattttctcaaataatatgcggaactgtgatcgtatgcttcagaattgcccattaaattaaataaaatactgattttgcaagggtactgatcctatatctagttaaacatttaacaaaatctccatgtttcctagccattggctgttccacaataacctaagtttgccgctaatgttcatacaccatcaaggacaattaaaactaatataggtacagtgagaagctaaacttcattaacatgctcagtaaaataactatcctatggcatggttaattaaaatactctggcagaaagggatgaggcaagggaatgatagattagcataagggcataacaatcctattcctcagcagtaattcctgatatactgccatgatgaaatctctaccataaattgcaggtgagtacaatttttcttatctgtattttctaaaaaatcttctctcccggcatattaccttaataaatcttcgaagatcatctctgtatttgccgttccattcagcccacctgcaagaggaatgttaaacatgatcaccatacctttaaaaataaatgaaactcattatagaataactgatctgtgtatgcatggtagggaaaggtcactgaaccgcacaatgaagcatgtttgccaagtccaatgagaaaagtgatactagcaataattctctcatttcaagaattcagttgttaagtactttaggaatgagcatctcagcatgatattatccataacagaaaatagttactgttttgtgttactgtatcaccaaatctttagtcctaaaagaagcaaggataaaacatctataccaccaaattctttttatagaaatatagaagtgttcaaatcacctgtcccagttagggaaacgccctacgagataaaggccgccgcaatcccaaggttcagcaatgatcttacatctagataatacagcatctttggcaatttcctacaaccaaataaattaatatgaagaaacataaaagccactagtctcgatacatcaacgtgagttgtatgaccagagattgatggattaggatttagatggtcttgaaaaggtggaatttgtcataaatacaattttcta

SEQ ID NO: 40988 - DNA, 952 bp, Oryza sativa
atctttttcttatacttaaatttgactttttaatcttagatttggagttaattttagatggttttgcatcgtagtttattttttaaactttgttttttgtttttagatcgctaaaaacagtatataaaagttttatatacaaattattttttatttgtaaatatactgtttggcttatacccccaataatcccaacgatggggccgtaacacacttgggatgattcggatgaagcttcctgtctccaggaaaagaaaggtttaaaagcttgcaaaatccaaaccgacaatctgcaacaaaactgcatctcgaccgtcaaattccgatccaacggagagtgttggaaaattagcactaaaccccctgataatacctgtatttttcatgtagtaaaccacatctcctacagttctacttctttataagctcccctacctctactgtctcggacaccattacagtacaccacctcaagctagtagccaccttctccccaagcacacactctcctcccaaaccctagcaccagctagctctctcactctactccaatggcgcgcttccagatcgtggccttggccatggcgatgctcttcgccgccgcatcagctcaggccccggcggccaccccgacgcccgctcccaaggcgtcccctcctccggcgacgccgccgccgacgcctgcgccggtgtcagcgcccccggctcaggccccggccactcctcccccggctccggctcccgcccccaaggcctcagctccggctcccgcccccaaggcctcggctccggctcccgtgcccgcggccgcggctcccaccccggagatcagctcgccaccagccccgtcaccggcaggcttggccccgtctcccaccgccgaggtgacccctccccccagcgccgccgccggcgtctactgcgacggaggatgaggagacgcccccaccac

SEQ ID NO: 40989 - DNA, 4847 bp, Oryza sativa
gttaagttttgtatgcgggtatggtttttttgttgaggatatggtaatttagtgtccattaaggtgtttcttaattgcttttttctttttattatatctatcggattttaatccaaagattaaaaatccgtgtgatacgatcataaaaatctttcgaaagatgtataggtacttcctaaaaatatttgtttcttttcatgtctcactggtgggcttacaaaggctagcgttcatacaactatacaaggcctttcttttgggctttaatactatattaggtccatttatttcttttattgcgctcgcagtaatcgtacaaggatctggcatatcagcgtatggatatggttgcatttgctacgagtttttcatacctgaacctacgactaatgatcaataacctgactagacactactttccttttccctttgcaaacctgaatgaagattcatgcttacagttcgtagttgatcagaattaatgcttctgaattgaagttctgttccgtcccctgtaacttgacgtcacgttctatcttagccctatcttttgagagagttggcgatgcaagcgtttgccagatgacgaaaagcacaagagttctctgaggcaatctagggcaaattgggaaaagcaggagccttttgcagacagcattagagacttctaatataaccacgcgtatgcatccaacagaccggttcccctttcatcgttcatgccctcgatttttctttttgtctgtgattctacttttgccccaaatgagccgcccaaattattctcacctgagaaaaaaaattatttcttctatctgcaaaacgcttatgtcactcgacatatataggcattctttttcttactcgacatagagaattttaagcttgtgtgtctatatagtaagtattcctttcattcacagaagttacacctattacttttgtcatcaagaccaagaagaaattaatcttagatgttataaaatcaagaagtaaatacaaacatacaaccaatgagtatttagatgactccttgggttctaatcaaacatttaatttatctcttcatttaagttttgaatatataaagactaccaataggaacaatttatttcaaaaactcaaatgtgaaacatgtctaacttttatggatggagggaataggttgtaaggcttgtaacctatcgattttcattttttcaaattaggatttgctatttgacaaattgatagtgttgtaggccagtacgacactaatctaccgttcaaatcctacatatatacccctgcttttggcacaagtgggtgtcttcgacatttgatttttttagttcaaaagtttatctttatattagccaccatgtgtgttgagcctatgagggactacatatgcatgcgcagaacatggaattttactgtgcatgtacatcttctatctaattgaatacagtttgctctttctgaatcactttgatgttatttagcataggaaagcatctacacactacactgcctgacaaaagttatatatttactgcaataaatcccagtaaaatggatactacgcccctcatgcagatccccccccccatatatatatatatatatatatatatatatatatatatatatatatagtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttggtagattttgattttaggtatatagcatctatacatataattagttaggtatgtaatcatggattgtgaaataaagttaaatttgagttgttttgttgataggtataggtatgaatcgagttattataactaggtatatactcacaatttgaaaattttgaaaaatttgtgtgattttgtatatttgataccatggtgcccgggcaccatggtgccccatatgagtgtcctatattatatatatatatatatatatatatatatatatatatatatatatatatagagagagagagagagagagagagagagagagagcttacaaaacacttcgcatggcattgttcggttctaggttgctaccattcacatagcagcattatttgagcaaactcttttattgcatgccaacttccaacagcgaaaatatgttcctcgagcataaatactttttttgccaaagaatgaaggttgggctctccttctgaattttagggaaactattttgattcctcgaggggatgcctaaaaaccatttaaacggttataaaaaattctggaaacatttgacaacactcatagaacatatatatacaacttcacaaaatcttaattaagtccaaattcaactcacacgtcgagatataaaaaagacaaattcagcgtatgaatagtagcgcactgtttatatctgaatttgtctcttttttttctcgatgtgtagatcgaatttgaacttgattttcggtggactagtagatatcactgtactctatattgtcaatttttttcagaatttttcataattatttgcattgaattttaaagaaaaagatacacgagtggacatccactcgagagattagaatccacttgtgttcaacccagtggcggatccactgttggggctggttagtgcgccagccccacctccaatccctgcatccaatcagctattagcaattataattaatcattaattagtgaaaaattggccggcggcaaggcaagctacttccctacttcttgcagccaaggccaaactggcaaagacagatatattttatttatagatcattcttagtagaccatgaagtacctatttattaataaataaatttctttagatattttatatagccacagcaagttgaaatatagagagaagtgtgttcttattcattcatgcatttgcatatttgggttatatttacaaaatatttttgttgatatagtcttgtttgtctcaatcatactgagtttttcatagccccagctcattttgcatcctggattcgccactggttcaacctcagttaagcatagaataagggcctaggggcacactcatgcgcagggttttgcaatgccttcttttaaggtgtgaaaaccggtcgttgtcagtttgcttaaaactaagcaaaatccgatgatttttggttaactctgtaagagaatcagccaaaaccgatcccaaacagtttcataaaaatggtgtggttttcacgatttctgatcgatattgcgatggaaccatttcatttgagatcatgtctttcatataatagaaaaataaatataatatcttcaaagaacacaaatagtttgcaacttggcacttaggtgtgttggacaagcttgggcatatataattatggacacaggaacctattttaaattcgcgaggggacatctatcacctcgttgtttgcatgtcattctgatggttatgaaaaaattgaaaaaaaatcaacaagatacttggttaataagtgttaaataactccacaaacatataagaccaaatttaacttgtgcaagttgcaacgaaaaaaacaaattttattgcgaatatacgttaactagccatagtttaatttgttttttcgttgaaacttgtagaagttaaattttaacttgcgtgtttgttgagtgaattatcatatactaatatgttttgttgatttttttttaaaaaaattcataaccatttggatgtcatgcaaataacgggaggataacccttcgagagtttagaacaccaacggtaaaaagacgtgtagtgtgatttgctggaggatagtaaagggaaatatttattcttaaggccttatacgtttattctcataagaaagggattatatagaattgcaggggatttagtgtggaattaactaatccccttgaaacccccttaatctagttgggtgactgaggattacacaaacaaggcctaacaaggaatttttttttagaaaatgaattaaaaatctggcttctacattcacttggatgtatacacccaacagggattcaactgctggaacaagtatagagagcaaaggctaaagttgaggggtcaagctgtgattacaaaggtcaagtaattaaacttcggtatagttatacaaccacgactataccattaccaccagcatgtttttaacatgcttggttttatttatacccaccataagaaatttcaccaacacaaaccatggcatgcataaccagagcccccagacacgacgatacaccagtggcacaagcaaatttagaatcaccacaacaaactaaggtgattactacatacgagttgcacggtgaccaaatcacacgagaaacgagaagaaacacggtcagcttcattgcacgagtcaccaacgtgcaacggccgatcgacaagaacctgcatggcttccacgcactgtctctaccctggctcgcatgcaccgcggccatcagaacagcgcgagcttgatcagggcccccgctgccgcggcggcgacagcgctcgccgccgccggcgaagaggcggcagagtacgacgggtcaccgttgacgttcacggcgagcttcatgccgctgctgcagtggccggggatggtgcagatgaagtagtgcatgcccgggtaggagagcctgatggtggtcgatcccccgttgtcgttgctcagcgggctgttgccgttgcagctgtcgaagttggtccggctcacctccgtcaccgtgtgcgccctcgcctggtagttgaacactgcaccaacacatgtgt

SEQ ID NO: 40990 - DNA, 751 bp, Oryza sativa
ctcagggtgcagatggtgcttggaggcgtattctacacggcacgtcgccgttactcacaagtatggcacagtgaaagtccgtaacgttgccaacttagcagcaacatcactaatatcctgggtatgcgtttgagaggttagaactcaatacgaactgactagatttgcaaatgttataggagtaaatcatttccccttacctcattaattgtttgtgatcgctttacatccatacaactactaatcttgcaaatggcattggagtaatcattttcaccataactcactaattgtttatcaattattcatatcaactaccccttaaatggcatacccatataactctacttgtgttgctatgttagatgaggtgacaaaaaatgtggaaactgcattggaggttgtggagcacgccgcggaggtgacagataagttagctgctaatgtggccaatgctctaccagagaatggtaccctgcataaatgggccgaggaggttgagtacattgctgagatagcggataaggatgcacagaaggttgaaatcatcataaagaaggtatgtatgtcaattgttgagtatatatatcatcatgtcaaggatatatatattattaatgagaatgttatgtccacggtacatgattagcatgctttctgtttacatgtagtagaagttacagctagaaacatcatatgcaattacatgtttctgaccatttcagactattgaattggcgttcgactaaag

SEQ ID NO: 40991 - DNA, 3503 bp, Oryza sativa
cgaactgattatggtacactgaaactttttaaacccatcactttcaagtgcccaactaaaggcctgattgagcattttcttttgttgggcttctattcctttacatggtatctgaacttctcgtaatatttagaatttcggtatacacagcagaataaaccgaagaactatttttagagagggctttttggctatttgcatgaacttcacttggttgatcacaggatggaggagcagaatgaacgttcaggaaagtaacgggcaagctgtgtggccacaagatggggaatctttggtattttggcagtaattggtgcttcacaagggaaacagaatcctcgcaagaaggtattgaaatagctcctgtcaattgtgtcaggtcctaaggaacatggtagcacccacaaggaatgtcatgtgtcatgtctactatgcaattgttctctagctagagcatataagtattcgtagttttattttcaaacgtaacgtacacagctaaccatgcatgcgtttcacttgcacactccacatatgaacaaatcagtccattattatgaaatgattcaacactaatgattaatgaaactgctaagtacataaaggcacaataatattagtttgcacaaggaagtggcttcacttgctagaacaactaatcatcatcattcatacatgctagtaaacgtagttggttggtatgctaattgctaatctaaactacagccctgctcttcttgaatcttctcaatgatctgatgagcggcggttgcaatctcatccacagacgtaagctggcaatcatcctccacctgccattgacgacgagatcacttgagatgacgatccattggcaggtcaaacaatggcccttttttagggaaccgcaaccttttagctactccagctgagctccattaaagtaaacagatgggggaatttggagcagttgtgcaagacaaagcaagatacaaaatgcacggaaacctaggcaccaacaacttgtttcagtgtgatattgctaaccagatataggtactatgcatcttggattgagagccacacatatgtttagtttgcaatcagatcaaattgtttagtaatggtactagatgtgaggaatgcgtagtagattgtagatttgtagtagtcgtacttggattttttttttaccttgaggctgaacgagtagagaaccatgtggccggcgctggtcatgttgaggtggagcacggtgagccggtggccctgcagcgccaccaccagccggagcagctgcctcggccgccgccgtgacagcacccgcaggttggcgtggctctccaccatggtcacctcgacgtcggccaccgccgacggcttcgaccctgacgcctcggcctcggcggtgcctgctccgccgtcgtcacggccgtgcaactcgttcacaacgggagccaccggcgccgcggcggcggcggcgctcatcgagtactgcgggaaggtgaagaagctggcgaacggcgccgccgctgccgccgcgtcgtgggccgcgcattgccgggaactcttccgcgcctccagcgactggagcagctgctccagctccttgacgaagttgattgcgccgccgacgatggacgcctgatcaccctgcgcacataagcagtacatgcatgaagagagaacgccatgcaaatgcaagataaatcaaaactcaaaagcagtacggccggcggccggcggccggccggcgaggcgaagccgtggaatgaccggcagtgaagtgagctagcaagctagctgtgttaccctttgcgcgtaggacggcggcatgagggagcggagcacggcgaggtactcgttcatcggcttccggcggttgcgctcgacggcaatgtgggtcatccgctggctctccacctcctccttgttcttcgccgccctcgcccgccgcgcttcctcctccccactgcaccgccgtcgccgctgccgccaccgcagcctgatcctcctgatgaccaccaacccctcctgcttctccgcgcaattagcaggctctaccggcggcggcggcggcgccatggcagcagcagcagcggcggccgcagggatctctagctcctggaagccctcagaagcatcgatgagcacgcggcggcgtcccagttgccgccgtccaaatccatcactccctcgaagccactgaacgggctgctccaaccacctcctcctccttccatggcgcaacgacgacgaccaaacagatcaccacgcgagagcagcacggcctccagtgccatgcctccgcaggatctcacctctcaacgagacaccttttgcacgcacaaaacaaactgtggatcaagaagaagctaggtttcctccattggatagcgcgcggttgttgtaggcggcagcagctcaccttgtagcaacaggttggctttggctcgatggacacgtgaaatagctagcttagctcagctctagctctagctgcggctgtttgggaatcgaaatggatggagccatggaatgggagagcatgacaacgagcagggggagatgagagtgtagtatagtacgagtatactataggagtgattgatgggagggtttggaagggagtggattttggtgtgattaggccataatttggtcgtgtggggtaagacgtacttttgtcgcccaaaaaggtaacggaacttttaccgagcctcggacgggcctgcaaaaacccggcccagcatggctaagatgatgaagaatatttatcctttttttatcatttccgagttccaaccgttttaaagttttttggaacaaaaatatcagtggattgttttatcattggactgtgaattaccgcccgtccaaatacaagaagtatggtgtttcaatagttcattaggataaagctttgattggcagttattccgttaatatattatttatgtaatacaaaagaagaataatagtaagtacttaattcgagtacaaatatagtgacatcaaatttgtgtaaaaaatattctaatatttgttggtcaaaaccttatcataatgaaatgaaatacaccttatcatgctgaatcctaatctattctagaacaagatgatatcaggtgggtactagacccggtaccctaatggtgccaacgacaacgctttgtgctccaacgccaccatctatgaaactcacaacctcactcatctggatctagctcgtcaactgtggaattgagcggtaggggcgcaggtgggtagacctcatggtgataggccctcaccatccaccgcaagaggcttagcctgcaggagaagagatggctcgtgttcgctagcgaggtggatcgacaactcgtgtttgccatcaggcaaagatggcgtaggtctagtccaagaaggcggtcggcatggagtacatgttttagcttgtgatgcagccaacgtcgacggcggctggtcgctcgccatggcctttgtggtggcacttgaccaaacggcgaggtcgggatggc

SEQ ID NO: 40992 - DNA, 15375 bp, Oryza sativa
aagaggggcagacgagcttggatgcttggttgcctggttggaacttgctactgcgggtcggttattttatatcgatcggcatgcaagattacaaaaccatgggaacgctgcactgtgcatgcttatccgttaagcatgcggcccaggctgggataatactactcacagaccgggtcgttcttgggcagcagtttaatactagtagtatattcaaaaaagattttgagtaaaaaattcagttttagcagcaagccattgggtgcagtcgtgcagagcggtttatacgctctggagctggagcaaggtcgctgccctgtttgcagttggcatggcggcgatcgatcggagcacaaagttcatccatcggacaacagattgacccatgatattacgccatgcaacgcaactccaagaggacaaagacagagaaccaagaaaccgaagcggaagacgagaacaccggcgccgtgtcgtgcgcaaccactctgcggctcggttccgtcgtcgccgaccgtttccgaattccgccggaagccggaaaacgttttcctgtgccggcggtttcgggttccagccaaacaagccttttgccttttcccgcgcgggggttcgggaaaccttttggctactttataaccatccgattacgggtgcacggtcgcagatcgtggcttaacttaacacagttgcgtgtatttttgcaaaacgtggcattggttggcgaggcaacggcgagttggtgacgctggcaacggtttccggctccggcggacggcggcgagctgctggagtaaagtggtgtgtttgcaatccccatgttcccaacccctctccctcgtttttcgcacgcgtgtttttcaaactgctaaaccgcagcttttcttgcaaaagtttctatacgaaagttgcttaaaaaaacaaattaatccattttttaaaaaaatcagcaattatttaattaatcacgcgctaatagactgctccgtttcccgtgatcactgttccgattgggaaccgcttctagcaaatcctgctcatgcttgaactaagaccttgtttagatcctccaaaatggcattttgccattttgtaacactttttgccattttggatctaacactagtagcaaaagttggtaatttggcatttggcatttgctagtccatagtagtaaattgtgccaaaaagtgctttgggaccactccttctctctttctctctctctcactttagtgctagaatggcaaaactttaacatgcatctaaacaccaactaatacttttgcaatgccaaaacttttgccaccaaaatttttgctatttgccattccaaatggatctaaacatgccctaactaatctgaaattggacagacgtgtttggacaaactctgaatttgatagcggcaattagtgcgacatgtatatcagaagttcagaactaagagcacccgcaatggtaaaataaggtgctctctataaaatatgtacatctcagcaatagactagattaatagtaaaccacctcaatagtatgtctacatgggtatctatagctctctaatccattccctcatttttctctatagactatctctaggttagtagatagttgtgctctctctctcttcatttaatctctttcaagtagaaaaatatgctgatatggatctcttgtagagagcctatagataaccattgtgggtgccctagctaaaattcctctgaaatcgttgaaaactgtgtctcatccacaatctttcatcaaagcgtacgatataatagtttcttatcacgtaaactgaaacaagcgagagtcagatatttaccggatgaaccatcactccgtcagttcgtcatcagcggaagatagcaacaagcattgcagcaccaagtctaaagatcagaccacgtcacgatctgccggcgacggtgggaattggggatgcaggaggttcaaaagttttgcaaacgaaccctcttttccaagtctatttgcccattacaactcctaagggggttcggaaaataaaactccgaaccccattggttattttccaaccattggatcacatgtagtcctcctctgacctctcttcttccccacagaggcgcagacacgctctgtctctcagtcttgagacaagtgcgaccgtaaaatcaatctatgattggtgaactacttatctgaatgaatttagagagtcgtatttaagacaaaattatatatgaaacatagcaacagcaaatagagcaacgagtactttttttttccgaacgcacaaagggattacgcgtcaatatattagaagaaaaatagttttaattacacaacgcaatcggccaaacaggcctatgccgggaggtgggggaggaaaaaccaagaggctactgctaaacataggctactcaaaacaaacgagagatagaaggctgagccacgctacacttccagtaaaccccaaaagctgtaattcttctggaatcgtagaaaattgtggatcatctctaaagcactcatcaaacatgcattcttatctcaaaacactgaaacaagcgacagttacatactcaaatgaaccatcactccatcagttcatcgactgaaacaagcatgaactgcaagcgaactcacgatctgcatcaccagcggccgtagccgacggcggcaatgacgacggtgggaccggtgaggctgggaggtgcggaaacttttcaaaacgaaccctctttttcaagttatttacgcgttacaacttttcccaaggggtacggataagaaaactccaaaccccttgggtgttttccaaccccgcagaggtgcagacacgatccagttctcatcaccggcctcttcgattccaaaggttccagaaacttctacaaccataggtccctcgtcgcaatggaggttaggagacttggggcatgcttagctccactccctgtcgctatgttcgttcgctctatcgtcagccttggccagtggtggatctattatgggggtgggggcttaagcctccactactaatatgtaagtttatctagtttgttcagattcccctacaatttatttctagattcgttcctcggccagttgtcctgccgccggaggacgccgcccctgacgtcaataaggaagaaggtggcgtacatctggtgatcaaccgatgggcacggttacatggtgggagcacggaaatatcatgagttttcaagcaccggtgggcacagggttttcaatttcaaaattggtttttataccgggggtcatcgaaatttcagaaattttgagccgaaattatttgaaaatttgacttaaatttgattaaaatttgaccaaatttaaaaaatataaaaaaaagagaaaattttgggcgagatttgagcatgctggtggggggtgaaatttctgaaccaaaatttcaaaccctgggtgggcggtggaattgaaaatctctcgaatcaacatcagaagcaacgtaaacgtgcgagagctgacggcatttgcaggatatcctacgtagattttgatagtttggatattgcagcgtcaaatcaacatcagaagcaacgtaaacatgcgagagctgacgacatttacatgatctgctgcgttggttttatctgatgtatcatgtatggataattggatattgcaatgtcaactagacaacggaaagctatggtaacatgcgagagctgatgggatggcgtttacaagtttatctgattggatattgcaatgtcaaactctataataccccttctggaagcaccagggttgcagaaaaaaaaatcaactctgacctcccgagggatccatctggtcttctctctgtgatgtgtgaacatgtatggaatacaacaccagtagagttgaaaacctctccgagaagagtttaaaatggcattcacattctgtgtacatgatatttcatccgttccaaaatactccatgagcatattctttggaaaaattttgataaatgaaaaaaaaaacttttagtcatttcaatgatcaaaatttgaaaaaaaaaattgagagcatggtacaaacacgaacactcacatacacatgctcaccctcatttctatgaatattttgaattttgagttacttaaattcctgagcatcaggggcggcgccaggaaaattacaaaagtagggctgaatcagtgtatttcaattagacacaatatatgttcaaaatttttatatagaattcaaaggggattttggcccgagcctagggctcataccttaactgccctaggcccggctccgccattgccgagcatctcattggctaaaaacatatagattttcatgcattgaaattagtgtcctagaaatatttatatcatggtataaattttaaatcacataatatttatatagttaaagtggatggactaaatgatgtcctagcattacaacggtggcttctaatggcagtggtctgagatttggtgattgtgataagctgcttgtaaaaaatgttaccgcccctaaccccacggcctagttagggtgaaacgagaagccaagggcccatgagcccatcttctcgcgtctcactaagaaaaaggcccagtacaacatacaccaagcccgtctcatcgctcgcgtgacaaaaaggagaaacgagctgccattccatttccagctgtgactgaccgtgaggcacagacatgcttcccactggtatttccagaggtacttcatagttccttcccagagctaacaccttggatccttattgcaagactatctcaaagcaaagttgtcagatgaaagtagatgatcccgaaacgtcagcgatggatttcagtactttacgaactataatcaccaccagtgtagagaaagaacatcagacaataatccagaacccttcattcaggacaaacaacaattacaaacgttgggtgcactagacaaatgtgcaacgcaatgcatccgatggtagtaaactaactctcaaaatattgggctaaccctaaaaaacaatttgccttccggggtactaaaaaatgcctcttccagcttacaaactgtcctctccaccacaaaccgaaagaaaaggaaagagaagccctacactgcctagatcaaaagtaaggaccacctaaccaaacttgtacagatgctcaatggagatgaagcagcgaaaaatgataaatcattcaccctctccaagctgcagctgctgcagcagcctgttcatactgaatcatgctccgtttgctgtataaatacgaacaaatcaacaaataacttgattatataccatggaggtatctacagaaggattgagttgttgctcctgatcatcatttcttattgttgtggacagaatgtcggaaatgaaaccggtcgctcacaacaaggttttctgcaaactcaaggatgggggccatgatggcttcagcatttggcgcgactgattctggaagactgggtaggcagattggtatatgttcaccattctcctcagggtgaaaatagaatataactgctcggcagaaaataaacctgcaaattaaaagaaggaatatgatttggcacaatgcaataaatatggaacaaaataatgtcttggaatgcaacatggagagttctgattatgtacaggtatggtgctgtaaaaccatccttccactgttcccttttacacctccatagacttgttcacaagcccaccggcggtttgcaggaaatatcgcaatggacaggagctcaagttgtgtactattaactagtcatgttaaataaccactttcatgttttggaagaggtcaagatactatcttcaagcgatgatgcaatgctaaccttccaaccaaatggcagatagtcaaaacattgaatgtggagatatatggaaaaaggtacctgacgatcaggcgcctgagaaaaggatctggtaaaatttgtccccagacgttgttcaatccaacagatgtgcagaggattccttcatattgttccaaagcggagaaaagtatgatttccgcgttagcatatgtatcctgaaaaccaagcagaagagctcaaaatatagaaatcaatattccacaatactcgactcttcaaggaaagtgcatacgctgtctatgtcagaagttatcccagctaattggcagaaggcttgcattggagctgtgaggaagtacgtaaattggcttccattactcgtggattccacaccaggcattgctgatgctatcctaggtgaaagtagcaaggcagctggctctcccttctctgcattatgtatagcctgcaattatggctcatataagaaattcgttctcccatttttttaagaacagggaaaaaaattgttagaaacataatgaaaagagaaaacccttcgtagtattaagttaattatcttttttttctgaaagaatattttgtttaaagtttttaaaatgtacttggaaaaatacagaatcaaatgatggattcacaagctactatggatagccagtgcctagattttagcaatacagtgatctatgaaaatggaaagaaaaatcatatgctctgttgaaaaaaactactgcagcttgctttatattacagtaggttaaatagtaggaacttcaaaacaaatgagaatacaagacccttcatccacaatgaatgtaaataaagccatataggaactacagaacaaaaggcatgggcaatccagggtagtaagtttggctctgaaaaataacaaaatactcatgataatgattttcatctaccaagctaagattaagttctgacaaacctgccttgaatgcatgactattttcactatcgataacaaggaatagtggatatcttgtaaagggaatcagatcttctggataaagattgtttggacctggtaaagatacagtcatgtcagaatagaaaatgcatactgtatcaacctttcaacaagaaactagaccatcagtctagtcggacactaacctagtataccataaaaagtgggcttaattgaactatatcattacactgagatataattccagaaatcaaccctacaagaagacagatgctttacctccacttccacggggaccaagccatagatgattatctgaattgccattggaatttggcttatcgatgggatacacggaagttgcccttgcatatgatgagcttgaggcatacttttgagaagtaatgttctgctcggaaaaacctgaaattttgatcactaaagttagaagggtaagaacctaataactactcaaaacaagaatgttactagatgttttacagagtcagatcaagaagggaacctgatgctgatagatagacaagtaagatgctatcttgagaaagctcctcacagactgtggctagaacctgaaattacgaatttctgatgtaacactacaaaaaaggttcaaatagcaaaagaacaaatcatatggaccatcaaactcgtgaatgaataaaagtacattccaatggattgcaacaattaaccccattgtcaatcagcactgcaacttggcaaagctgaaatattctcacatttttccatttgtgtcatgagaaatggtacagtatactgccaaataagtgggtggttccaccaccaaataaattataatgtgcagcagcagccgatctaactatgacaacatccaggcatgatgaggacttgcacagacttgctaacccaacacaaacgtcaaccagacaattgtattgatataaagctaatgacattgttaaaggggaaaatacgcatccagttcactggatggtgagcataatatatcatttcaagagtaatctcctaaaagaagatccgtgattctatcaagatttgatttccatcttatgtaaaactgagcttcaaagagaacaacatgcataaacaacctaccgctagaagatgagatactgtaggatgatatatgattgccttttgaggatttgcaggaagatttccatcagatatttctgatgataggtggatatcaatcaggccagagggtccactctgatcacttatagtgccattttctgtaagctctttggcagcaatctgataagacccagtgggttcccactccagacactgtagcattctgaaagtgtccagagttagttctgtgaacttcacctgcattacatattacaaaatgtcaagcttgttttcacagtaagataagtgggtcaattattgatggataatatatgtgacctcgtttctgtgatagcttgtcaatacagcttctttcagtttcagtactctttttgaatggaatcgtgcaataggtgcaaggttcgacggaaaagagtcaaacaagttgtcatatctcagtgatctagatcccttgtatgctccatcagctttcaagaatctcccaagctcttgaagcacttgtttccattccttgaagttggttttctaagaagtatgaggtcacaaagttgttatggaagaattaaatggcaaggtgttttaattagaaaggatataaatatgtgattctctattgaaatatataacattgcaagaaaatgggaaatatgtaacaaggcactcatgtcataggctcctaaatgctaagctatcgttttagcataacattcattattcaaccctcaaacaacatatcatttctcaattaagcactgacaaaacaatgtgatatatatgctattgaaaggtaatagagcttgtgaaattgctctagttcatacactttagtacgtagtaactttaaaattatcaaaccaactaaagagaatgattctactttagcagctaaaactgtaaaccatacatgattcgaaatccgttatcctaatgaaatgtacgactcatgcaatgcaatatcccaaatccgaatggtaagacgagcattgaacagtcgtattacttcagttcaccacaaataaagtaagattttaaattttaagttacatactaccagaacgaatttgccattttaaattacatataatcgaattgggaaataaatagaaacccttgattaagcagcagtccaggtcaaaattcccaatcagaattctttatacagaaaaaaaaaagagcactgtacatatcacttctatcaaaatttcaaaaccaagcggcaaaacaaccttcaaatcaacaagttcccactcttcttcactactctaatctagaagttaaaaaggtctccttactccttaggtttcctaaaatacaaaacagcaagcgcacaaacttaactcggggttcccctattcaaagcacgagaggagctaagcttcttacggggtatgccgacttggtctcctcgacgagcgaacggaggcgggaagcgaggtggtccaccgcctcggcccgccgcatcagcatggccacgacgaggaagcgcgcgatgaaccgcagctccttgtaccggatcaggaggccctggtgcctgtagccgccgcccaccaccacctgcgccgcggcggcgaagtacccgcggctgtagatggcctcgtagaacacgtaggcgccgacgagcgagcgcggctcggcggtgcggaggtagcgcgcgtagtagagctgcccgatccgggaggccacctccccgatctcccaccgccgcagcccgcccgcgacgagctcccgccgccgctcctgctgcaggcgccacagccgcgtgtacgccttgaacgccttccggctgtggtggtccaccccgccgccgtagagcggcacgtcgcgcgcgcgcgcgaacttgcggtccgccgcctccgtcagcgccttgaactccctgtacgcgccggaggaggcctcgccgtcggccatcgccggcgacgagaggaggcgcggcgcgcgggggggctattcccctcgccgatttggtcgaatgggagaggggaggtggtggtggtggtggtggtggggaaacgggcgagaaagagaggagagagagtgtgtgtgtgataaaaagggggagtttgttcgagaagagattaaaaaaagtattacgacgagtacggggtgagcagcgcagtgagctcaagctgctgtttgttacagggacgctgtaatttaggtgcctaattgggctcttattagtcaatcatttgcactttgtttaatggcttgtctgcctctactcactgctttggttccacagtgagaaattacccggtatgattttgatttggacactaccaaatctatgtaactatgtttgatttgatttcttaacaaaattttatgttaggcatgtttaattcccaaacagaatttttcgtgttatcacatcgaatgattggacacatgtatggagtattaaatgtagaaaaaaaaataattacacagtttgccaggaaaatgcgagacaaatcttttaagattaattgcgccatgatttgacaatgtggtgctacagtaaacatatgctaatgatagattaattaggcttaataagttcgtctcgtaattttctagcggaatctataatttgttttattattagactatatttaatacttcaaatgtgtgtctatatatccgatgtgacatgcagggtaaaaatttttaacaactaaacgtgaccttataatatgatgaagggaggatagattatactatatttgtgtatgattttgtgataatatttgaggatagaaatgaatgaattaactattgtaaagtttaaaagttgtataaagttttttaataattataatgtttaaccgtttagactggccataataatctataaattataggagaaaaaagtgctaaattttgacgtggttggggcattcaaaggaggattagtaagctgaaacaaattaatcaattggagaacttatgtccgagtacgtaggctgcattctcccccacagcctcgaaagcgatctcaaacgaagaacaagtccacgttaattaaagtgaaaatgaaggtaaccagacatttgaccacccaaccgtgaacgctttcaatgagaacacgacaccgttcagtctcgtcagctcgattcgatagggatatccatttgcggaacacttgacagttgacactgataatcaaaacaaatggcaggagcagccgggctgatgagtgacgacctctactcactgctttgtaaatatgaatatttgtttttttatttagtaaagattaataaaaaaaattcagtcattcaggtgctcatatagatgaatggatagaatacgtgtgtactttaatataggtgaaagtgtgtatgttgtaagcgactgtgttggtattatatttccaaaaagagttaaccatatcgttgtcgtgattcaattttaaattctaagcatttaattggctaaaaatactttgatttcagtgtataaagaaacttatattagagcaagtttaatagtatagccaactactaactccaaatcatatatatctaatataatagcacattcatacaatagttaactatagaaatatattacatcattaatatccggttatacctctcatacacaaataatattttagagtccgtgttgcagctagctataaatatgtaacccgctttcttctctctcttcacttttcttcttgatatgtggttatagctggcttatagccttctattgtacctgctcgtagataccatcagaaaagaaaaacttatgttagataaaaaattaaaattttaaaatgcttatttgaatacaatgagagggattcaccaattgtcctatagtttagccgcaacttgctgcccatgcctagcctagcccccacctccgcttacgccggccggagacggacgcgccgatcgcgacacactggttgaagtggtcgggaaagcttcaggcgatcgcgccatcttcgtacactttgccttgacgttggttgttccatgtcattattccctagctcgcgggcaggtgggcagccgttttcacgcctcgtcattttccggtgaagcagcggtcaattagcactcgctccgctgatgagacgcccgttgcaacctccaactagcacaactggtagtctcctttcctctacctaactgaaatgcaactgccaagaaatcctactagtagtagtagctgtctactgttcatgttgttctccattttgtgtttcagtacaaaaggagcccgagttaattcttgcaagaatttcatactctgctcgggctgagaccgcagtaaccactggagtactcaccagttaacgaaagagggcatctttgctcgattaaagaatggcactttcacttggtatcattctttcacttgccatcattctgctggaggtagaggattcagtgttcagtgcagtggcctctgcctctctggtcggcgcaatcattcggcgcaagtctactcgccccaattctttacagctggagtacgtgcaacctgcatgcaagcattcgccccagcggctcgcttggaacaggttggctccgcgttgccggcctggactgagcaagtgtagcagaagtagtacgtgtaaagagcaattaacaattggtgatgcagtggttagcgattaagtaatctgatcatgggaatcttaatctgaacgggtttgtgctgctggtgttctgataaaaagctgctgttttgcggtgattagttagggcaggattagcttagcttagctgctataggcttttggagctggtcccaagggatgcgaccatttagtagaacacacatcaagacataaaccatgctttcggcatgatttctcccgtaccggagtactcactataggtcacatgaaaaaaagtgaaatggagcggtgattggtactgtgcgctagctagctgcatagatgcacactgtgacacatatgagatagcttttcacttcctaatttcttgacgagctagctatatattgtacgtgcatgtatgtgcaaacccatgaaggagactgtgccctagttaaaagaaagaaagaaagaaccctcagcttagttcatgctactaatagtactaatgctactaatagtattatatgcacgggtctcgactattagatctgtctaacaaacaccttctccacttgtatagtactcccttcgtttcagaaagattttatttttatgtttctgtgttcgacgtttgaccatttatcttatttaaaaaatttataaaaaaatattaacaaatagtcatgtataaagtatttttcatcttctatcatctaataacaataaaaatactaatcataaaaaaaatttaaataagacgaagagattaaaagccaaaaaatagagcctttatgagacgaagagagtagatatttatgcacctcaaataataaatctattcaatgtaccctggcccttggggagagctagtttttgctaaagaaggtgaactaaaccgatctgttagttggaagggacaaacataatactccctccatttttaatagacgacgctgttgattttttctcacatgtttgaccattcgtcttattcaaaaaatttacataattataatttattttgttatgagttgttttatcattcatagtactttaagtgtgatttatatcttatatatttgcataaaatttttaaataagacgaatggtcaaacatgtgagaaaaagtcaacggcgtcatatattaaaaaacagaggtagtagttgaatagggtaatatggtgttctcatgtatcaacactaacctataaacggatgcctgcctaaatcgatgctctttcgataaatgaaaagtacaaatagcacattacattgctagtaagaattgtgttgattcttcaattaatatactctacatccgatccgcgtcatccgctctaatgtataataatttttaaatgccgagatacctagctaaaagttgttatatttgtatagttttatttgaactcctaaaagttgatatattagtacgattttgtttaaactcttgtgttcttgatgaacttaaattgttctcatgcgtaaatatcactcgcctctaattatgctttgcattttggtggggaatagaatatcagttttcaaactagtgcaactatggccctatttggtagggctccaaactctaactcccagctctaaactcctacaccagttggagctagctcctattagcgttggagacccacccaaaagtgtttggtaacctttaactccaaatctgaaaaatatcaaaaaaaaaagaaaaaaaaaggaatccccgctatcgatcggctgtgcgtcgctcgagcatcgtctctgcgcacaccgcccgccgccggccgtgcgccgcccgagcgtcctctccgcgcgctgcctcccttgcaccacctgcccgcccgcgtcggcgtgttgcccgtcgcaggccatgcgccgatcgccgttgtccccgctcgcgccgaccgcccccgtcggagcaccgtcgccgcctgtgcgtcgtccgccgccccgtcgaagcgctgccatcgacgccgccgccgctgccgcctgtgcgtggcccgccaagcaccgctgcccgtgcgctgtcgctgctcgcatcgcccgcgccgccgttcgcccgcccgccgccgccgcaggagcgtcgccatcggcccgccgcctttgcccgcccgtgggagatgaagtttcgggggagagagcggggggaggtgaggaggagagtttgggggtagttcaatggtatatttttaaaaatatgttaaaaaattaaagggtaatatgtcttttgggttggagtggagttgtagagcagtaaaaacttatctccacccctgtagttcattttttaggagtagctccgttaactccaccccaaaaacagagaatctggaccgtttggcacagctctggctctaggtaagttgaagttaggagctagagttgtgccaaacaggccctatacaagcggacaagtggtgttaaacacatgtacgctaaggctgtgctcgttagtctggcttcccaacccacacagcatgcacggaaaacggagcattccattagcacgtgattaattaagtatttgctattttttttcttaaaaatagattaatatgattttttatgcaattttcgtatagaaactttttgtaaaaagcacaccgtttagtagtttgaaagcgtgtgcgtggaaaactagaatagggagttgggaaccaagagttgcgaacagagcctaaggccctgttcagtttgatgccattttcaattttagcattaccaaaattttagcatagttgccaaaattttggcaggatttcttatatagttaccaaaatttgacagcaaactaaatatagccaccttttgtaactttaccaaaatttagtaaggttgaaaatgatatcaaaataaacaggccctaaatgctgttaaccaaaccacctcccaaaag

SEQ ID NO: 40993 - DNA, 3350 bp, Oryza sativa
  unsure (1)..(3350): unsure at all n locations
agggtttgtaaaacccccgataacagcatggttaccgtgcttatcatgggttaagtacggtaaaaggtaaaagaaaaaccgtagtaaccttcttaaattcaaataaatttaaaaaataattaatgataaattttacacggtttcgtgctgttaccgtccttaccgccggggcgcggtaactctagtcccggcggtttgggaaactctggttgtgctctgatcccatcacatcgccatggtgaaatcacaagcttttgttccaagttccgaaagggaacgacgctttcgcggaggcggccggagcaggcggcgccgtggccgtggaaagcgcgaagccaaagcaggtcgacgtcgtcggatcgctgtccgcgaggcgagagtcccggtcagtgaggaagaagccaacggctgctcctcgtggccgccgggcccaccgaacagcgacactgttcaggccgtgggccgttcgttgagtcgtccccttccttgctcagccagacttcctcaaaaagtcctaattaccatcctactgctagtgacatatttatggtccattttggatggcatatgcttacattagagctcagatgagtttaagtagggaagtgagagctagaaattggagaggtaatggagtagtaggattttactacactgcagtgctacagctaatgtgcgcgagaattggcaaaagagactagagaagtacgtagaggtccattttttttacaaaattgcagataagaccctgctttcctgcagaattctttattcccccaggcatagtgttttccaactctctctctcggctgcggttacgccggatttgcttcagttccagtgctccgtgggctcggcccaccacgacgacagcggcgggggctgatcgtcggcgaagaacccgccgcacggctcgtcgtcgtcgaggaaccccgtctcgtcctcctccaccttgaggaaattgccgtggaagaacacctcctcgtggctcgccgccgccgctgcgcccgcgcccgcgcccgcggcgggcggcgcgccgagaaacgtgcacgcctccggagccagcgcgtccgtcgccgcgggcgcggcgccggccgcgtccacgtcgttcagcaccgcgcttgagtcgctgtcggacgacccaaatcccgccgccggtggcccgtcggaggccgccggctcctccttcaccgacgtgaagctcgccgccgcctcctcgtccccgagcttcgccttcagctccttgatctgccacaattcgcgcgaccaagaagccatcagacattatgcgcgcaaacgaacgactgctcgacgcagtcacgcagagcaacagctcaggcggcacggcagggcagcgactcagtcggcacgtacctcggcgaggagggcgtccttgtcgcggcggagcgcgtcgtgatcgaggcgcagggagtcgtaggaatggcggagcgcggcgtagtcgcgctcgagctgcttggtcttccaccgcgcgcggcggttctggaaccagacggcgacctggcgcggctgcaggccgaggtcgcgcgccagccgcgccttccgctcaggctcaagcttgttctccacctcgaagctccgctccagcgcgcgaacctgctccacgctcagccgccgcttcttctccccgccgccgccgcacgccatcatctcctcctccacgtccccctccgcctccatcccaacccctccatatccatcatctaatcaaaacacgcatgtacaattacaaaacactcaatttcccgcacatatcacactacaccatcacctccaaagaatgaattgccacaaaaggaaaaccaaagaacaaagattaccactagaattagccatcgtgacgagcgatgggctgcctccgccgccgccggcaccgccgggtcgcttcatgccgagttctagtaaaattcagtgaacgcctggtcgatctctctctctctctcactgcgagaagacgacgggcacagaagcgtaggaatgacgcgggtgcctccgtcgctgagtcctcgccggtcttaattccacgctgcgatccatggccaaacaccacgtagccaagtccccggtccaaatgctgcctagaattgcaattttgttgcgcggtttctcatgatccaagaaagggaccaggggatgagagtgtggagtgtggagtgactcttcttccctccctacctctctctctctctctctctttctcggtttcctttctgttttcgcaagacggcgcgctgtaccctgtgtgtattaataaaggcgagagagaccaagagagaggagaggagaggagaggggggcgctcgggttaggtagagagggggtggtggtgcggttaggaggtgaccagggttaacgtgacgtgcgtttgcatgctcatgtgcaagacagtacgaagaggcgcggccgtctttgcgttgagtccagtaacaaccgaacgaactaaaggcgcgaagtacgacgacnntgactngtactcccggnccactgaaaaacgactgaatcgacgtctgatctagcgtccaaagtcgaatggatttttcacctttcgtaggcattagcttcactcaccaatggtgggggtgcttcctgcgttggtcatggcctaaagtttatcaactttgctatacgtccaactcatgtgtccgacgcatgtacgactgaaacggcagaaaaaacgagcaatgacagcgtcagatatgactacgcgtcgctgagcctcgttgttgtttgcttgcgtactgtgctttctatacactgaggccagaggctagtccggctgagacatgtatcgatatagcttaggttgctattaaaaggattcactccagatgttagattagtttaggccttcaggatatgaaaccaatatattttcacagccataacatgcaagtcctcttaaaaaaaccataacatgcaagaaaaaatgattgaccagacttgatagaaaaacaaggcaccatggcttcaatttccatatttatgaccaaaatcagttgaaaaatcaaatatggccatgtatatgtttgcaagcatggaaaaacaagagatgttgaaaaacgaattgagataaaagattaatagaattgttcatggggcctagaaaatcagagcctaaaataccttctgttagcttcaacctgaatactctgttgcggttgccgcaaaaaaaaattctgattaatcttaactgattggtatggataggagacgaaggggattagatgagggtttagggtgagaaaggaaatgtagaagatgaaaagtcatggatgtgtatagagtaatatcgagaagaggaatcgacgtcggaatatggagcttcggctgga

SEQ ID NO: 40994 - DNA, 3743 bp, Oryza sativa
cctagagaagagagagagatagaaagagtgtgtgtgtgtgtgtgagagagagagagagagagagagaggagaggagagggaagggaaatgaaggggacgtgccgggccacgccacggaaacgactcggcaaggagccaaagcgcggcacctgctgcccccaaaaggcgtcgtgccgcggtgcatctagctaggccggacgggctaggaaagcgatgcatggtgtggcccaatatattgaacacctttttctagctccacgtccatccatccgggtacgtacgtactactgtgctagatagctcggcgctcggcgatgcctgcacggaccgaacaaccggtccaaaccccacacacgcactgactgcacgcacccaccaccgaatagcgaacggattccttcgctttcttgcgtgtgtgcgtgcctgcatgcatgcacacgcacagcccggctggccggcgatccgcgcaaaagctcacggctttaagtagcctctctctcctctcttcttcctgcccgatcgtcgatcgatgcgatgagttggccttcatttggtcacccggtcacccactatggaactcagggttggcgttacggcgcgataaccgtagttatcacacttacaatgaaggacggtaaaagaaaaatcacggtaacctatttaaatttaagtaaatttaaaaaataatttaaaattttgatcaattttacacggtttcgtatagtttgtcatagttaccacggttaccttgcttaccgccgaggtgcggtaacctggtcctgacggtttgggaaaccctgtagtatggattcatctgttagagttagttcttttttcgtgagtttctttcactgtagatgactgaaactttacacggttcagtgttggggcctgaataaaactctgtcaggtgagtaggaaaagttagcgagaggatgctaaaagctcttttgtcaagggcgaccatactgtcaagttggaggaaaagttccttccctttcacgctttcggacgatagactgtgcagcatcgtgcatgagagtggcgttcggtttccattagcagttaacgcggttggagagagctagtgtagggtagtggagagacatatttggcgtagctaagcttagctaggacacctctcggtctcagttgtcacggtcgttcgtatctctctctctccctctcggttctttttcatggtcatatatgtacaagcgaggattgatcgatcggagcaaaagttatttcactttgggtactgttcggtagcgtcaattcaacaccgcgaaaaggagcgcggaagcattccatatatatgctcgcgttttccttcgtccggcatccatccgtcaggttactcgtgcgtatgtactgcggcacatactactcctacatatacagggtcaacacgagagagcagcgcgtaggtgccccctaccgccctacccagcgaccagcgtgacgccagttgcgttcgaattgagatgcatgcatatcgcggtggtcctgtgtattgaccctatctcaacttcatggagccacaccagaagagagaaaattacggtacatgtaccattcaagccgtggagaaaccacgccccggtcggggcagccagccatcccatgcacgtcggtctcgacgacatcacgctccgcgtagttttccgcgcgggtgggcgcggtggatgcgcgagacccggacgggcgagatatttttcgccggcgtcgcgctcgcagccacgcaccaacgaacacagtaccagcgcgcgcgcgcggctgggttgggtagtaggttggaccggggagcgggtgcgtgcgtggcggcagcaagcgaacgagcgagcgacgtcgcgttccgtggagaaagcgaaggacgggcgggtcgccgacgcggacggacgcaggggcgggaccgcgcggtttggctgctgctgcgcgcgtctgcttttgagttggttatgatcaggtggtccaagagcagaggggggaggggctgggaccatgcggctcggctccgctttcgtctcgaacagtgcgagcgtatcgtacatgtgatgtgcgtggtggtgtgcatgcatcagcagcattcagcgccgacggagagacgtacgtgccggggtcactgatatggctttttccgattaactgtgctgaggtggaataggtttttgtttcgaccccaaagcaagcaatggcgttattttcatttattttgggagctgcggcgcgacatattttctcggcccaacaacggtagtttgcatgagggcctattttgagttgggttggttctaggcccaaaaacattacaaatggagtagggcacgagtaggaactggagttggattggattatggcaaccgtgctcctataatccggcttctcgcctacgaccatcaccggctcaaaccattcggtgtgtcgtgtctgcagtgtccaaatcctgctggatccctcgtagcagctatcgtacagtgtccaaaaccttcgatcgtctcctccatttgtcattgccatccgaccatccctatcacttactttgacatgaatccatggcataccggaaatcgcatacacaagctgcggccgtctcctcagataggcgtgtccccatgttgttctcaggagcaccctttcctcgatgaaacacccgctccttgcactaagaccattcacaccattcgcggtgcaagaccctcctacaaggggtcctatatgccacgtacgtagattgagaccacacctcttcaaatttcttctcccacaatgcatttgagcctagttggaccgccgggggaatcactttggacatgatctgaagtgtacgtactgtagactaactgactaagcaagttcaatcgttgcaaaggaaagacacagaacggttataacagaattctttaaaagaaggcatagctaagaatttcgcattgaggtaatcagattgacctgattttccattactctcttagttccctaatttacatttactatacagctgagctaaccgagcggccgagctgatcattttgaaggaacaaagttattctgttattgaactctcatcgacaggccacaaaagaaacatcccttccgaattcagtgagctccaatggaaaactttggtcaatttacaggcagccgctatcaatagagccccaaaagtttccaccagaaggttccaacaacaccccagatcagaatattgatcaaggctgttacgaaacccatcctgaatacatctggaagctcaagataccccgctgcagatagaaagcaacaaattacagagtagtgagaatatgaatttggaaagactaattatggaaccaaatataaaaggaacaacagcatagaaggaaataacaggttttctcattctatatctatatgccttatctgttatagcatgttgtttttgcttcctctgctctttttttttagggtaacccgtttgtaaatgaaaataatgaaatgaaatccagaaaagtagaacatgaatttacctccaaagtacactgcagcctgtccgctactataatgagttagtgcaccaaacagatttgtgttgaatgccaaagcaagagctgacagcactcgaggaacaccagctgctacatgcatggccagaaatgccgagtataaagctccaacatgtccggtttggcttgcaaatagatagtgaatcaggaagtaggaagcctcaagaacacaaaaggctgcaggccagctcagcgaga

SEQ ID NO: 40995 - DNA, 2319 bp, Oryza sativa
tggtcggagttagcttttcttctttttattttattttattttttaaaaaaaactacaagctgcaagacagttgcagctacagattaaagcaaatggtatcatcaaaagaaaaaacactcattttctatttgttatcaagatcatatgttagttatatgaaaaatcctactaataattaaggaacatttaaaaatctgacagactcttgtaaaaaatggtgaaccatatcagaatcaaaagttgaaatgaaatgtgattaatacaggaatacttgacctggtgtctacagggaaaggaaagctaactggaacaagctgctccctactcaaatatgaatgaaaaatcacacaagtattttaacgatgcaactattaagtatcttgctagcaggaggcaattagctgcattccatggaaagttttagtcaaccaaaaagcaacaaagaaaattatgtcacaaactgcaacattgtattgatatcaaagtcaacattatacgtgggagcacttgtactaaaggaggagcttgcccaaaaactcttcatgggactgcaaggatcactaaggcagcctaaggatgctactattaagtactctactatggtatatcaatataatcaaataaagggaaacatttaaatgctgcaagattggattaatgtgacaacgtaatattaagattgaggatgatgtgtagtggagaagcttacccaaatacccataatgaaactgcaaggagcattgtaccaatcataacccattcattcttagtcactggacccatgcgctcaagcttctctgcagctaatgctggggcatcaggagtatcctttgtttcagggggaaatattttgtatagcaagtatggtgttgctagtagagaagcaatggctggcaaactagcagctttgaaccatgctacccatggatttgcaacgataataccaagctcctctgctagcttcaagcacaacaaattttgtgctgcagcagttaggaagagcgcacttgagttaccagctgcctgttaaaaaataggagaagaaaactagatactctgtaaaaacatttctgaagatgatgcgtatacaatgaataacagaagtataggatgcacagaaacatcatgcatgacacaccacatgacattaaacacggcaatggtactaaacccaagagaattataaccggcattctgcattcttactgtttaatggaaacggtaagaaagcaaaatgcacaaagtcattctgcattcttactgttcgattagagagggactataaaatatcgttgtcttatgaccagatgaatcctctcttttccaaaaccttcacccttctgctagattgatgatgaactcagtcacataatattacgaccattcatgcatcaatggtggcattatgattaaaaaatacatcaaattgtaatttaccctgtaagcaggctaacaaaacactaggttgatctgacaatggcctagctggttgcctgatttcaacccaaaattactaggtaaggatgttctgcttattgcaccaatgtgccacccagttctcactcccactccacttgtgcagagcccaacggcaggacacagtaatagtcaatgcaagtagcaatcgtcccttgctaaaaccaaaatttggttgctatgatcagaaaatcctggttgcaatcgatctatatgaacagatcccatgcgagtatgagaaattttatcacttaattacctggaattgcgacatcacaagataggatccaagcttccgcgacgacgggtggttcggcttgctccctgccgagagcgagagcgacttgatgatgggcaggaacacgcctccggccctcgcggtggtgctgggcatggccggcgagatgaacgcctcgctgatggtgagcccataggacagccccagcgtgctgcccccgagccacttgacgaagtaggtggcgatacggtcgccgagaccggtcttgacgaaccccctcgcgaagaagaaggagatgacgatgagccagatgacctcgttggtgaaggcggagaaggcggcggcgaaggggagcgtgtgggtggcgacggcggcggtgagccccaggaaagcccaggcgccgacggggagcgggcccagcactagccccgcgatggtggagaggaagatggagaggagctgccacgcctgggggctcacctcgggtgggcgcggcgcgaggaaacgcacggcgaggccgaccgcgagggacacgaggagcggggcgagcttcgtgccggcgggggccgggctgtccgcctccgggttgggtgtttgcgaggcga

SEQ ID NO: 40996 - DNA, 9675 bp, Oryza sativa
  unsure (1)..(9675): unsure at all n locations
aaaatatcttaaaatataaaaattttaggtggatatgacacacacaaagtcccaaaatataaggacacatacagcagtcccaaaaatatcccaaaatataaggaattttgacggagatgacacatagagtcccaaaatataagaaattttaggtggatatgacacaaagatttttgggtggatctgatacatcctagtatagagattttgtgtggatagaacacatcctagtacaacaagtctatatgtctcatccacccaaaatcccttatgagatggagggagtaatgtggtaaaccagcaggagtggacccgtttgtcagtgacaagactaatactccgtcaccatattcctcaaaaaaatagacatcatattcaggcctactaacaagaaaaactagtggatgccccgcgcgttgcagcgggatttgagaattcttaccgagaaacattgttgatcaatcttcacgtgtttcctttttttactcattggttgcgtgtttttttttccgacaaaataatgtggagtactccctccatcctaaaaaaaactctaccttaggaggggatgtgaccagggaggatgtgacccctactagtacaacgaatctaaatgaatctagacagttcttagttctttgtccagattcgttgtacttaggttaagtattttttggggacgaaggaagtacttgtacttaggttaagtattttttggggacgaaggaagtacgtgtttatcaagtgggccgctttcgtccactggctgctaagaaagaacgaaaatattttcttctgttacttgctaggccaacagcccactgggcggagaggttcgttccggcttttttttttttttttttttttttttttttttgccacagcaaactgaatacatgcaatgtttgaaggccattcgatcaagatctgactgttaatatgcgttaatgacgtggcgagctgtgggtactaactatataggaagaagagatgccatcttgtatggaatagaatgttcttcgttaacaaaatgagtagataatgcttctacattaaaaccagtagaaatcattttgcaacagcttacactacagacgacatgagaggctttttgagatatacgcgcatcaatcccgtaaaaaccctggggtcccaaaagatgagatcacaaacccttgtgattttcaaaaggttcaaatcccatcagctatatttacaccatactgtggggaaaattatatgctgatgaagcagtgaggcctacacctatgatgagttgatgaccaataagattcttgtgaaaacttgactttgttaaagaagtgggatcaccttcatgcgacagcactccaatcgcgcgtgtcgtggtaaacagttataaggttagtcccttaattcttggttctctgcctcaggagcacttggtaggaggcaagagctcaggtatgtcagtacccggagcatccattgcatcacgaggatacttcgcgggggtgcagcactccgatatgtcaatgccagcaacaaccattgcgttgcgaacccacttcggaacatcgccctttgggaactgtcaccaattggtttgagaaacgaccagccagtaagataatcatcaaggaaatagcaaaacagattgtaattttggttttgtagatggaatgggtagcacatattatcaaggaggcagcttagacatctcagagtcaggaatgacagaatttacttgtggtgctgatagtttatatataatattagggaacaagatatacctgcatcctcaagaatcctcgcacgaatctacaatatggcatggaaactttcttattcaccaacacagtgagaaaactgacaaatgacacaaaatttagctggatgataacatactctgggaatcgtccttccagaattgacatgtggaggtctctacttaactgaaataaaagtggatgatcaagcggtgacacttaaaaagaaaagttatgtggaaatattcattaatatacccgcatcataaatgatagattgtgatacgacagcagttgggaacccatagcatcttttgtgacaagacaatgcaagtaagcacgtgtatagtttttgcagacctgaaaagatagtcaagttatagaacacgaaatagaaacagaaaaagaaaaagaaaatttcgaagcagtttaacactttgttcccagtagaacgaagccttaccatacatggacaggtcggatctatcggtcgttcatcagttgccattgcgttttgtttcaacttcagaacaccctaggagatatcacaataaggttgcaaatgctaagattagaatcaaactcagaggaaaagagaaacaaaattattgtgagcttgcttccatatgttaatactctcatagattatgctaactggaataaattgttcaatatcactaagaccatcaaatcattccatgtaaaatattagtggcactagttatcagtgcgaaaagaagatcaaacataaatattttctctagcttgaattgtatagttgactttgatggatagataagttccatacctcaggaacaagtgcagtcccaaagcgagcagtacgagttggataaacacagtcatacatgtctgcacccaaagcactacatactacaatatcaagtggatagccaacaccctgcaaattagcataacagcaaggtcagccaaacaacccaaggaagctacatggttcaaattgttgtgaatcatagaagacaatatcacttttggctttatgagtactttgagaaatttgaaactataccataacatatcgtggtttatcttcaggcagtccagcagtgcactgggcaacaacacgccagaacgagtctttatcttcaccacctgcaagaccaccaatggcatatctggcaacaaaatatcacggtaagtggtatcagccattgaattgtagatcagatatgagataatatagcgtgcatccaccgacaaataaataaagagtgcatataaagcaggcacaacatctgaagatcatgcatcaatcacagaaaagacaaacaatttgtttttggctgcatgtaaaaaacttgcctacatatttgctacccatggaaagaaatcctgagagaaatattagactatgacataccctggaaggttccgctcaaccaagcccttcacgcagatatctctggaattacaaaaaaaaaaacactattgattatttcaattatgccttaaaggattgatatattacatgattagatggatgaactcacctaagaactggatctaatcctccttgtacaatcccaaataagttctggacatcaggtttcttatgagctatatgtattgacaaaagaaaacaccagaccttagctaaacatgcttagcattattgtaaatgttcttttcttaacgccagtaaaatacatagcagaattagagtcataatcaaaatgatgctaagctctaacttaacgacaaaaatagtgaaattaaacgccagaaaagtatgaaatacgggcagtggcaagtcatattgataaccataccagcaatgcacctatcaatccaacgaagggtacgatacatagcttcctctatccttgggccagtaattgtggtcttcacaacatcatcaagagccattattatatcagctccaatgttgttctgcattcatgttcaatggataagcatacacatgataagatgtaaaactaccaaatctattggcgcaaaactctaacttttacaagtacaaatcttgtctagaaaaggatgcacctgaatatggatagattcctcaggtgtcaagagcatgggcttcccatcaacaggtgactgaagattggtcaagagaaaaaaaatatataaaagatacagagagggaggcattttcagcagttgtaaaattccaaggaagaaagtacaggatgcctcacacacataattaacaaaagaaccaccaagaaaaaaaattggcttctattactaacatcatagatatgatatgataccatgccacaacacttgactatgcaacatctgctagatcaaacggcaatatatatctgttcattcaagaaatatttatatgtttgtcgaanaccatcagctaaccgtgtggttctcattagtctcacaagttcacttaagaatttttggttcatcattgtaataaatagcagtttacagggaaataacaagactacaggggatgcccagtacaatcagaaatattatccttgctcagtatattttccattagttttgaacagtctcaattcagctttaagaagattaaaaaaatcttataaacctccacagtaatacaagcatgcctcctgattattatatgataacacatggacagctggacattgttatcaataaataattataaactgtggcacatttgaataatttgatttggaagtatgataaacatcagtgcacaagaagttgacatctgtaaaagaaagaagcatcacaaagtagcctgcacaaatctacctgaaatgtaactccttcctcagtaatgtcagccaaatgtagcaaagaaacctaaaaagcatgtttccgatcagtaaaatttcagcagggaatatatattaacattggaaaggagtaagcactttggaaacaagtatgtgctcatgttgatagagatcttgaacaattactgtcttctttcaaataaaacagaaatttgattaaatctgctgttaagaaaaaataccagtgatatttaagatattgtcatctcattttttttcctttaaagccagcatcaataggtttctcgtcttttaaaaatcagcattgtattttacatcaagtgatcaaattaagtgcaattcagatttcatgtgtggagcaactggttgttgggatcactataacaaaatggtactcatgggaaaacattatcaaagcaacaagacttgacaattaccagtgatgtatttaaactaatacagcagaaggtatttacatacaatggcaaaacattaaagttgatgacttagttatttatgttataacgatccacatagatattcaatgtcttaaaaaaatgaagatttggagcaaccatttggaaaccaccagagtcagtcagcaacgcccttttccaattcataaatttgtgaaggccacccaagtcgtcaataagttgagaacctggacgaagttcaaggtggtaggtgtttccaagtataatctggcaacctatttcctctaactggtcagtagtcaggccttttattgtacctgagtagagagaacagaaattaaaatgctatgagatacaataattcagagaacaagaaacattttgagaaatttatcatgaacttctgtgaactaaacaacatgaaaactctgcttctttttttttttacacaagaaaaactctgcttcagactgaacaagtgttaaagcaacagacacaataccttgagttccaacaggcataaacagtggtgtctgacaagtaaagtggggtagtgttaatcgagctgcacgagcacgattgaatcttcctaatacctgcaagcaagaataatttttacttcaggtttcgtcattatgctcaatgcctcatataagatctaccgctatgtcagccagccaccttccatcagttggacaataccgacgatgaggctggacagaaagaccatgatgagctgacagagtgacagtgctagaggtactaggccactctaacaggacgtgccacgtggcaattacatatgcccacattcatgcttttctattattttcctattacatggaccactaataggactataggtatattagcttaaccttagtgaagggtaataaacaaagaaaactcaagagatttaatcaaacaaagtacaggattaacaggaatacagtatgtagcaccaactgtagagtgtagagctaggcaatgacaaattacaacactgagaaggcacgtgcctatggcagcattggtcaactaccttctttaactaaatagttactaatccagagtactaaacgcaatcttaaaataaaacagtatcagcttaattgggaatctgtactcccagaagatcgtatgagacaaaaatgattagagtgaaaatcacatgtaatggcttgtcgactaaaactacagacagaagtacaaatcttatccacttaatcaccacaaacttcagccggacgcctagtttgcgtatgcgcaaaccagagaaaccgttgagtttgcttcgcatctcagcaatcaaacgcacaagcaaactagggaaaaatcatctagaatcgaagaaagaacatgcacccatttggaacttcaacaaacctcgaaccgaagcgccatggagaacaaataaaaattaaactccagccaccgagctggaacctgcgcgtccgtattaacaaaatcagctcagagattagctcgaagcaacggaaagaacagccgagacgcgcttcccgtttggcgccaaatacgatattgaacgcgatacggaaggggaatctggcgcgaccaaccaacctgcggtgcggcgctaaggctcgtagaaggggatgaacaaggccgcggggagatgagacgaagaggaggcggctccgaggggagtcaaagcccactctcgccggcggcgggggaggaagccctaacgcggttcttcttcggcgtgactttggtggcggcggccggcggaagcccagcaccgatttaaaaaggggaatgggaattttgcatggaacaccctcatctatgacatatttcattcgatgccttccattttgcatcctcctgcttctgggcaggctaatgaaccatgaggaaataaacatagcaagaaaaaaacatctatgggtaatatatttatattattattgttttaaaaccacaactgaaaaacagaccgatgaaaaaaatccaaagtcaaaatcacatgttggctattgctaataagttaacaagcaccaaattttctcatatggtatgtgtcttgtgtttggttaaatgtcatattctctttattataagcattttaaggttttcaaatcctattcaatcgtgtgaggtgtgaatgggattttttcttataggtgtgggaataatattggaaatttagattgtagaaagcctcctgtcatgtgctaactaagaaatacggagaattggaataattggatcatgactcccgtgtcgcctctctggtgacccgggaggcgaaaggccgacgcccagctccaaccccgccacgccccgtctgcctcaccgccgccggcaacgccaccgtctgcggtggtggccggcgacggcagggccgccctcctccctctcccctctttctccctgtctctttcttcctttctccttcctccctcccttcttctctaggtttgaggcttcccggaggcgtcggccccgggcttggttcctcctcctccacgtctcacgccggcgaccaccaacatctcctgggcaggtggtgagggggacggccagatctgacctcccaaggtccaaatctgacgcgactctggtgtgatccggactttgaggggcctagcgacgactgtgagggctacacgtgggcgagctccgcagtttcccgcgtgtcctagcgtgagagactggctggtggcagcgctgcaagatggggaacggctagatctggccctctaggtccagatctgacgtgtccaagctggggttgggcgaggaccggacctcaatggcggtggtgacgacgggtgggcctgtgtggcgccgatggtccggtggtgccgacgagctctgcagtttagtggtgctccatcagtccggcgaggtggctgagcaggtcatcaatgacgtttgtccggccattgtgcaggtggttgtgtgcatagtacaggtaccccgtgtgcaggtggcatttggtggcttccgacgcagacgctatatttggatgggactctgaggtgaaagccttgctcggcttgccgatgctaccaacgacgactcccttgggtgacgtttacctttttgaaggcgttgctattggagccctcgttcaaactccacatcaagggatttctccgggtgaaaaccttagattcgttaggatcgaacgatgtcgtcgttctgtcggcgtgtccttcttgaaggcttcgttttaggagttttatcccttgctggactgttgttcttagttttaggttcagtatatcaatgctggggttttcgccggttttccataaattaaccatgccgttgtaaggtttttgggtccggttttccttataaactggatcaactctcttcttctatagtaaattgtactaactccctgcttgtccccttagaaaaaaagaattggaatatgatatagaggagaaaataaggctttgtttgacacaactctagatctcaaatggatttgaagtttttatgttaaattgtaattgtttaaaatttaaaattatattaaaaatgatataaaataacttatcaaaatattatcaacgtaatcgtagatataaatttatgaatttatatagagctacggacatccggctctaaaaattcttacatcaggagctatgaaaatagaggaccaaaaaagagtacaagaagtagacttttgaagcccatggtactactatggttgtgtacgtataaaccattgctccccccggaaaaaaaaagcccgtggttggcgcggccgcggagcaacaccacgtcagtggggtggaaattttgccaaaaatacgattcatagggcttgtttagttcacgaaatgaaaatttttggatgtcacattagacgtttaactggatgtcgggaggggtttacggacacgcatgaaaaaactaattttataacttacctggaaaccgcgagacgaatcttttaagcataattaatccgtcattagtacatgtgggttactgtaacacttatagctaatcatggactaattaggctcaaaagattcatctcacgatttttcccctaactgtgcaattagtttttcttttaatctacatttaatgctctatacaggtgtccaaaattttgatgggatgttttttggaactaaacggggccatagtctcaaaaacaaggttgacgttggctaagaaatgaaagttcatgagtaaaagaaaaaacactcacaaaacaaggtgcccattccggtccaagaccaggtacaatagcatactataaaccagttataaacacgtatcgagaagataaaagataaaagagaagagcaatggactatcacatctcatttcatagataacatataccattaaattaagaggtaacatatacaatatgttatatttatcatacaatccccaatatttttaacactctcacatgcttattgaagtttgtgtaagggttacctcttacatgagaggtgattatttctctctcatctttcttctctcccccacctcatcgtgtagtcctacgcagtatcttggagtttgtgcttggataaacatagtatattcccttatagtacggactttaagacacaatgtgtgtatgataggtaagacaaagtattaatagtgtaatatatatttataggtaaatattgtataaattggatattaattgactatggataatttgaaacttgtaatttgctatgtactaaactgcgg

SEQ ID NO: 40997 - DNA, 6270 bp, Oryza sativa
tctccggagcagaagttggcgaggacaccgccattgcctcctacgcatcaatcgacccaacccaaacggacgcctcggccgatcccccgggggacacaggacacacgcccacaggaagagagaagaggggagatgagaggaggaaccgctaggcaggaaggaagagaggagaggttatatatacggaccctgtcgttctacctctcctacacccatcgcctcccgtattttataagctttttcttggtttgaatgaatggggaagaaatgggatgggagaagggaataataatgcaaaaatagagagaaatgccagctttgactgcactgcaccacaccacctctctcactcacactctctctctctctctctctctctctctctctctcttgctcctcttgctttccctttcagagaaagcttcgatccttcaacatcctagctggccaagatgcctgggcaacacctctccgcctcttcttccccacactcacaggcccagcagatataaataaaaaggttcttgtatagggtggtgagctttaaaaggatggagagagaatagtgtttgctgccccactactccagtacacatctctttgtttgcccaaccaaaaaaaaaaatcctcttcttttcctctttcttgcacttctttttccctctttgtatgattcttttacgagtgaatagtacattgggccacattttattatcagagttgtaagttagactaagggtaagttaatagtatcactttggattaggtatttttgcacaagtttcatattggacttgtgtttcctaattctcttttttctttgcttcattggccgatgtctattagcttgtgcgtggtgtaccaatgccactaatattgttccatactcgagagtgatttgatgccatcaatgatgggctgtttgaatttaggaaagatgagagggtggtgtaaggtgaaataaatggctatattatgtggtccaaagtgaaaacattggctaagacctagtccaacccacaacaaggatcaaaatatatggcctaaactgcaatttactcttcttttattctctcctctattttaggttatcgattttaaagggccgagtatcatataagtatacgtcgattcttccaaaggtgagagaatatcagcaaataaaggactatcacatttttttaaggtatacgaaccgtgcaaatgcaaaagctattattatagttattactgtagaaatattaatatttgaatgttaagagaagagtcaatgtcaattataattcactgattattaatctttaactttattatgaacctaaaaaaatattaaatggaaagtctaatgtgggtaaaacgtcatctatctattcattattatattattcgggtgctttgagggagctcctatgttacacataaaattccgacgcagtcggatcgtacttcgtcatatcagtttagattacagtttgtaatttagagaaagataaagtgtattgtgcatactttttccccttccccactttactatacacctgaataaaaacatactagtagtatttagtattttattaatttaaatttaaatttgtgagttgcaaaagttgcagacccttcttaaatgctacaataaagaaaacaacatcgtatttagtatttgattaatcatatatttctataaacttaaggcacactaaattctaaagctcaacatgcaaagatgccacataatccactaataattattacatcttaaacctcatgcaagcatgctaatttattatgttttagagctttaaaattcaaccatgttaattagattatcatcccacataattcacaaaatatttcaatatatatctccatcaattttttttaatatcctatatgactatatagtttatcctcacttacattttagagctttaaaaatccaaacatgttaaatcatcattccacataattctcaaaatatttcaatatatctctccaacattttgtataatatctatatacctatacagttcatcgtcacttaattagtttatattctttctctcttgtatcattaagccatatcacagcagttgtttctaaccccccaaatgattaatatatggtcggaattatctccctcattttcttctctcataaaaccacatcatattacttttacatttggatcaacattctatatattatttaaattatgataaaccacatcaatttaagcgagtttatgtcgtctagctatcttacacattatttttatttattattatcataccaaactcctgcaccaacgagtggggtttcacctagtatatataataattatgatatcaataaaaaagtgtgtgcattgcacgtagtatttattaattctagttttaaaaattattaaatttaggatacctaatattatagagttcacaataataaacactaaagagtgcatgttattttcaatatcatgttctatttaacatggctttttatataactagtgggaatcttatttactgttttatgaaataatgctaacaaaagtcatatctcaccatttttacgccatgagatagaccatagacttaaatgataagaatatcttttaaaaatcactttgtaccggttatgtataaattatccttttgtcaccacgacttattatcactattttgaaattgtgtatgtgccaataaaataagcgtaatacatcattaatacactaaatcaactatttagagaacacactggcctgagatatttgcttagctccagtgtaggaccaaaggttggtaagatacgagcgtgccagtcagtttgaccctgcagctgacaagatatacaaattgaagatcaatgagccgatcggctgacaagccgatggagtaattccagccgatagccgatattagccgatgccgattccagccgatgtcgatagggttgagcaatcagctatatgtagataatgatataaaagcgatcggcttagttgtcatcggctaaatctaacttgtatgtaatccttataagccgatgcaacgtccagataacttatcggctagcaccccaataaaacattagcatgaacctatcggcttagcaagacttatattatcaacaacaatctagtaggtcgaacctaaccgatgcagcacaagattgtatatgataatctaatactcgatgagccgatagatctgtccaatgtaatggatataacaaatctatttagaacaactgtgattgtagagatatatcggctaagacaggagatcagacctaaccgagtcagtcccaactaaaccgattcgtctctaaatacaatgcaattagagatagaattgagatatcagatgggcaaatatatcaaccaaaccagagcgatccaagagattgaagcgatgcagccttgaacaacaccaatgtagccgatagattcaccagggccggcggaacgtaggatttactccttcgccggagatcgaaagccgatgcagccccgcgtcaggtgccaaattccgccgattgataagtaaaaaacctcagggaatagggtggcgatgcgccgagagtagttgtattgatcgagattgatagattacatagaccccgggtgtacatatttacacccatgagttgatacaagtccttgtcggataagaaataaactatcctaaagataaaaggaaaacataaaatccttatcgaacactaaacacacttttctaaagataaaaggaaactaacaaactattcctaattaatagataaactgccatgccgcatccttcttgaactcagactcttttggataaattccctttagttgatccgactccatcgagaacacggttgctggcgatttgacaactcccatcggctgattctataactctgaagccaatagtgactctaagccgatgatgactttgggcttaccaaatttcgtccttaacaaacctataagcatttgttggagtgccaaatgtcaaattagtaccgtttatagtaagtttaatggattttagtatgcaatagaagatgtataatcatgataatttgatctataaccaacgggtagatcgtttcaaaccaatgcaagagctcccttaattaggttatattcgggagtgagggttgggaaccctcactctccggtacgcaaaacgaagcagcatttatcacgtgattaatcaagtttcagctattttttttcaaaaatagatcaatataattttttaaagtaactttcgtatataaactttttgcaaaaaacgcaccgtttagcaatttgaaaagcgtacgcgcaaaaaacaaggaggaggagttgggaactactcctaacgaacgcagccttagagcaagtttaattgtacagcccactactagctccaattcatctatagccaatctaatagttaattcatacaatagttgcttactatactattaatatatggtcccacctgtcatacacacattgtgtcttggagtctgtgctgcagctggctatagatatgtatcccgctgctcttctctctcatcttttatctcattaaaatatgtttatagctgactaatagtctgctattgtactgctcttagagtgcttaaccagtataggtcatagactcctagttgcacactcgtgatttgcacatattattattaatataatataaaataaagttttattcgtatgctgatttttaattaatgtcagagtcatatatagtatagttttttccttaatttaattgagaaattatgaattatactaagtattgatttatactcgttttgtattctcaattatagctttttttcgtaatatggaaatggacaatccgaattaatgtttgcttttgtgttggggtcttattttatttattaatgttgcttttttgaattttagaattaataaatactaagttctacttacttatgtagtattatattaatactaagttctacttacttatgtagtattatattatctcatgccattatataaatgattttttctaattaatgtaggactgtaagagttaccttagagtgcaaaatagtagtttatagggagggaaatctccagagaaaatcattaaataagtaaaaactcgtgaaaaccatatctaaatgtgttgtaaatttatgaaaaaataactagagatatgtgtgtaggcctgaaatacatttataccaaatcttaagttcaaactcaaaaaactttatttgagagaaaaaatgacaatttttaggtgaatggtgtttttcttactattcactcgaaaattgttttctttgctccataataaagttcagtttgaaattcagatttggtgataatgtatttcatgcctacatatatctaattttttcatgattttacaaaactttcatatctggtttcactactcactagatatgtctccttataagtgttggtagatacataagtagatatcggctctcgtcattgtttgttgatttatcaactgcaaccaattttgaaattaaaaattggagttaacatttgcttttaaatatttagcagtatggatataaaagttgtacatataattttatttttttattcatgtttctacagtctattaactgtagctagctcagccagatacaactattattctcggtaacatactaagggggtgagggggtgtttagatggggctaaaactttttagcctatgtcacatcagatgtttggacgctaatttggagtattaaacatagactaataaaaaaactaatttcataaataagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacatccgatgtgacatggacttggaataagtccctggaaaccaaacaggccccaacatatagtagtaataaagaagcgaagaattttccaaatctacgtgaatagcagggaggagttcgattataggtttagccctatttcggtcacaatacctgcagatataaatagcacccgaaacatgccaataagagcaaacttgctgatactaacgtctttgcaggaacacgaacgcaccgctctcataaaaaccactccgtgcgtattgcatccgcgtaaatggccattgc

SEQ ID NO: 40998 - DNA, 3606 bp, Oryza sativa
acaactctagtacattttgtgagaaagctccacccaactccactcccagttttggtggagctgaaactgtttggctgagctccagctctaggaggggtggagctggagctggagctgtcccaaacagacccttagtaccactgtagccggcgtcaacaaagcaatgcgatggttagggctttggggagttaattactgctacgcgctacaccaccgtagggcgattatgttcgtgcgtggcctgactgcgcgcgtagtagtactacgtggagtgcggcagaagcaactgctgtacccgagtgtatagctgctgctagtagtcgcgacaccaacaacttgaggcgcttttcctttgcaacccctaccggctttacccatcgcaattgaatgcgtcacatgccgaggaaatgtcagcgtcgctctcctctcctctactacggaggagtatacccccactgctttatatcctccgtattggtagcagttacgtactacgtacgtacatacactgatatactattacgtggtagatcgaatattccaatgtgtatacggacgcatgcagaccataatatacctactcgtacgtaagaacgagcgtgagcgctactactgtttgttgcgttgatggtgcatttggtgcttcacgctgtatgggcaggagagaaaatatgggtgcgtgtctgatgatgattggtgagcagggagggatctcccattatttgagcaggagttgggcgtgagcatctctcgctaatcatgtgtgcatgttcgagcagattaggccatcaatctgtccatgtgttcttccgtggggtaggagtagtaacttgttcggaaagcatgctgggctgatttcagaatttggataggtggcgtgcaatagttttgccgaatgcagcaacagcagaagaaaaataatttcctcggaaactcactaatagaaaaggtatttttcccaacgtgagagtcttattttcgcaggcggacataacccttagaactaaatgaccgcctacaaacatataaatcgaggtgaaatttgatgtccgcctgcgaaaatctattttcgcaggcggaccacttaagcggcgcctgcgaaaatcaatagacttgaatataaatagacttaggataggaggagattttttctaagtctccgcaccttcaccactcacggccggcaagcttatcccctcacctctctcattcacctctcctccccctcccctcccggcggcggcggccagcgacgggcggtggcggcggagggcggcggcggcgcgctcccggcccctacctcccagatctggccggagggggcggggggagagcggtggccggcggatctggccggaggggggcaaggggagcacggcggcgggcagtggcggcgaggagggttgaggcggcggcacggccacggcggcgagggcggttgaggcggcggcgcggacgacagcgggcggcggctcctgaccgcccctccttcccagatccgcgttgacgacggtgggccgcggccgtgctgcggcggcggtggcggctcccggccgccccccccctcctagatccgcgttgacgacgacaggccgtggccgtgcggcggcagcgcggatgactgcgcggcgcggacgtgcagcggcggcggacaaaggctgggcagcggccgtgatttgttgaatgtttttatttgctttcttttagaattgattcggtgattttggatgaactgtggatgaattgatttggtgtttttttggatgaactagatgaattgaatggattggatggggaaggggtgggaactggattgagaacgggaagctaccgccggaaatgggggtggctgcccaattttttttagcgctcgaagctattctcgcaggcggacctggcgcacgcctgcgaaaatcaactattttcgcagacgttgaggtgcaggcggatggcttgtccgcctgcgaaaatatgattcggcctactgggaaaagagtttttctagtagtgacttctgtactcctgttagttttgagaaacatatacgcatcctccattcacagaaaattgctgccattttttgtgcacgtaccactacgaatatggattgcattttgaaaactgtggtaacaaaggtaattgtacgcgatgtattttcaaatagtagagacgatcagagatctttcacgagccatatcccaattccgacctagtagtactcctaacagcaaaacaaccaaagttttggtcaatgtgagtatatatacatttcacagactgcagtctctcgtcgtgcgaacgaccaatccgcgctgcgcccacggctcgccaccagcaaaggcagcaacaattctccgcggtttcagtaacaaaaaagctccagatggccctggcggcctggcacgacgtggcgtgcgattctagcgaggaggcgtgcgattgggtagcgcagccgcgcaggagtacgtgctaccgcatggtggtgaagtactaggctcctataggcaggcgtatataggtgggctcggctcggcgattcgaggccgggagaaggtagcgcacgtcgtggcgctgggcgtgtgtccccgtggccagcagcatgggcgcgaccggcgggatgcgccgcgccagcaatcccggcgcctgtctgcatgcccctcccagtcccaaccctgccactccacctccggatagatggacagaatcaacgacgatatcgttgtggcgcaccatgcctccgcgctgcgcctctcgttgcaccacaccactggttgagttttcttttccaattctgtgatcagcctgcaggccgtggccgtgtgggtgttctggattccgggggagcgaagtcaaccggggcgtgatcctgcgaaatccagctgcgcgcactgcgtttcgtgtggatacccgcgtgtgcctgactgcctggtggagctcgtgccgaccagcttgattttcattacgaaaacactcctgatcggtgtacacagatagcctggtgaagaaaaaggaaaagtgagttggaatacgctgcgtgccaaccagccacatcggatcctcagatgcttctggctgtggggccctttgggagtatgcctgtctacgtgctgccacggtgtccgagaagttgaatacagctgtcgccctaagagtggatgtgtccctatatgaagtgctttattcacaggtaagcctatgttattgacaggtaagcctagtggcattcgtttcgactttggactggaataggcactgaacaaaattggtccttggtccacgtggacaagttaagttgggcccacgacaaaagacatggctgagcgggcccagggttagctttcaaggccgtatcttggaggctcagggcagtccgttgaaagaaaattgttgggtgtcacatcagatatttgaccggatgtctgaatgaatttttggacacgaatgaaaaaactaatttcataactcgcctggaaactgcgagacgaatcttttgagcctaattaatccgtcattagtacatgtggattactataaaacttatggctaatcgtagactaattaggctcaaaagattcgtctcgcgattttccctataactgtgcaatt

SEQ ID NO: 40999 - DNA, 1201 bp, Oryza sativa
tttctgtgttcagctcactgtctgagaaactgctctcagagtcatcttcatcctcttctgttgaagctccaatttttgagagaaaactgagggcattgcgagcgcacgtctctgaggccgcaatcccttagatttgggggattttttccttttgcttgaacgatcattcctagacttcctgcttttatgtggccttgacacttgaggcacatcacgctcgtcaaaatttcttttcttaactcgacgaccagatgaagtaaccacacccccctgtcgaagatacaatgaaaaggtaaacaagtcaaaaatcagaaggtggcataaaagaggaaggaatgatcacgattgttgcctcttacatctgattttttcttttttcttctcgatctgcggagagcgctatcagtaaggttatccccatcaatttctccacttgagtacgaagcaccagatgaatcaccattcaaagcctcatgttccccttcactagaatgctcatccaggccatcgtactcagaatcagtatcatctgaaataacctcattttctggttcaagctcaatgaagtctgttatctctggaagtggttcccacctatctggatcaataactgggatgatttgatattcaccagtggttgcattgtaagtgggaccgacagcaaaattcacggagggaggtcgccactcaatacccagggtacctaaccgtcgtttctggtacatactctggaagggctctggatagggtatcatacctgcaatcaacaaatcataagtacaagtatacaagtggctagaagcctctacttatactaggctagaaggatggcatacaatgtacataccagagtcacacagaaggtcttgcatatttctcctataaggtgcaagctgtgtttcctggattaatgaaggaaaaagcataaagaaaaccaacataggtcatgatgcactttgtgaaccaataaaaggcagcttgacacaggttaagaataaccagagttcagtagcttctggagttgtttgtttagtaatgtttcgatatttccttagccttgcaaaagttcactagattgaaccctttgtggggttactattgaatagatttttttttaatgcactacatctactatgaaaagaaacattaattaactacatgacaataatgttgtggataccatgtttactcaaagagagaa

SEQ ID NO: 41000 - DNA, 3207 bp, Oryza sativa
tcctgcagcccgaacaaaataacatactcaaactaatgccaaagagaaaaactcaatccccacggctaatccaatggttcatctcatcacaaggacggggcagtttacatgattgcacccaaacattggtttacaccaggtattccctacaataactcgaaagttgggtaacaatatttgtacctgatcatatttcgcatccttctgcgactctccctgccctgtaccaataatgaatatttgtccaatttcatcggagagaatcagtgatgtcccatccctgaatggtccagcataatattaagaacataaaaaaataaataatttagattaatcaacaatacaagtaattgatcaaagttctcttttccattttaaatggtcctgatgtttctaagttaatatatcacatactagcataataaataactaaattcaacagctctagtaagtctagtggagtattaatattgacagggtgatagtcgccttaatcttttttaaaaaaaaaacgttggagtgcagaacatctagaaggaaaaataataccaatataatgtttatattctctttgagttgtgtccaaaatgagtataagctactccttccatcctaaactatagcagcatctagcattcaaaatcccaaaatattgcaacttctccacctacattctcttttcaaccaatcacaacctgctcccatttaattcctccacctactttctcttctcaaaccaatcacaaccttctcccatttaattctacctatttccttaataaacatgtccaacctcaaaagttcttatattttggaagagataaatgtccagataacataggtacatcgtcaaaccaatagtctatgtatcaaactaaccaggcatttaaaaacaaatgtttacaagtgcaaataattgactgatccaaactaattgttctgcccattatggcattatcagttaattttaagtcggagataccaaatcatctttacagttataatcaggatctgcgctagattatgaaacatgccctttctcaagatctaaaacagcaaaaccacaagactaaatggaacagtaagaaatttaggatcaatactagttatatttagaaagaaaaagggaatgaacaaccccaattgcatataataacaccttagcccaagtttactgtacaggtttaccagccaagtggtgggtttagttccacatggatagccccatttcatactttagttagagttgcacataaaccttgaagaaccaatcgcaccaaccaggttaaccattttaggcaaagcagggacagaagatgaacatgtcgcaatgtcagtatagtgctacagatggatgtaccttgggttacaagtgagcacttcagtggaagataattttgacttttaaccagatcaaaaaagatgaatacgatggctaaagtatcacagtattcaacaaagagatttgaggaacacaatgagattgaacaacaaaatcaacaaaaatatttctacgcaaactcaagattcctaaatagtgagatgaatagatgacagtgctacttaatagatttgagaaaaataaaaggatgatgctgtgaagaaattctacagtgacacttacggtgagaacttcccatcaactaacttgaaatgcccagtttcatatatctgtacaggcttcccttcccaaatctggatagagaaaaacagatgttcagcctggaagattgtgataagaatagaaaaaatctggcaagaaacttacatcccatatgattgtctttccatcatacccagcactcatagctatacgggggttgaatggatgcacatcaagaacaaatgtctgttgagaatgagggtggtcaaatttcataagagaacataactctaggcaagggtcacagcttttgtgaaaaattgaagttgaaagaaaaaaaacacaaataaaaatgaaacagaatgcagatcatggcattgcaacagaacagaactgcaacaaaacagagcagacagatcactgattcattcaaacagtttaatacatagattcactcatggaattcatgcaaattttagtgggaccacaccagaaatcttgtttccattcaaagagagctcattacccagaaaaataaaataaaaaggataagtgacaacacaggtccaacaagcttcaatcatggcaagagaaaaatggttatatatgtgagaatacaacagattaaactgaactgtagctgctgggtaaaaatactgccaataatcgaacgatgaaatggctatgaaataaattgggttaaaaataactcgaaacacgctaaggtaaaagatgatattaccaacgcttaatactaaactgctcaatggaatttgcaacatgaagcaacactcagtgatttcattattcaagaactatgagaaaaatgattaagtattgaatcgcagagaaacaagaattggcaggttgcattctcatactgtcctgttcttaaaaaaaaaaatctttgtaaaagatttacatctccaaagctaccatatccatgtttcttgtttcagtaatgttttgtatgcctttcagtccatgctcttgccaggatgctagcacacttacaaaaaaagtatgaatagttacaattgtactccacgaacatgtgaatagcatgctaagttgctaactcaaagagttacaattataagtgatgaaaataacatgaatgaaagctctatgactgttaatttgcaataatgtcaataatttaaaaaacataatgcatgtcatatgcttactgattctttatgcccaatcaatgaatgtaccaagctcccatcagaagcattccaaacacaaattctgcaatctgcgggacataatacatatttaagggaaatgaatacagatgataacaaaaatagaaaaggagactatgcaaaaaaatggaaagaacagtttatcctaagtctttagatggatgccccaaactgcaaaacatggagtgaggcaaccatggaggcttctacatgctaggtactctaaaccaattatcaatttcatcatatcggtccctgaggttaacaactttgagctaataataaaaataataaagagaattatgctactaagcgtctctctatttttcaaatgagcaatagctactgcaatcacaaaagcataataacctctaagtttagggctgcaggaat

SEQ ID NO: 41001 - DNA, 2154 bp, Oryza sativa
aacaccagcatagtttcattaaatcaataattgaataaattttcataatatattagtcttgggttaaaattactacttttttctacaaaattagtcaaacttagagtagtttgactttgaccaaagtcaaaacgtcttataacctgaaacggagggagtagtaaacaacttacagatatatctctgcagtttccttttagtgtgtacataagtagtttggtgtctcagacaagcttcaggtttggctaaggctacattcgtttctctggcttgggaactcattccctccgcacggaaaacggagcggtccattagcacgtgattaattaagtattagctaattttttttcaaaaatggatcaatatgattttttaagcaattttcatatagaaacttttttgcaaaaaaaaagtaaagtttagcagtttgaaaagcgtgcacgtggaatacgagggagaggggttgggaacaaagagcaacgaacacagcctaaagcagattgaacaccgaattgtataccatagactgatgacaagtttatcctttcagtttatgcttttatgaaaatactatagaataaagtattcagaaagatacgagcactcacgacaacagctggaaagcagcaccgggccttggactaaatgcaatggcggttacaacccctgtatgccccttcagcactgagataggcaggccatcaggtatacgccactacattagtgagtagtaaacagagtcattaacaggaaaggaagaaagatattatcacagttattgagaaagcatacaatgaacttacaactctaataatgaaatcattggatgaagatgctaccacagcattattggaactcactgcgaggtcagtaatatcacccttaattcgaaaaaaaagggcagtaagttttctgatgaaaggttgtaaatgttattatgttacaataagcaaaacttacttcatgacctcggcagctagccagacaaaatgctgtttccattgcccaaattttaacaaggcgatcatcagaaccagtaataacataacgtcccgttcgatcaaaagtagctgcagaaacagaaacaatctcagtctgaaaaaacaatagagcagataaaagagagaaaatgtaaaaaacaacaaggtatgatggtctagaacaaattaacaaaaggacaaggcagtagctacatttgttgaagatatagggataagtcctttagtaatgttgcataatttagcaaattgtaaagttaatatcagtaaccattttgctgaatagaccgtggcagtatggcgcatatggtcactgtagatactcaaaacaacaaccatggaatgatgtatccacggaaaaatattcaaataacttattcaagcattatgtgttaagaaaaaagaaagaccaacagaccacaatacacagcattttgatgtccccttaatctctttataatctgcatcttttcaacaagggtcgatggcttcgcaatggcatagcatgacgcgcgtacagacggagctcggcgatgtttagtgaaaccgccaatctctctcagacttaaaccgcgaacttgatcggcttgtatgtgtggccaacggagataacgcaacagcttgggattttccttttcttgcctgcttgtatcagctgaaggatccaagatttctcataagcagttcagcacatagcaattataacagcgaaaatgtacataacataaatcaaactagcgaaactaggaacacaaggttgggtagaaatgaaattataaacagctcatcgggactagaagaacatagtgtacatacatgcaagaagggagaaggaacttgatccaagaagcgttgggacatcagcagcatttggagaaacccctccaaccaagccatgtgggtggcaagaactaaaaatcagctgctttaaaagctttaccaagtggtctttaccaatgtgggggtatctacaaaatgagcagcataaacaaaagtatgtgaaatgctcagtgtcatgtgatcattgagaaaataaagcagataataactggtctgccacggcaagggacagttgtatgtgtttgttcatctgttatgctcaaattatatcctaacacattaacaaactagcagcagtttaagaaacataaagctt

SEQ ID NO: 41002 - DNA, 952 bp, Oryza sativa
  unsure (1)..(952): unsure at all n locations
tgacgtttcagaaatagtatgattcatcagctctagaatctagactagcacaccagggaagagtgatgaagtatgaactccacaggataagacaaatggatacaataccagatatttttcaattgttcccaattttactctaagaaactgagaagcatctccagttcactacaggcataatattatttttatgtgctccgagcagaatgaacctctagtttcttgcgtcataaaaatccttaattaacaataattaatataatagcacaaaactggtctggaaattttcactttgaattccagacctcaacatcctgatgatctttcagaaccaacattggaatgaacggataaatagttacctctcaactaactttaggtatcccaaagggagtgatatgccatcatcattttcttcaccgctatgaaaaccacctcgtgaataccaagcatgatatcttctaggtagcagctgatgttcaaggagctcattgcagagttctccaacagtccgcttaaatggaccatgtgataaaaaatgcatgatgagaaagtaaacttccctcatatcaacatcaacatcagcctcaggtggaacatctgttgctaccactggattgacagaattaaccttctcaagttcctgacttggaaaatccaggggcaccatactaatggaggccgcattaccagaaggttggtgttttctaagagccatgtatacagcaccaactgaagtgggaaataataacaaataagcatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcaggaat

SEQ ID NO: 41003 - DNA, 2191 bp, Oryza sativa
attcttctattgattgatgcatttgttgctgatatgtgcgtggatgaatcttgtgttcatcaataaaagtgaaaattttgatttctaatggtaaatcgtcctttgctagaaaccaccactatttatttcaccaaaccactctgtttgtactcctatttcactaccttttaagataatatttgtaagtcctataaaactgcatgttatataagtcctcaaaaaccatattcgtacatatcttgaaaattatgttataatagaagttggtggtggaaattgtatttttagaccatgatgatgtccaaaacatatattttgtgcatagagagtttctttttatggtgacaagtctgataatgagcattaaccatagatttagcttttcttttacatatgcttgcctttagttttttttattcatatatgctcataaaatcatagggtggatgactagtattctctccatcccaaaatatagctacttaaacattaaaattttgttaaaatatatagtagtactttctccacctacccctcatctcaactaatcacaaacatctcttatttacaccccgtacttcctaatctcaaccaatcaaaaccatcccccatttaatttcacttattcgaatgtagccatattttgggatagagggagtacttgtttatttgaatagttttggttgcattatatgttagtccaatgactgattttggttgcattatattggcattttatgtatatatggtctatttagcaaattttcccatcatcttaggagttctttttctctacacacctaggtttcctgtccagttttccattgaggtgattaggataaggcttgagaacaattactacagaactctggaagctattcgacatgatgcgactgtgatgcttgcaaatgcccagtcttatttctcaaagagcactgatatgaccaaaaaaattcggaggctatctgattggatcgaacaaaccttttcatcattgtagagtggtgcttgatggttagtgcccagttaacaggcttctttttgtgcaagcagaatttgcctcgcagccacagtatgattctacaggtgttactgcggaaaattttgttagaggaatactaaagtagttttcaagatgctcaacagcttaacactatttaatgcattgttttgcttgcacaagttgatcttaactaacgcttctgatcattagatcttcgtgaagaaaaatcaattaccgattcgacaaaaggaacatcaagggccttgttagagataaagctggtagtgtaaaatgcactaccgtgttattcgttgtgtatagaccccgtaaatcatcaataaaaatgataaaatgtttatcgtctttattatgcactccaatttcaggtgttacattggatgatattcttcgtcgctttatacaaaatctcgtttctcccacgggagaatagcggagggaacagtcttttgcgcacaaaaacaaatccgggtttcaagaaagctgttttttttaaccgctcatccacgagtctcgattctgttgggtcaaacaaacaatcgaaaaaactggaaaccaaacttgcatctacagttaaaagcgattatccctttatcagtgttacctttcagatagccgaaatactatggcacttacaaagcgatgattgtacaggagtaatatttggatcagaactaatctggaattgagcactcacgagcgtcaaccccaaaaaacagaaacaccgaggacaaaaactccaggaaaacatggtcaaccgtgagaaacgaggaaatttcctgagagacaggggtagtcatcgtctacgtgggccttgcggctctgaacgtggggtgcagcaaccggccgagctcctcgtcgccggcgtctagcggctcgccggtctcgttcctgacgcgccgcacggccgtggtattcagcgactcgtgcgcgaacccgtacagcttcagtatttggtcgtccgcgaagttgaacgcgcgctccatgccgcgccggcaccgctccgccgggtagctgtcggcgtacctccggcacggcttgcacccgacgaagtgcgtgacgaacggtcaccggccgtcgtcgcgccccgcccgccgcagctcctcgtacttgtccacgatgccctcccagaacccgttgaggtcgtaggagctctcgatgaacaccttg

SEQ ID NO: 41004 - DNA, 1934 bp, Oryza sativa
ccgcgtaccgctcccatgggatctcgaacagcatgtcggtgaacaccgcgtcggagtccacccaccagatcagctccgcctccgggtgcgccaccatcagcatccgcagcagcggcagcttcgcccagaacccgacatctccgcgtccaggaacgccgtgttgtagaacacgtcgaggccgtgaatgcggcagtagtccaccttgttcttgaacgcgcgcagaagcaggtggtcgccgtccgggtcggggcaccgcgccggcgccgacccggtcaccaccagcacgcgcggccgccccgcgggcgccacgcgcgccgggaactccgggtgcgccgccagccacgccgaacgccgcgcgtcgtagcccaggatggtgcgccccagcgagtagggcgggtccgtcagctgccgcggcggcgggaggccactatcctcctcgctgctcgcgttggcgccggcttgcatctgcgccggcggcggaggcggaggcggagccgccaccgcgacgtggacgggttcgttgaacacgacgcggatccgcggcacggtgaagctggaggagccggtcgggccgaggatgaggaacagcgcggcgacgatgaggatcacgacgacgacgagaggggcggcgtcgctcgccgaacagcgttggccgtgctgccggcggccggctcgccggtcagacgtcaccttgccaccgtgcttctccatcatcgcgcgcgatggctagctagctgggtgacacaaaggccgacgtgccgtccggccggcgagcgatcgagcgtgagctgcaacgttccaccttgcaagttgcaagttgccggtcgcatcgcaagtggttgtatatatattagtactagtagtaggcaaaatttgctggctaagtagcagtcgtgagcgcacgacgaacggtgcaaacgaacgtgtcatcgctgcatctcagccgtcgatcttgtggcagccgtcaacccaagagaggaatcctgcggtgcaggcatgtatgggttaaaaatacaccattgggatcgtgtcgaccgatcgagtgatcacgatcgtggcaggcagtgatagggttaaaatactgagcaggtaatttctggaagatttgggttccaaatctcgatggcgatgcaaattaggttaagaggctttaattgcccatgtgcattttctcaaaatttgtgtagggttattccttcttcccaggttgcacacttcatctgaggtcacttaaatttacaccgaatccgattttcgtccttaaaccctaaaaccaaatataaccagtccctaaactattaaaacaggtacaaacgagattcctcggtgatttgaaaaacggttttggctgacgtggcgtttacgtggttggtttgactagaactttgtctcacgtgatattgatatagcgtttacgtggcaattctactccaaaaaataataaaaaccatgggcccacatgtcagttaaaaaaagaatttaaaaaagatggggccacatggaccccacatgtcagcctcactccttccctctcccttctctcttcttcctcatcctcactcctctcttcttccatctcctctctctctccttccaggggagcggatgggcaggtgggtgacggagcaggcgagccgcgcacgagctgctccttcgacggcagcggccgcgcgtcacgggcgactgcgccagcgcgctgtgtcctgctccgtctccggcgagccgcccaccagctcattcaacacatgcaagtactagcagagcacaaaccatagctaactaactagctaatttgccgatccatgcaagccactaacatgaacatatcacattggtagcaccagcatgtctaacacatgacgtgatccaaaaactaaacaagcactaaaggatcctatgcaataagattagtgataacatgcccgggctgcagg

SEQ ID NO: 41005 - DNA, 4727 bp, Oryza sativa
tgctcctcgccccgtgcaccatcttattattcacgtcgggagacgtgccgctcccccgcatccgcatcgagtacgctcgccgtgacgctccgacgatcaccgcggtggcagcggacacgtcgccgccaccaccttcaccaccgtcgtcgtcgccgccaccgttgtcgtttccgcctccaccgcctccgccatcatcaccacctccgccagctctgcctgtggtcgatgatcacagcgacacgcaacggtcgctccggcggctgcggcagctgacggacagcccgtacacgctcggcccggccgtgacgggctacgacgcgcgcagagcggagtggctgcgcgatcacacggagttcccggcgtcggtggggcggggccggccgcgggtgctgatggtgaccgggtcggcgccgcggcggtgcaaggatcccgagggcgaccacctgctcctccgcgcgctcaagaacaaggtggactactgccgcgtccacggcttcgacatcttctacagcaacacggtgctcgacgccgagatgtccgggttctggacgaagctgccgctgctgcgcgcgctgatgctggcgcacccggagacggagctgctctggtgggtggactccgacgtggtgttcaccgacatgctgttcgagccgccgtggggcaggtacaggcgccacaacctcgtcatccacggatgggacggcgccgtgtacggcgccaagacgtggctcggcctcaacgccggcagcttcatcatccgcaactgccagtggtcgctcgacctgctcgacgcctgggcgcccatggggccgccgggccccgtccgcgacatgtacggcaagatcttcgccgagacgctcaccaaccggccgccgtacgaggccgacgaccagtcggcgctcgtcttcctcctcgtgacgcagcgccaccggtggggcgccaaggtgttcctcgagaactcgtacaacctgcacggcttctgggcggacatcgtcgacaggtacgaggagatgcggcggcagtggcgccacccggggctcggcgacgaccggtggccgctgatcacgcacttcgtcggctgcaagccgtgcggcggggacgacgcgagctacgacggggagcgctgccggcgaggcatggaccgggccttcaacttcgccgacgaccagatactggagctgtacgggttcgcgcacgagtcgctcgacaccatggccgtgcgccgcgtcaggaacgacaccggccggccgctggacgccgacaaccaggagctcggccgcctactgcacccaacattcaaagcccgcaaaaagaagacatccagagcagccaggcccatgtaatgacgaagatcatatcgaaaaccgtgtaattatggagatatgatactttgattaggttgtattttcgtttggagatatttcttgaatattgatgtatgaacgaggaccggagatatttaatgtgttgtttttacacccaaaaaaattctcactttatgtacgagctaattccggttacttgacttattaaaaaaaattgcgagcaatgttttgttggggaaacgtcattcctgattgttgttactattggcaaagcatcgaaattattctgcatctatgcaaggaaaagattgcaccatagttgattcatgccagtggaatacaaaaagaaacaatttatgtatgacagctggattgagtagaaactagaaacgactatatttaggagactactattgccattcacaaatagcaccagcaccagtaatacaaaaaggaactatgggctaacaatgaaacaaaagttcattatatttccatttttctaactagaaagctaatataagctcgttctagctctgatatttgcacttgaaaaattgttgcacaccttggtctttcaccatttgagatgtcatatttgtcagtattggaaagaatgaagctgccctcttaccatctcttggactgtatctcagtggatcgaatgattgatcattgaggctgaggctaaatttaagcatggtttgtcttcagggacttcaggcacaggcacttcaatcagcttcatccagtgacgttgacaaaaagttcaagatgaaatcatctaggtccccattgaggactgaatcagggtcggatacttcgtagtttgtccggagatctttgaccatacgatatggctgcataaaggcaaaacatcagctatatgtcagaagtaattctaaaaatatcctggcaaaaatacatcacgaacttatgttgtttacattcaaagacactttccatatcccgtaatctagctactttcatggatagcagtacgttgacggttagcagttcgcagcttctttcttgattttcaaataacagcagatgtaaacaactgatgaatcccatgaactaatgcctaatgttgaggaaatattgagaccatggataacgcaatacttaagttgaaactttatcctccgaaacctagctagcaaaatcttagtcatatgataaaaaaaaaaagacttacatggagtacataagatcttatttggtttccccagctgatttcagagagtgattgcgtgtggtctgcattcatctgtgcttggcgggcaatctcaagctggtccagccgagactggagcactgccattgctgatgccttattcatatgctgtgatctgcactttttagaatgaatcagaaacattttttttctagccacgcatacgcagatataaccaaatatcatttatgttatatcaacaatcaagattatggatcctttcaaaagtagaaagaaagacacaatatgattctaagacatcactaagttcatagaagtccaaattgcccatcagctaacatggaactaaaagtatgctatattatattcgagaatagtacaatgatcttcattacgggaatgctggagtgtttcaataataatggaaaacaggagaaagcataaaaaatacctttcattttgacaagttgcagttataccagttggaatgtgcacaattctaacagcactttctgtgcagttggcatgttggccaccaggaccaccagagcggaaacgctctatccgaagatctgaatcttttatctggtatcgggtagaaccatcaccaagaataggtacaacagccacagcagcaaaggaagtgtgccgcctctttccactgtcaaatggagaaatccgtaccaatctatgaacacctacttcggctttagcatatccaaatgcatattcaccatccactttgatagttgccctctaggaatagcagattttcagtataaaatctacatttttgctaaaaggtttctcaaattaaaagtaattgactgtaggaaagataggatcttatgttaagatcagatagtttactggtttgatcatcacttccagccaaagttgtaactgaaactacttctgaatgaagcagtagcaaattcagtaacgggagttgatgagaaggaatgtaaaccttgattcctgctatttcaccaggcatttcttctataatactgactgtgtatcctcgtcgttgggcccatgagctgtacatgttcataaccattgcagcccaatccatgctctcagtacctccagctcctgcctgaacctggtcatggcatcaacatcatgaggaatcactcaccaaaaatgcatggaggagcaatagctttagaggataattctgaaaatgatacacaatatacctcaatgaagcaagagcaagagtcattatctccagaaagcaatgcattcagttctttctcctttgcacttcttctcatttcggctaatgccctcatggtttcctgcacagaatgttgattatcagataaaaacaaatagctgatttgcaccttgaagttgtaactttatgtgatgtagtgcaaggaagcactgcactcaccgtctcaagttcattatcgtcctcttctcttgcaagcctcaacatgtcaatgtgctccatcaactcctgctcgaattggttcactgatttaatcttgcccatgagctcaccatgttcacggctaaccttcccagcgaaaactggatcatcccagaggtccggcctctccaacaccacagacaactgccttgatctctcaagtatccatccccactaagaaaatcgaaataaattaattaacagcataatggaacgggcgcacaaatacatactagcacataatgacatgtgccacacaacgcacaccaggtgttcgttgatatgcccaagaggaacaaggcactcagatgcataccacgggcccaacaacgccaggaacatcaccaatttcgcttggggaatatgagaagtacaaagtacctcacaaagattgtaccttgagccgcttcttgatgagcttgacggactgcgcgacggcggcggcgtggctgcgccagtcgctctcggcctcggggaggatcgtccaccccttccccgcgatcgagtccaccgtgagcccgtccgcggtcatcggcgcctccgccaccgtagccggggaagagaaccaccgcgtcggcgggtctcgaggggaccatggtccggccgccgcagggaggccaccgcggccgagtcccaggagggaggccaaggcggcgccattatcgaggtggtggtggtggtggtgggtagggctcagggccccggaggagcggaggtgggagaggaggcgcgcggcggttgatctggttaggaggcg

SEQ ID NO: 41006 - DNA, 2187 bp, Oryza sativa
  unsure (1)..(2187): unsure at all n locations
tgctaaaaaatggtttttttaaagaaaaatggtatttttttataaagcagcatcgtcaaagtgaactggcccttcatctcggccgcttgcatttgtgagcagaattaaatcactgatccgactcatgttgtgcttgcgtcgtcattcgtcagtctcgtcgcgctgtgccgactgtgcagccctcaagaacacgtccgaagctcgaatagacattcagcacatacgcatcgaatctgaagacaaccatttcctttttttcgaacgctgaagacaaccattcatttcatcctgtttagtgcgtagatttgcatgtgaagcaagcacacccagcaaccctgcttgcagatatcaagtcgtcaaccatcgctatcggcatcaacataagtttgcacacgcacatcgttccaaaattcgataaattttagatgggagtgcaattagtgcagcattgcagcaacaaagcagaaggttagtcagtactcattagaacaggttcgacatgatttttcgatttatttgtaccccgtgatagcacaggaaatcaagcatacaagatgccaattacaacgagtgctacactgaagacttccaagctccaacagctagcataacaatggcagacttgagaagttaagatgcaggtagttaaaactccggacagctaatttgccggctgagcggctcacaatatgccggagagcacgttggcggccgtggacagcgcggcgccggcgatggcgcactgcaccacccgctcgtgcgacgcgcggtccgaggtgagcgcgacggccgcgccggtgagggcgcccgccaccacgctgttctccagtcgtgcgtcccgcgcgcctccgtcaggccgtaggtcagccccgagtgcaacccggccgcgagccctgacacgcggaaacaaataaatcgaatcaagcagaattaatcagccgtaagcatagcaaattcgtcagtaaattcagctcgagagagggagggatgcttaccccactggagagactctntgctcacgcttttcacctgtcgagaaagcagaaaaaagaaggttcaccatacaggaatcagaaacgaccattcacagattcacggtgtggcgttgtccaagacaccaaaaaggcaaaaaggtatttgcacttggcttaccatagcctcagctgacttgctgctgttccctcctgcatacgcaatttatcagaacaaaaatcagtggcatccatgttgtcatggtcatactactagtaactattcaagattcaacatcaaacgatttccataagcatatcacacagttgctaccgttgagatccgggaacgatcgcttcctggcgccggtggagtcggacacggctcccgtgcccccaccctcccctgtagcagcagcaactaagcaactaagttgatcatcatcagaaagaaaaaacaataaaaaaaaacttggtaaaacgaggatgaactgaagccccgtttggtttgctagttacgtgccttccatggccatgaagtaagactcccgcgcgaccgcctggactgcgccgatctgcgtgggagatcgaagcaagcaaagttaaagacagtagcatcgcggcggtgcagaggtgaagtgaactggagaaagcgagagaaacagaaggggaggcaaaaaggtgagtgagatggagggcgtacgccggcggccttgacgaagctctcggcgacgcggttgaggagcgggtggccgaggtcgaccatccagttcttctccaggccgcgcacctcgtccaggaacgtgcgcgtctccaggctgctgttgctgctcccgctcatcttcctccgctccggcgccgcaccctgctctctctctctctctctatctctctctagctattgacagcttcggtgacagatttgcaatgccactgcttacactacagcaagcgagccgcgtgcgtatacataaactgagcgagtcgtggtcaccgtggaacagatcatcagcaagcggcgacgagaacccgatcctactggtggcgtcctggggagaagaggacatgacacgtaccccggcgggccggacacgttgcggggagaggctctactcgtggcgctcttctggaacgtgcgcgagcgcctccgtgttccatggaatctgcggtatatccgcctctgtgcctgtgctgtgctggccagggctgcaggaat

SEQ ID NO: 41007 - DNA, 3522 bp, Oryza sativa
ctttttcgcttcttttcttttcttttcttttcttttctttaaaagtgcttgatttaaatattgatttgaaaggtacaaaaattttactaaaaaatgcttgatcaaagtggtcatattttcttttcttttcattgaaaggtaccaaagcacgttttgaagtgttaggacataagcgggcatgtgcgcagcgcagtggccttcgagcaatgcctacatattgtccaggtgccagagtgccggcatgtcacgccctgaaaaaaaggaaaaaatgtctcttgaaaaatggagtattgacaacgaagcacatcttttattcagatcaatacttcagcagaacaatggttcccaatacaagtgcatcgatcgttctgaaattaaagcaacagcgaactgtcgtccataaaagaagttcacgacactccgacccactttcaaaaactggaaccacaataatcggattttcgaggtcttctcgaccatttatgaactaatgccaagctgagtgcgccaatcctcgagctgtttttttacttgctccgagcctgtagagccgtaagatatgaacttgtttacggcgttctccactcccagatactcgtacacatcgccctcaaaaacggggtgaacagatttcaggtcgtctagtccaagttcggcgagctgacagttcttcgagacgcatagagctacagaccttccaactatctcgtgcgaggttctgaacggcacgccctgaaaagcaaataaataaactagaataaataatctgattgtagtacaacagcatagcacctattataagattaaggagaacgtgagcggtgagccctagtgtgtgtgtgaatgtgtgtgtgtgtgtgtgttttgaacgaacaataatttttttttactgaggttacaaaaataggttttgatgtagttcagagttgatttatagactttcagatagtttgggttgtaaatgaactttacaagctatgggagaagcttaccttcttcacaagataatctgctagtgttgttgcatccaaatagccagcaggcagcgaactttgtattctttttgagttgaaggagatattttgagcaaactcggtacatacttcaagcattcctaatacagccttcacgctgtcaaacaagggttccttgtcttcctgctcaaaacgaaatattgagagcatgcaatgacataacatcagcatgaataacttgtacgaaggataatcacctgtaaatcacggttgtaggcctgcggaagtcctttacaaagggtgaggacagtcatgagatctccaaaaacacgagcagatttgccacgaacaagctccattggatctggatttttcttctgtggcataatgctgcttccagttgaaacagagtcacttggtgtgaggaatccaaactcctctgatgcccataagacccactcttcaccaattcgtgaaagatgaacagcagcaattgaattggcagcaagaaattccaatacaaagtcgcggtctgatactgcatcaatactgtacaaggaaaagtttccagattaagtgaggaagggcttatcatatgtcaaaagtgaggtaaccaacaaagaggaaagccaaaaattatgtttcagagtttgctttacaaaggcatagcatacatgacaaatcacagtggagattccagcggagaaaataggtaattcatctacacatgtgctatgtgagaagacatacttatttgagcagagattacttatttgagcagaaatgaagagcaagtatttgctgtgtgttaactttgacataggtgatataggtcaaactactaaaataccatagaaatcatgcaatgtgactgaaactttttaaagttcacagtactaaaacaaactggggatttacctgttcttcattggagctgtaaacttcaaatctttagcagttttgaacctatcgataggaagtccagtaccagccaaagcacaagcaccaagaggacagaaattcaaccgttccctgcagttgaccagccgtccagcatcacgctccaactgtgcaaagtacataaataagcggtcaagttcattgatggcttgttctcaaagaagtaagctttatcagatcatgtagtgtttgaagcactattatatccccgcacagggaatacaggaagtacttgtctataggctactcattgtgtcatactggcatgatatgccagctaattcaacaaataaagctggagttgctgaagtttattaaacaaaggagattgtagcttaagtaacacaaacatgtactgcagtttctttatattccagatttaataacttttttgtgaacagtatatagaccgttgatatatcagcattggcgagtagaggcaagcctgaaaatcatgtaaattttggcattgtactggcattggtggaacgaacaaagagagagagagagagagagagattcaccacataaattaaggagttgaatgttttggcacaaaatgttcattttatctacataagaggcatcatttttctatttcacaaaaaaaaagagagagattcaccacataaattgtccaaatcatcttttgatcagaacttgggataaagtagattatttgattaacatacatagtggagagaggattcaaccattcaggtttgttaacacaataaccaacatatgtaatcataggaaataagtctaaaaaaactgcatgggattgacatttgacacgcattgacaatccctggattacaccaagaaaactaacattaaaaaacccaatgggcatgaacggtatcagggaagggtgcataagaaaattcacctgttcaacatatgataagaggagatgtggaagcaaaacaggctgtgccctttgcaggtgagtgtaaccaggaactattaagtcaacatattttgaagctaacagaacaagagacacctgaaataatgtaaagtggtgttagaaaagtgaaaaacatccaatttagacttttatcagaaaaaaagagagagagagaaaccagtgttaatatttacaaaatggagttgcaataatcaaccatatttcatgttatacataatagtgaggcatttctgcacatcaagaactgcttaatcaaaaaaagtttgcatctggaagtgcttaataagtcgttcagtatggatgccagcagcatggctattagataattttctagtatagtaagtcaaccatatttccttgaaggcttgaggcaaaacttaagatatgtcaatctaatctcttgctccagcctttatatagtgaaagaaaggaagcatatgctctggttctcttcagaaaccattgccccagactcagcactacagtagaatcaacacttaaagctttcaacttaactagtttacctgaatgattgcttaggtataccatgaccaaaaagttttataaatggttcatgcaataagaatccataattttcactatgggttgataattttcatcaagtgttggatcaagcagaaagaattgtattgc

SEQ ID NO: 41008 - DNA, 2305 bp, Oryza sativa
ccgttatcaaaccctgcattgcaaatgattccccaatgtgaatcaaggtcgacagcacattggtacaattagcatctacaaagtgcaaaaaaagaattagaggcaggtgtttcatcaagcatctgattaacatactgacaaactctaaaccctttgatgaaacactaagaactaagaaagttagatttagaaacttgcagacacatctcaagcattacagtggagctagcaatttcatcgaacacatggcgagcgcattagcagcggattaaccccagactaaaactccccaaaacggcttagccgcagctctccagcgcaggcatgattagccgaacacctaggtggatcgcactaccaccaccaccaacagagacaacgaagcagatgggcacggtggaggcgcgcgcacacagtacctgcgcggcgagcatggatgcgtgggccttgctgcccatgatgtcgtacttgtagagctgccagtcgtaggagatggactcggtgaacccttccacggcgtcggtgacgccctcctcgaatcgcccgccccacagcttggtctccttcctctcctcgctctccgaggacgccatcgatgtggacgccgcggcgacggacgggaaggcggggcggcggccgcggagggacacggacccgccggcggggaaggggaggatcctcgggcggagaagggggttgggcgccggcgagaggaaggattgggaggtggcggcggccataagtatcgtcgccgagggtgtccgcttcgcccacgactgtggcgcggcggcgcggcggggaggagggagtagttggtgacggactatggtcttcggctacggtgagtgtgtgtgtcctctcagaactttgtttggacggtccttttagtccgagtccgtgcaatgtggatgggccggaattaaggcccaaccaaataagacccggaataattagggtacccaaatctatttttaactcgtgtatgtatattagtgctagtgctaattaatttggacactgtaacggcaagtgcaacagtgaagtccgatatggaccctaaggagaagaaatataacaccattgtacaatccggtcttcaatatgaatcagatgaagttcttgtgaagagtcaacttgatcgagatagttttcgggggtagagttattttctaatgtggattgtataatatttacactgtaccataatttggggaagcttttaggcacaagaagcataaaggagctagtgactctatggactaatttaaaagctcagactgtaaagcgtaattaattactccctccgtttgttttgacttttcttcttagttaaatcattttaattttgatcaagttcataaaaattgtataataatatttttaacccaaaacaaacgagtattaaaacatatttaattttatatttaataaagtaatttcacgtggtagagattattattactagatttttaaaaaactttgttaaatctaaagaagttttactataaaagattaaaatgacttatattacagaatgaagatagtagaaaccataatttggggaaagtttttttaaaaagtagcctctttccagtaaacagcctgatggatggtgtaacatccataacttaccgtctcagccagcatgacagcgtggacgcggctgcaggcaatgtcgtgcgcccacaattcatcagcctctcccgccaccggaggcccggtgaaccgctcgccggccttgcccttcaccgcgttgccgttaagccacacccttgtcggctcggtggccttcactaccgccggcttccgtttcgacgacaccgtaagctgctgtggcggatcgttggcataatccagcgacgacttcaccgacgactccgcggagacgtcggccgagctgccgaccatctcgatgagcccgacgtcgtgcgctgacagccgctcgccggtggccacctcgacgatctccaggccctccacctgcttcggctgctgccactgcggcgggaacggcgacggagctgaggctgagctcgtcgagtgcttgcccggcctcggcgtcaccggtattatccggttgggcgtcgccggagaattagtgcgcccgtcctcggtcaccgcgggtgaaggcggctgtgtcgcggagggcgtcgccgcttgcgtcttctcgggcgtcgacggggagtgcggcggatgcgtcaccaacgacggcgccggcgtgagcgcctggcgccgcgcgaccacggcggcggcgttggccttccgctccttgttcttcttgccgcggaagcacgacctgatggac

SEQ ID NO: 41009 - DNA, 13435 bp, Oryza sativa
tccgtgctcgacgcctccggtacgtacgtgcgcgcgccatgtcgctcgtacattcccctttccccccttctttcgccggcgttgtttgacagacctgtactagctatggtaggctacgtgttctccgacgaggtggcccccgccattgacgggtacagcaaggaggtggcggaggcggtggtggagaaggcgcagaagctctgcacgctctacggcaaggtcggtgacattccaacgctccacgagaggcaattcgggattcgaccacccattgatcgaatttagcgtggcgatttggtgcttgcaggaggtcggtggcgacggtgaggctggccataagatgaaggtggaggtgaaggtggcggtcggcgacgccaggaacgtcatctgccagatggcggacaagctcggcgccgacgtgctggtgatggggagccatggctatggcctgttcaagaggtcactgaaacgatctcgttttcaatctcagaagctgtgagagcgcagcttatctgctttgcatatcatctgcttcaatcagctcgcgctctcggtgacgatgatgtttagcttaattacgctatatatgctcgttgattttgcagggctctgcttggaagtgtcagtgattactgcgtcaggaacgccaactgtccagttctcatcgtcaagtcgtagctgccactcactccagtgcttgtaactgtgcagcagcatgtgtgctctgtccggcttttttttttgtttttgccttgtgttctgctttgtatgtctactttagttcgcttcgcatgtaatctgccggaagaggacgtgctgagtgattactcagaactctgaagttatccagcaacctgtatatagaagaactactttctgtggagatggcaaatttagtttttctgtcatcggcttccacttttagcactgatttctgaatttggctgtataattagcaaatacccagggtttgctttgatctattcgcgctaaccattgcgcagaaattcagaactcctttataaacaaatctctaagagagagaattactagcgtttcttatatttgacccaatttcatctgcgatcctcttttgtgcagttgcttttgttcctctttcttccggtgtgtatcactatctatcttgggcctcgacattataaattgggaaaaagtttatttttggttctcaacttgctgtcaagtttatattacatcctcgaaatcacaataacacgttaacagatactccctccgtctctaaatatttaacgccgttgacttttataaacatgtttaatcgcatgtttaatcttttgttttattcaaacatgtaaataaataaataaataaatatatatatatatataacagagaatttaaattttttaataagacaacggtaaaaaaaacatgctaattttaaacatgtttaaaaaattaacggcgtcaaatatttagaaacggagggagtataacgtatcccttgactagcataaccggtgttcccgagatctcaggcaatatagtgtcgtgttttagctaacgtgatgagcgggatccacatgggtctcacatgttaggggctattagggctatttttttcctccaacccctaggggcgtacctatgtgtagtttataggtgtcctagaaccctgggtagattatccaattatagttaactagcatagtggcccgcgcagattgcacagctagcatcattataatttcccatataatatcatatatattttttctcattatattgttcaaatatattacattaacatcataattttaaattttacaataactttacgaaactacaaatgtgtaatattcatattgtattttatatacgtgttagttattaattattttaatatcaaattttagttatttgtaaattatatattctcatatatctactctagactcgtcgtttaatattcttttttttaattccgaattttatgtaagttgtatttctatatagactctaggcttttcttccaatattatttatttttatttctaaatttttattatttttaaatgtatttctatgtgaactctaaattcatctctcaatattctttaatttttaatttcgaatttcagttacttctaaattgtattcctatattgactttaaactcttcttcccatatttttcttaattttgaattttagctatttgtaaattgtatttttatacggactcaaaactctactattaattttattatgtttattctgaatttcagttagttttaaattgctatatggactctatactctacttctaatattccttatttttaattccgaatttcagttatttcctaattgtatttctatatggactctagtctcctcttctaatattccttattttttaattctgaatttcagctatttctaaattgtatttctatatggactctgtttttttctttttctccgattaatgtgagaatttctaggctatgagagcgaacatgaaggctctttttttattactttaataatataatatatttatgccatgcgaatcagtataatcagttaataattaaataattagtatgtttgggaccttcgataaattttattctggtgcaccactaccaacctctcctctctctctctctccatctccaaagcttatggtcggggaaccaccggcggcagcagggtcccatgcagcctccatcgaattagcagttgccgccattggtgaaaggggaggcgagaagggagcttggcttggagtcccaaatcaaccactggttcactgttgtaggagactaggggaagagagaagaaggaggtggtggcgaagtagcagcacgccaacggccgtcagtggagctcagcgtcgttgctacagtcaatggatctcgactggagaggggaacggggagacgggacgacagtgagggcgcttcagtcggtgggtggacccaggtggagggtctccgctgtcaccgccacgctcacggcgctcgggccgtgtttagttattttcaaaatttcttttaaaatatacggacacacatttaaattattaaatatagactaatagaaaacaaattacaaacttcgcttgtaaactgcgagacaaatttattaagcttaattaatccgtcattagcaaatgtttaccgtagcaacacattatcaaatcatgtcgtaattaggctcaaaagattcatctcgcaatttacatgcaaaatgtgcaattggttttcttcatccacatttaatatgctccatacatatgtccaaacatttaatgtgacggaatttttgaaagtttgaaaatatgagggacccaatgtgtcaaataaaaacgagggacccaatgtgaacttattactactacaatttgcaagcgaccaagcgtaagtttggggccgtttggctatcgaataaattcattttatgtaccttaattttacaccgaatcctattttcgtcattgaaccccaaaaccagatacaaccggtacccgaactatcaaaactggtgcaaaacaggtccctctgcagttttgaaggctgttttggctgatacggcgcctacgtggctggtttgactaggtctccatcccacgtggcattgacatggcaattatatctcggaaaaataataaaaatcgtaggcccacatgtcagccacacaaacaaataattaaaaacggtgggtcacacatgtaacctacacaaaaaaaaatatggcgcgcccccgttggccccacatgtcattctcaaatgaccaaatccaatcctcttcttcctcctttctctggctctccccatctctctgctccctccttgccaagcggcggggcgacggacagcgcgtggccggtggcgggcaacgacgcgtgtggcggcgcgcgtggcggctgggccccctgtgtggcatgtgaaggcggctcgttttctttctatagctcttttgagacaacttggtgagtgctcgtgagctactacggccatggctgtgatgtgttgtactactgtcgtcatcaagctgaacgctgaagaggagaggcgtcctgctactagcggccgttcgagtgggagaggctagcgaccgtcggcgggaaagcccagtgggagtgacgggctctcggaggttggtgggtagaggcccgcagcggccccttcatcttcccctcgccgccgtaaccgcgcgctgccgtcggcgtcgggtcgtctcgatctgtgcgtacatcttggaggtgaggacgatgacgacgccgtggcttcctgattcggcacaaatctcagaccatgtcgccgccgcccctcctcccgtgcttctagtcccatcttgaccttgggcagcggcggcggatcctgctcaccgctttacacttcaacatgacgctcatgatgacaccgccacccaggcaaagcaccttcggccgcggcgaaatcggcccagcgctgtgacgggagcgccttcagctctaccttcgtcggcatgctgcggcttgacgaggaagaagagggagaaccgagtggagagaaggagatgacatgtggggcccacgtgggacccaccatatttatttatttatttgtgtagcttacatgtaggtcctaccatttttaaattatttttttgtgtggctgacatgtgggcccacatttattattatttttccgagatataattgccacgtcaatgccacgtgagatggagacctagtcaaactagccacgtagacgccacgtcagctaaaaccgccgagggacctcttttgcacctgttttgacaattcggggaccggttttatctggttttggggttcaaggacgaaaattggatttggtgtaaaattaagggacctcatatgaacttattcctttggctattgttgagttattgtcgtgggcttttattcattgaagaaagaagttcctgtgaacttgactcgtggcctgcaggcctcaggttcgtagcgttcggtcatcactgtgaaatggctctccttcaaaacggtttgggccctggttgtgttattgcgctgccgatccatactcaatgctctcatacttgggctgtaacgatgactggatgacctattattgacttgttcctagcaaagtttgatttattctccgtgtttttttttacttcgacgtaatggcgttctaaagtccgaattttgctatgctccgaaactctgaagtttgaaattagcatttactgctacatccgggcgtctttgagtttgacatttcaaaaccagcagcatcggtgatcgttccgatctaattgtcggcgactgttccgccaaggtcaacttgccagaaatcccagtcaatccaattggcgatgttaattacgagttaagtgggttcgttgtcggtcggtgctgaactttgcacgtcttctctgtacatgcgcgtttgaatttttcaagttcagacgttcatttcgccttcgccaacttgggaagaagtagattcttaatcgagcatagacatgtacatatgtattgcaaacattgctcctttggatatgaacaatagatcacgcctaaacactggccaatcatttcgttgttaggttgcaactaacgccagaatctccgcaatatcgtgttgctctaagataatgccagtaaattttatttcgagtttttagatgattacatgtatacctgacccgtcaactaattcatgcgagtatgcaacacaacagtatcgcttgagcaataagcgaactgtccctttcagacaggagagtttaaaaaaggaacgagctttattaggcttcagaccaaaccgtaggttggttcgactggcaatggcagtgcttaattagattagaagttccggctggtccaagtagtattagattagattataataggatcagaacaatgtatctcggcaaaacgaagcttcgtacttcggtttggttatttggtacacatccctctccaaatcaaccgaaactatcattccatcgacagtcactaaggaagcaatttggccaggctcaactcctacgcaaaattcttcctttctttgccctcactggaccatgcagagccatgagattctggaagaaatgttgtcaaatttggtgggatttctcttcattctttttgttattcttgtgggcaggtgatgccgatggattgtaacactgttgccttcccattttggacatggtgatggagctaattattgttccatgtatcttctgagcaatcataaactgtaaagatttcataatgtagtagacagcatgatcgtcaggataattggcaacatctagtttctgacaaggatacgattcgtttaggtgcagccaagacttggatggatgtattcctcttgcatggttttccatgaattgcaggtaatattcaaagactgttaggacatgggagttcagattacagagtaaggtttacataaagtagggttggcaaagactgtactttgcagcaatgaagtttgcagttagaagcatggcagtttggtaccagtttcatcggatgcaaatatgttgaactcgccatcacggtagggctagcattttcttagctgtagtccacaaaattccaaattctttctgcccaatttatggtctcaacagtatcttcgtccggtcacaattcatttgatctgaaaatctgtaccgtgcaggaagaccgttttcatcgatacaacgaacaaactgaacatcataaatattgcagctattcattttttgacgaaatgatacaaaatatttttttcgcgaacgcgaaatgatacaaaatacgcgtgattagctgaacccagctatgacctgctccttttgatttgtcaaatgcaaaaatccagggcgcactagctttcgtgagagcacgcacaggaagatctcgtcagatgcaggacacacgcctgaaaaattattgtacgaactgctaaacatcaactgaaacatccaaaaccccaacaggagagaaattttggaatacttcgattatcttccaagcaatattttgtatgaagaggagtggagccccaacgacaaaatggtcgcacgtcaccgtcggcgctgagacaaaaagtacgcatgcgaactcactactactaccattttgccaaccaaaccaattaacccattcttaaacactgtccatttctaacccgctatagctatcactcttttccctttcattaattttgtaattatctccttctcctgccacttccctgtctctttttccccaacctgtagctgtagctgttaccccgcctgttacggccggaaacccagtgtgcacacgctgcaaccgtgccaattttgtcacgaaccttccaaaaaaacgtaaatttgggcgtcgtttctgcgtacagtgacattttacagaaggtgttctttccgtgcgagttcagtgcgttcagagaagagacggcacgagtgattcacaaattttgacgatttgtccatttggaaaaactaattttacaaataaatcgtgaccaaaacttatttcagaaatgataatttttttcagcgccaaatcatatggcactgaacttatacatctcagcgccacatcaactggcgctgaatgccgtgccaccacagatgggaggctgagtcggcgtgccaatgtgcattcagcgcgatgctatttggcgctgagacgtctaagttcagcgccatacgatttggcgctaataggggtgaaaacggtcacggaaattaccgatcgaccgggcgttgtttccgtttaaggggtaccgttttcgaccgtaccgtttttggctatttttaaattttattttttctaatttctttcagcatcgtattaatgtcgatattaagtagtttaaatgataaatatggtcaattaccggttgatcgagcatcgtttccgaagagatgctactgattctgaccgtttctgatcatttttatccctaggcgtcgaaaaaaaaagtcatttttaaaataagttttgaccacagttcatctataaaattagtttttgtaaagggttaaattatcaaaattttgcgagtgattagtgaacggtgcaacgcgtcaaggacgagtcaacgcgccaacgacctcacgggaggagcagttcggttcaaaccgaacccgccatttttcttctcatcgtctccaccgcgcgcgccacaactaaacccctcgacactttttttttttttgtcgccgagtattcgtcgtccccgacgaccacgaaaaaccgctaggaaaacatatttgggtttcttgatccatccgattcccgatcccaccaccacccgccgctttaataccctcctgcccatccacccctcttcccggcccctcgccgcgccattagcggaaggttttgctttgcgtcatccaggatgggcaatctgatctcgtcgggcgcggtggtgggcgcgagcggcggagggaaggtggtgatggcggacgggagcgtgcgggcgctcagcgagccggtgtcggtggcggagctgatgatggaccacccgcgccacttcgtcatcgacgcgcgcgacctgcagcagcagcggcggcacaaggggaaagctggggctcctcctcctccagggggcaaggtcgcgccgctgccggccgaccacgtgctgggcgccggcggggtgtacgtcctgctgccggccaccacccgcggcaaggtgtcggccgaggaggcgcgccgcgcgctgacggcgtcccggtcgctcgagcggtcgcggtcaatgccgggccggctgaggaggaagctgtcgtccaagaagatgacccaggaggctgacaacgacggcaatgcgtccgagaaccacgcggcggcggcggaggcggagaggagggaggagacggcggcggcggcgaggccgccgccggcggacgggttcgaggagcaccggccggagttcctgagcagggagctgtcgagcagagggtggaagccgagcctgatcaccatcgaggagcgcgtagcgccgaagaaggtgtcccattggctcttctgagttctgacctcgtcgccgacgacgacgagatcaacaggaagcttcttaatttgacttgtcatctaatctctctttcttctctttttcttctttcttgctgatcctctgctgaatgcttgtcaattgtcatcatctagtccgtcaaaatgcatgcactgatgtacgcataatggcatgttgtaatgagatagcacaaatgaaatgtgcactgtaattacaaactttaattagtaggtgtttggaggctgcgtctgaaaatagctcaaattgaactggataaacctctctgtatccatattctcttctttctcttttcccccttttctgctatccacagctctatatcctccttgtctaaataagggtaccattaactctacattaaacgtacagccctgataaaaaccttcactaaactgaaaaaagaaatacagagcatatgccccggttcgttcgctaaggagttcaagtgtacttgcacctgaattacgcctaacacaactgcaacactgtcgcaacaatcgagatggtcagtaataagaaaaaagagaaaagacaacgtaaagatggagcaggatagtacattgtacagactagcgactaccgagagacagaccgaacaggacaaaaccacaacgttgtgcagaattttgccacggctttggaacactggattgttgttggccgttgccgtcgtgcttgcgtccaatgtactgtctcgacgagtagagtagagactggagaggcatacagctgtaggcctgtagcctgcagccaaatactttctctatcctaaaatattctccatttagcgggtgtttagatctaccggtaattttttttctcacatcgaacatttgagcacatacattgagtattaaatattaaaaaaaactaattatatagtttgcgtgtaaattgcgagacgaatcttttaagcctaattgtgccatgatttgataatgtggtgctacagtaaacatttgctaatgacgaattaattaggcttaataaatttgtctcgtggtttacaggcggattctgtaatttgttttgttattagactacgtttaatactttaaatgtgtgttcgtatatccgatgttacacgtcaaaactttacacccatggaactaaacacagtcttataattgaatgcaacgtaatatagtatactacgaatctgaacgggctgtttatagtatagaatatatcacatttaattttacgttattttaagataaatggaatatgcaatgcatgataggataggataagcgggcactgggcaagcgccaaacatggtgcccacggaattggcctccgcttctcgtttcgagcggaagggcgcccacgggctcggaatccagctgtggcaacagagaacggcccacgcctattcaagctgccgacatggtcacatcaggcatgcaccctggaccctggttcgacatgggccatgtgatgagctacgtggaggcccgcacgacggtaatttcgcaacctggcctgcttaccagctctgacatactcctatgcagatgctactctaaaaaaaaaaacaaaaaactcctatgcagatgataatgtttcatgattgtgtttcgaaaggaaaaaaaaatgtttcatgactggattggagggaatatacgatactacgagttctatcacatgtactctttttttaaaaaaaatcgttttgacgacaaattgttttattttagctgcatgtttagaatgcaggaattttgtaaagaaacattttttgcatgacaaaaatactgcccgtccgcgtggcatccgcatttgatgcaatgaaccaggacaagggtgttcaagatgtcagtggacacaacttgctgccgcttgcatcagcacttacctcacattcatatggcgccaggtcatcatcggcgtccatgtgccatcagaacaaatcagcgattataatcaggtccgacaaaatgaaaacaaaatgataaaaaagaagctactgctgcactacaacgctaatctgggcataggacacaatagtattaccaacataatcatacctcatctttaaattttaagacgaaagatgtactccctccatcttaaaaaaaaaactaaacacataaaataataatcccttcgttttttaatagatgacgccgttaacttttggatacatgtttgatcattcgtcttatttaaaaattttatgcaaatgcataagatatgaatcatttttaaagtatttttagtgataaaacaacttacaataaaataaattgtaattatgtaaatttttttaataacacgaatgatcaaacgtgtgtacaaaagtcaacagcatcatctattaaaaaatagaggtagtatatgatctaccctagtaaaacaaatttagatccagatttattatactaacattctattttaggtttggttttttctaatggagggagtaggttcataggcttaattggttgctcaccaagatttggcaaaataaaaagggctaaacataagtgtccttaccaaaaattttaactgtaaatcaagcacatatgcttcaccataatgtcgacctaccagcaggtttcccaaatcgtttggaatgcggttactgccatcccataatttgatactaaaccgcgcagttatcgcgagatataccgtggtttaaacagcaccgatttataaaccctgccttccagtacgttgacaacaaccagataaatttcttctcccacaaagaccggttcctcccttgtggccgtgccgtttcgtccaaagggcccaccggctgacacgaatttgggagaattgtaacgcaacgttctgggattcgaagcaatctccttatcagacaatcatagagatccactgatgacagcaatctcatgggtttggaacacgctaatctcactcaaaattccttaggacccaaattttccgacccgtttgaatgtttctccaagttgtttggcttactccagtgcagtgatcaacgacctaaacttctcccctaagctgcccgattgttttttcctaattagccgccctgatgaaagtatgaaactggagccatacagtaacagatttgtggttttcctggtcagcagcaatacaacagaggacgagaagcaccggtaatgtgatagtgaagtcgtatccacctatcagaattcaaattatagtggtcacaattcacgaatattacatacacgcaagtaggcttttaatatgaatttagtgaaataaaagatgtacaactgatttttgccttttaacatgttttagtagacgagttcgcatgtctgtgaataaatgtggtactccctccgtcccataatataagggattttgagtttttgtttacattgtttgaccactcgtcttatttaaaaaatttatgcaaatataaaaaacaaaaagttgtacttaaagtactttggataataaagtaagtcaaaaaaataaataataattcaaaatttttaaataagatgattggtcaaatagtgcaaaaaaaacttaaaatcctttatattatgggacggatggagtattaccatgtgtgcgtgtatgtacacttcgtaacagttactctctccgtttcacaatgtaagtcattctagcatttcctatatttatattaatgttaatgaatctaaattaatatctatctagatttattaatattaatatgaatataggaaatgctagaatgacttactttctgaaacggatgaagtaaaaaggaaaagcaatatagcatagcggagcactgctagagaagcataactgtagcgtatagccaattagccatctggtggagtccgtgggccatctcgacagagcccgtacggcccacttgacagtggagaagtccaactccaagtctctcgcctgccattacgcgaggacgatcccgaccgtccgtcccctgccaaaccaacggccaccgtggcgtacaggcgctatatatcgcactgaccgtcgcgcagcagcgttcgcctctgtctgtcacacacacacactccagtacccccacgctttcggcacattctcctcgcgcgagaggggggaggagaggggaggggggaggagcgagagcggagcgatgggctcgccggggcatggggatgcggcggagagggacatcgacgatctcccacggaacgacgccaactacacggcgctgacgccgctctggttcctggagcgcgccgccgtggtccacccggacagggccgccgtcgtgcacggcccggtgaggtacacctgggcggagacctaccgccgctgccgccgcctcgcctccgccctcgcgcagcgatccgtcggccccggctgcacggtaaatttctttcccctttcttttttctttttacccgctacgagccccgtcagcgcggtaaaatt

SEQ ID NO: 41010 - DNA, 860 bp, Oryza sativa
taaagattttttgagctgtggtttttgtatatatagctgggtagtatatacgatcaatcgttccatgtcacttttgtgataaaaatctggttgagtggtggaatctgatgtccctgatgctgtaaagcttataataacagtgattaataagcagtctgccttttgttgtccgacgaagtggaaaaggtgatcagtttacttacaaaaaggaaagaagaaaagaaaagctacaccaatagctctaagaagccgcagttcatgaacatgctgattagtctccttaataatcattttgtagaagtttactccggctagactgttatcctattgaggtgcgtggctttgatcagtccaaatcattgacacgtgccaggcagaaactttgcattattgcatatattgggcagtcaaggagagtaatatccctcccatatcttatagaaggcgctcgaaacaagtgctagtttaataactttgctcgccaaagaaaacacggaaccgtcactgtttctggtcaaataagataaggctatcactttcatctgttgccaataactctttataatacccgtatctgttgagaatatgaggcgaaaagtactagtagtagctattcctattgcacatttgtactgaaacattttaagataaaaattctccacatttaactgggtactctatttagctcatactgttagtttatttttatttatttattttgctctggcttgttaaggtcgctgtgattgctccaaatgtcccggcactgtatgaagctcatttcggcgtccccatgtctggagcggtggtgaactgcgtaaacatcaggttaaacgccgagacaattgccttcctccttg

SEQ ID NO: 41011 - DNA, 2169 bp, Oryza sativa
tattagaagaagagcctagagtttatatagaaatacaatttacagaaaattaggaattaaaaaaattaaagatgagtctagagtccatataggaatatatataatttacaaataactaaaatatgatattaaaaataattaataactaacatgtatataaaatacaatatgaatattacacattagtagttttgtaaagttattgcaaaatttaaaattatgttatcattttaatatattttaataatataatgagaaaacatatatgttattatatgagagaaaatataatgatgctagccgcgcaatctgcgcgggccaccatactagttttttagtatatcatgttcaaagttacaatttaactatctatttaagaacgaaggaagtaatttaaagggtgaatagctaatttagtccctcaaatttcagcgaagactcaatttggtccttcacgtttcattttgtccacatagatccttcaaatatttgttttggcttgaaatcatcattgggtccacttaatatgccatatggctatttctagtcaatatttctattagaaaatgtcaattttgcccttaatttgtatacatctatatactagaaaagagaaagccaacatgaataaacaatattacagatctacttcccattatatcaacatatgcacatgaaacttaagcaattgctatcatatacacttgctagtacataatttttttttcgttttacataatatactatgtattatctataaaaaaatttaagcatgcaatttctctattatatatgtgaatgatgaggggtataagtgtcatttatgaaaagagttgttggttcaaggataagtttgaattaaaatgaaaacttgaaggactaatatggatagattgaaacatcaaggactaaactgagcctcagataaaacttggaggaccactttggctattcaccctaatttaaacccgattgtttgagtgtttcccttgtttgcataaaattaaaatctcccggccttacccaaacaagcagtaaggaggagacataattgttgcatgcatatgccacgtttatggagcatctgttcgaagtaaggtgcgctacgacagtacggtgtacaaacaactttatgccatgcattgcacatgtgtcagtttttcctttcaagggttggtataattaacaagccagttaagtgtccattagctgtaccttggtatcaattcatataattgcatcagatgatgcgccgtgcggctggtgaacggtgatcgatcccccagcatattaggaataggaataaaccatgctaatatactcatgcaggtgttggtcctgcaaatctttttgtacacactcgaaacgatcgtgtcggttctaatgtcggtttaacctaaagcatcgagtcatcagggccaaattaaggaccttgtgatctatataagcaacaacagctactactcctacttaataggccgccattattcgatcagctaattattattttgagctgttaagcacctagccttctactaatcaaggtcgttctttatatatgcatgcatgcgcgtaagcgatggatagatagtcagttgttgacacgtaccgtatgtttgacagcaagtgatccatcagtatcacctctagttgtcttcacgatcgagactctatacgcgtctgatctatggtccaatcaagtaagattcgatcatcatattggcaagcattgcatgatttgcttgcatcgaactttaaactctgaatatcatgtagggcaccttttatgtgtaacatctaattaactcgtttatgtaggcaaattgaaatcaccgtgaagatctttcacatgatgcattacattgaaggctctcatgctcgatcgacttatatccactagaatttgatccggcatcttctctatggcttgccaaatcatcgaactgcaattcaaaagatctgcacaatgcactgaagcatggtttatggtgtcgaactactcgtctaaggtcgtgtttagttccacagctaaatcttttttaaaggatacggacacacatttaaagtattaaatatagactaataacaaaacaaattacagattccgcctgtaaactgcgagatgaatttatcaagcctaattaattcggcattagcaaatatttactg

SEQ ID NO: 41012 - DNA, 2144 bp, Oryza sativa
tcctgcagcccttcgttctgaactattcgttcagcgagcaccatctttctgttcccccaggtctcggccgcatgtgccgcttcgtcttgttgctggaagtcacaattcgagcgtgccgtcggtcggctcgccgctgctggggcggcatgtgcgcgccgccaccaatgcttttcattcaacatgaagaaacaagcaggcattattcttatatcacgttgattaatttcaattacacatgaatgcaaattaaatttgatcgtattaactgcatgtcctaaacatatgacagaaccagcctttcacagagaagaaaaaaaaaacaatcattggatgcatcttcgacctctatttaggggtggacggaataaaaccaaaccaaaaaaccaaatcaaaaagatcgagaccgccgaattcggtaagtagtccggtctcaaccagtgaaagaccaaaatttattccgttaattcggtcagtggcctcggttaatcgaattgaccgatatgaccgagccgtgacccaatagacctagtacaccgaataaacccattaatttagcaaactaaaccctagagacagggtagagagttgcacctccgcctccatcattcctcggttcactccgcccccgcctccattattgtgctcgcgcatccatcctctgcgtgactgcatcaattgcacaccacattggtatgcaccgccttgtgcctccgcctccattgcacagctgtgcgctgcctccaaccagctccccttcacccggtgcctctagcctgcctccgcctttgtttctcaagtcccccacaatcgagttttggtggaaaagaaaaaaaggagcctgaagctccttaaggtgcggcgctgcaagcggcgacttgcaccacgctgagatggatgggatttgaagcttctcatggagtggtggagatcgacgacatccaagtcatggcaggattgatttgcttctttttcttcccctctgaatcgtgctctatttgttactggcatcatattgtagttcttcgtttgagttgcttcgatttttcgatcttatatggtgttcttatttttcttgtgagtaactttgtttgccattcaaaccactcttatgattagttcggtctatgaccgagaccaaactgaactaaacgaggaacgaagtgcgtggtcttgaattttcttgaagaccgatcgatcttgtgattctaaagactgaattttccaaaagaccaagaaacggaaccgaatttctcaattagaccgaatggccacctctacctgtattagagctggcacatctaaagaagtgaaaggaataacatttctcgcatagttaccaatgccacgtcatgtaataaatatggaccgtttgatttttagttcaaacgttgcaagccatcggatcccttgattggtgaaatccccttccggtccatctagagacttctttttgtaacgaggtactttcacatccctggtcttagtatttttcatttacgcccctacaaccctcctgtgctagtgagatgaggcacccagcgtccggcgacctcttccttggtcgctacgccacctccgcctttccctcccctcccgaaagatcgagacgtcgctcgatgtcttcccaatcccaaccgctgctgcatccccctcccccaacatccaacacctactggagcggcatcgtcgctcctcctcctcctccatatctccaccgcctctagtttacattgagaatattatgagatggttgttgctaaaattcaattggttaggatggtcaatgaagcttgcaaaaatatttaactgttaggcatcttctttcaaatatacacctataccattctactatccatagttccatactactacatggtgtagtataaatgaatacggtagaaaccagtatagtcatctttagagtttgagaaaattccctacatacctctgaaaagtttcgcaatctcttctatacccttgaattttgccttatcccctacatgcccttgagttatcattttgatctcctctatccctattccattagttgaccgtgagttgactgttaattttttctaaaatgaccctatcgcccatttcccatacttacaggtacatgctatctactctacttcataattcac

SEQ ID NO: 41013 - DNA, 10089 bp, Oryza sativa
gagagaaaatatattgatgctagccacgcaatctgtgcgggccaccatgctagttcatgataaaatcaaatggggcataattatttattgaaacaaaaaaaatgttgaaccatttttttttgacaaaatccatataagagttttagctagaaattatgaaccaaaattatttatttgttgggttcaaattttgatgaaaactatatatgaatttcataaaagttaatttaaaatttatttacaaatttttgatttatttttaaaatttgtagtcagatcattatattccctttgtttatttacaaatagatcttttacatataagaattgtgttttatcattaaactagcatataagtataagagaggggtaatatagtcaatttcaaaaatatttaactgtcaactcacggaatgggcatagaggagattaaaatgagaactcatgggtatatatggaatgaggcaaaattcagggtacataagggattgaacaaattctcaaaaatatataaagaattttctcttagagtttataaacacgcacagccattgaagaaaaaccgagcggttcataccaaagaaagatgagtattccgctgctcgacaaacaaaattgcaggaacaagaacaaacacgacatttgacaaaactaggaggaatcttgtctcactagctctgcttggctgctagtgctagctatacccactctggcccggatggtcaaattaaacgatggaaagttcatcaagaacaatctgcctcgttttctgtgccataaactacggtttggtcatggtatatagggtatgtttagttcacactaaatttaaaaatttaattgaaattgaaatgatgtgatggaaaagttgaaagtttgtgtgtgtaagaaagttttgatgataaaaaagttagaagtttaaagaaaaagtaactaaagcagggcatagctaggcttggacaatacagtactgtcagcagtaaactatccggtgcaatttttttaagactgtatagtgcagctgtactacagcccagtggaggagtatactggagtcgtagggcaccctggcctttggatttttggttaaagtgcggcaactttcttgtgatcgctgggctcgcttctgagctcagatgcctctgtttccaccgtcttttttccttgctctacagcggcgtgccctggagcttggcgcggtgtgtgttctgctgtagcaatggccaatggccatggctatacgacgctagctttccctcaagtgcggctgattccattccggcagcgtccaaaaccaccaaaatatgctgcagcgcagcaattagcattgctgtagcggcaagcaggcagccgcaggaccgcagcaacgcgtaggacgcaagcgtttttctctccatcttttggctggttgtgggaactgccgaactatacgcctaaggtagactacgggcaggggtagtcaattgccagcagagaagcgaaatactccagtacattgagatttttttttttttgagaacacagtacatagagatttgaaataggatcggaagagtacatgtactcctcactgcatgtctactccgtgcatctagaacttatttcttcctttctttttgttacctcggttattaatggagttcacactcttaactctgcctagctagaattaatcacacatgagtatatacttcgtgcaaatactggtgcatgtaccgttatatacatctcagtggatatacggtagtagaatagtacgtactctctccattttatattataagttgtttgatttttttattagtcaaagttatttggatttgatcaaatttataaaaaaattagtaacatttataacaccaaattagtttcattaaatttagtattgaatttattttgatacaatgtttgctttgtattgaaaatgttgttatattttactctaaacttaattatttttttaaaaaataactaataaaaaaaatcaaaatatttataatatgaaacagggagcagggagtactaagattaccgcagaatcgcagatcaatggatggtgcggatgtacgttttcgtctcgggcgcttatctgatgatctataaatccatgggtcacatcgtgtgctactgtgaataatcttctgcatggttgcttctgatctgggcatgcattgacgctgtcaacaattgtacgactagtatgtgttaacttctgcacacaaggtagctatgttgctgtgtgaagcaacagtaatgaactaggcaactatctaagctaatactctgctatactacataggaacaattccagtacatggtcaaagcacagtttatggcatggaactcgggtaattgttttgtccgtggcatatgcttgttcaacctgagttccttaattccgacatttctattgctaaacaagttgaaggtggccgcgcccgggcaacaacaaacgctaccaaacaaacaatagccatcaaaataatctataaggccatactgtaataacttctattgatacaggaaaaaaaaactatactgtgccactaagaactgagctgctattagctatcctgtgtgcttgaaacttctgcccccgtccccgattatagcaaggagaggcctgcaggggacgcaagcaaagtgacgcaaacgggatattgattcatttccattgataagagattcgtgtagtacacagcaagtacgtgtcggagcccctgcatgagagacacacgatatgatgacttgcaggacgtacgtacgcctgtcgatgtgcccatgcatatgctactactgactacactatactccgtatggatcgatcgatagttcgtgcgcgagcgcgtgaatgcactggccgtacatcgcacggacagtcgcaagccggggatggataagcaagctagcgcggcagccgcagcagttgttaatggcgcgtgagagtatgagagatgctacgtacgatccatcgatctgttcgtgactcatccatatccatggataggtttgtagatgcatccatccaaatgcccgggcgttggcgtgtgcgaccggtggatggatcggcccgtggcgcgcgctgtgcgtgccgcgccgcggggcgcgcggatgccttgcttgccggcgcacgcctcgcgctgctgcgcgcgccgcgtgcttttgcgtgctcccgtcgccgagctacgtacacaggctatacagcgcgggatagctgaacgcgtgcgtgcatagttatacgtacatacacgggtaaatccgatcgatccgctggtcaaacgggaacacatacgtagggccgttcgttcagtatcatcgatcacactgtgtgaagatctccggtgatccagatctgcattgccgttcctgtacaaattattatcattaggcatcttcttaattgggatgaccagcgggaatgagctagtagtaatcatagtcgtgccattatattttacgtatagtacctggcatatgctacaagcttgtggagcatcgcagtttctttaagggcccgatacacgttgtacgtacactgcctctcctgtaagcttgtaactcgtaacagtgtgtggcacagtggctgtaacgtgtgggatcgatgtgtgtggcaatttaagacgcatgcagctcgcgtctcatcgactttactagcagcgcgttgtttcttgtgatcgatcgatcgatcgatcgaccagccgttggagacaaacagaaccgtctcagcgcattaacgtacgcgaccctagcagtacgtacgtatgttccctgttgaatccactactgcgcagtacgtacgtatgccgatgcgcgtacgccccgttgcgtcgtccgcgcgcatcgacaccggcgctacagtatatgtccagccgccggcggcgccgggtgaaattaaatacacgcagatgtggtagctcgagttgcaatctgtacttgtcgatgaaatcagagcgatatcctagctacagatcaagtggactacaggaggagtacgtacgctagtggtaactgagtgaggtacagtacgtacattagtggtaactgagtgacgatttattgtgctttcactttttttccttctgtctgtgtcagctagctaaccatcgatcggtctttcgaataaaaagcagctaatcctttgtttgaagatgtgaaagcgaagtcccgttccgttccagcctagcttgacactccccgtcccagctcctgacaaatgtggcataggattccccaattcgacagcgacgcacgcacattgaggaggccgctagctcttcctctatgcgtggctccatcgcacggcgagcgattgggtcgtggtacgtactccaccgaggtaggagtagtatcaccgtatcagcgcgcagcgcacgtacgtacatgcatccgctcgccgctcgcaggcacatgcattgctggctgtaaagtggccggcgtgcaccgtggggtatccgcgacgtgtcgcgggcttattcgttagttgccccaggcctttgggtgaaaactgttcgctcttttcttttctttgtttttgtttttttatctgtaatactcctacacggccacacgggtgtaaatcaaggttgtcagtatcccgatacgtatcctaataccttacgatactacgatcctactaaatcgaaacgataccgatcccatctagtatcttaattttcataatttctcgatcctactattcattactacacgatcctacgaaatcttaggtggtatcccgattcgatccctacgatactacaaaatattatttaaaataatatggtttgaaaataatgtaaataaatatgctcaatttcttataaaaattagttgaatatattaaaaccaacgtggtttctcttgataaatgtctctatttgcatggaatatatcattactatatttttgtaatatagaatagctatatataattaatataaatattaattaaacttaaaaaaagaaaatctcatagtatcccgatactacaatacgatcttacgatacgatattactttgagaaaaaacgatattatctagtattccgatcctgacaacattggtctgcttgctaccatcacggagtgaaaaaaaaagaataaaaacgtactcgtaaatatcatgattgcttcattgctagtaggcggatgaaacagtgggagggttctgatgcagcggctgcggcgctgcgccgtgcggggtatgtggcaggcaagcgaacaactgaacagggcaagccccaccggcgctgttccggcgacccggccgccgggccctgtgggtggagggcacgtgacctggccccagcttaagtacgtccgcgtggagcatttaacacccacgcgactgctgctgccccccctgggccgggccgctcacaacgccccctggtgggcccgcacgctgaggctccggcccccaggccccgtcgccttgggcccaagcaggatgccagcataggattggacaggtgatgtacacggtaagagcgataaattctgagcgagaagggaacgcggcattagacgaatgtggtgagtgtttgggttaaaaaggtactagatcgatccgagtttggttcacgacgacgctagccaaagctattaagcgggtacgcgcgcacgatgtataatgcagcatattgttatactctgctgctacatatagctgcagatcgatgccctggatctcgaatacgtgcgtggggttcacgaccgtgtggagctcgagcaacgctacaacagaggtagctgtgcctgtgtatgtatgtgttatacgccctgttacgtttgtctggatctcgatcgtcgcgtgggcggatgtactgtgaggctgggcggttttcggttttcaggtggacgacgcaggcaggaggcagagcggctcgcgtagatctgggaaatgattggccgagcgtcctgctcggagttgggcaccggcagcggctggtagctagctttggttccatgccgccaaccaatcctgcaacgagtccatccaactctcttctcaaacgcccccgatcgacgaggcgttttgttctgtcacctgcacagctgcgctgctggcctgcggggtcggggccgatcggggcatgtgtgtacgtgagccccgtttcgcgtcgtcgtcgacaccgatcgagatgagcagcagcaatagcgagagcatgcagcagatgcatgcgtagctaagctagctaacttttggcaggcaggcagtacaggccggaccgcgggagtcagggaggagagtgatgctgagtagtatagtgagtatgtggtccagctgcgtgcgtgacatgtcaagttgtttcagcagtgcaaccactgtgcaagcagctggaccagtacacatacagacaggcatgttagacgccaatgttacgaagaaaatatcgtcgattgatgatccaaagtttagcgctggtttaccaccatgttcgcgcgcatctacgcatgcagagagtagcgtgtgcaacagcgacagcgcccgcttaatttgtcccttggtacgtactcctgcatcatgcgtgcactgctccaccagctgattgcacaatggagaggcaaacagaaaataaagcgggttttagaccgtggtttttgttctcttctcccagatgaacccagcctgaacctgtgactgctccatagtttcaccatgcagctggcatttgggctcccagtcccaattggccttctcatggcgcgacacataggcatggccacctaatcgatccatcaagagatcccttagcttcaaacttactaccttcccttctttcaactgtaaagttgcttccatgatgctggctactggtctccactgctttaatgggttctattccagctttttcccaaccatacatatactatacacttatacagtacccggcttttgaatggacgcatttgcatctggatcaaccaatgcaaagtctgctcaggagcaatgctgaccaatcagccaatcgcccgtgaacaattttagtgagaaaagatgaaaccgggatcttatccttaccataattattgcagctttataaagatcataccaatccaataacctaatcagtatccctctctaaaggcaaaagggaaggtgagatcttgatcaggatggtcaatcacccaatgatattgctggttacaaggcaattagggagggcatgatcaacatgattatgatgacctgttttgagccacaagaatccatggccgctatcaggacgtctgtaaaggagactacataaccatatcaagactttaactttatcccactttgaagaaagagagtgtgagagaaaaataattacaactggattatcaaatgactcatgcatgttgaacatgagttgagttttgaattatttgtagcaggttacagaagtctgatataagtctcaaagtggattacagctgaatttaatgattaagcatggtaaagattgccacaagatccaaggctaaagggagtaagtgcaagaaagtatatggtactggtccaattgacggctcatgtgcatctgtggccagatctagataggtacaaaatacaaatgtacaatggtacacagaactgagaaaggtgggcagattgtcctagatgatggattttgacctgtcaagtagtagatgccttcccgttgctttatgcgttttgattgggtcatgactcatgagacatttcaagatctacacacagattttctttacaagctatatatttttcgttcatgaataatactactaaaaacatttttatgtgcccgcttagaacacatggatttccaatgaaataattcagttcgtcatggggcagaaaaatcccagcggtttgtcaatgcgagaattgtgccgatgcaaattggatggccaggaattcttacacggtgtgagttagaatcgcaaacctaaatttatcagttatatgtatttagagttgtgtatactttacacttgtattacagtcggtggccagctaggcttgccaactagtgcaatcgtgtaaagttcgccactctgtcaatatgtacctgctgcccaacaaatgttaagggcctatttggtttgattgtcacggtgaccatggaaaaatgttggcaaagaaatcagagtttcagggacaacttggtttgatactaaattatgctaagtcattcgcctttttttttcatccatttttcagatccaaaaatggccaagacatgggcagtcaacttggcccctgattttggtttcccaacatttcgcctagctttcttgggcttccttggagccaaactaagggcctgtttggtatagctccaactcctaaatttaactccaggagttgggtctagagtggagttatggagctgcctaaacccagctccacaactctagttcattttgtgagaaacctccacccagctccactctcagttttggtggagctaaaactgtttggctgagctccagctccaggaggggtggagctggagtgtagctgaagctggagctgtgccaaacagaccccaaattatcttaagctgtagtagtacttgtctgggactatttaatcacaggatgcctataagcaaagtctgggctaggctggtaaaagaggcccagttcggttcgggcctaaaatatctgccaaaatctgggccggtacggtgaactgggcctaccgtttttaatccattctccggcccagctaacttcaacaacacaaagcccaaccgctgtaccaagtgatatcattatcaatttatcatgacaatgttcgttaatccctttttttagataatggagatatcactgagcaatggttaatccgttctgaattctgatagacatagaggctgcaactgccagagaggctaatctgcaaatgcagagttgctgggctgtttctttccacctacgatttaggacaggctacaacactgatcttagtccacctgtccccttgttgcttcgaggtctccagctgccgctgcattctgatatgcctgtgagtgacatcaacagcaacaatcaagcagagaatgggccatgcctcgtggtgttttgcttaaccatatgtctgcaaaaaaaaaaaaaagttggggttttgagtttttacctcgcggctcagcttgatgcgcaggttggcttgcgaggagggagctggtgatgaggcgttctctgaagataaaaaaaggagagtaaaaataaataactagtatttttcttttaaaatttcacagccaacaattctggaacagtcattgttttactgaaccttgagcttgggcttgagagtctcaaccgcggcctttgaaccgttgctgtttgcagcttgctgaaggaactccaggatacagggttagattcagtctgatgacatgcatgcctgaatattggactgatgatttgtcatttaccttgccaagaacccagtctgcggaatcaaagtaggcgcgctcatggtcctgcattagcaccaggccatgcagccaaaggaatagctcagattcgctttcagatatttatcatatactagtactggatagtctagatgctgcatttttttgaactaactactattaccaaaacttgcactcccatcagactacatactagtactacaagatatcggtatgttctttatctagtgagttgaataaaaactgaaaacttgatacagcaataaataggatttgaacactatgaaactgtaagactgacaaatggctacaaaatttcagaaactgtatacctttgaaatcagaggcttctttggtgcaatccctccatacttcttctcaatgcacgcctgcaattcaagatcacactctttcacaaaccccaaacacgtgcagaacaaagagaacacccccccaaaaaaatcccatcttgctctgactgaaagcagccggaaacactgaactttactccggtgtactaagtgtaccagagatgaggcttatccgttcgctcaagaggccaagagggtcaggaggacacttcacttctcaatgccggtgcagtgcagacacagacgcgggcttgtccacttgtccagtgaaccgaacgacgtgacaaacacacacacaaaagcaca

SEQ ID NO: 41014 - DNA, 18518 bp, Oryza sativa
ccgcatggacggccgtccctttcgatcgcctcaaccaagcggaggaggaggggagggatcacgcttatgagacccaacaaaatctgcacagcgttttgcacaccaccaccatcgtgtggctgctcttgatccacccaaaagcaacatgtgaccgatcgatctagcgatggcgatcccctaacaacggagccgtgacaacgacacgattcctgaagccgttgagcgcccccggttctgttcctaccttcgctactgctatctctcacgcattgcccatgcagtattgcagtcatgcagatgctggttagttgcagtgttgcagaggtgagattcgcaggatcggtgaaagaaaaaaaaaagcagtggagaaaaatgcaggtgttaagtagtagtagtagtggtcagtcatctgtgttcagagcctcagagagtgcttgcagtcaaatagattcttgggttggaaaggagattaagatcaggttgaaagtttagtttgcctttttcgtcattcattccttgctggtaattaattagttttggtgtgtgcggctaaagtgatttcttctagatgcatataaatctaaagtagtgcgggtaaagggtagtaattgatagtgcagaatctttaattgctcacaggttttggagagttggtgttgaggacaagttaattttggtgcacgttaggtaatgttctggtggttactttctttaaacagattaaaaattattaactagttaattaagttcctagttaagatagaattaagacaacggcaaaggaacaatggtgacacaacaaaaaactgaaggtgatctttactgacgaattaagcacagttggggtattaattctgaaggcaagactgttctcattttccattagacagaaaagagagacaaaataactctacaggctcagggtcacacttacctcttcctccattgaagccaacgacttagcttcatcacagcctgccatctcctgtactcctctctctgtcttctctgcaagaaacaacaccacaactttcagttcctgactaaaaacataaaagattaaacaagatggtgaagcattttggcctgaaaaggagaaggaaacaagtgcaggaacttcttgcagaggtacacaaatgctgtaagagatgaaaatttcaagctttgggtgattaagagagacaaagagttaaccttgtgtgctccttcgtcagggaagatggagaggaggttatgaaaggcaaggagaaatgaagtgtgggcagagctgaacctgatatttatagagagcttgtacgggaaaccaacgaaggcccggtgcacaagatacatgcttactgtatgttagtacaagatatgcatatattactcacgtttctaatccagacaaaagtatcttttctttatgacgctaggagcaaatctaaagctggcactattcctcaatcaatggatagatagggaagtcatcacacatcccatccaaaagtttgagttgatgaataggggcggaaaattcactatatactttaagcaagctgcaagcctaatatatatgtgcaagttttatagggttttaggtgtgaaatactcctttcgtcataaaatatagacgacatggagggtctataagttaattctactccctctgtcccataatataagggattttgagtttttgtttgtaccgtttgaccacttgtcttatttaaaaaaattagaattatttttttttgtgacttactttattatccaaagtactttaagcacaattttttattttttatatttgcacaaattttttaaataagacgagtggtcaaacagtgtaatcaaaaactcaaaatcccttatattataggacggagggagtaatttttttaattgcatcagctagaattcaaacttaaaacctttttggctctaatacagtattgagtcgtatgtactagttagtttgtttgaaagttgcggatacacggttaagaatggactacccttcgattgtaaaaatttacaatccatcatttagccttcagtttttaagcacaagaaagaatttgaattttaaatcccttccattgtggaaatttacaacccattgtttagccttttgtttataaatgcaagcaacaatttgaattttaaaacataattttagagtcgatttcgggttttttttcattgtattttgttttctagcatttcttttaaattactaagaacacatataaatatttcaaaattatttttttaataataatccattttgctgataataagtataagcataatgacgtggttgttatataccttgtgttttaataatttattatgtagcggtcatgttattaaaaatcacacaattgagtagtctttaaccatcaaaagcaaatttatttttcctaaaaaaaatgttcctaaaagattgtctttttagcttgaaacattgtctacaaaattagagtgaagtctaaatttggttgggtacatggagctggatgggagatggtcgtccaatttttatagtgttttgttagatgacagtgtgggtaagacggtctagaaaaaaaaattctttcaatatcctccatcgtccttgtctcatcctcctccttttttcccctccttgttttcttcccatattaaagaagggtatagtctcttgcatgctttttgcgcaagattgcttggtctcgcactctccccacgcgagaccgctcggtctcgcgccgtccccatgcgagagcgatcgcgtcgccatgtccacattactttcgtgcaacggttcagcgataccgacggtatatttatgctaaaaaaattgcatccataatatttttgagaaaaaatgaacaatatattttcaaatttagttccaaaaatggcttgttttcatgactggatagaataatggcgtgtttgagacgagggaaaagaactagattgagaagatccatacgcaaactaaacaagatgagctattagcgcatgattaattgtgtattaattatttcaatcttcatgtgatttttaaaataactttgtgttgagaaatacgtaacgtttagtaatttgaaaagcatactcgtgaaaacaactttttttctctttctcataagaacgaactcagcttaatataatatttttttaagcttatgaacttatgaattatgcgtacatggttcaccttagggggtaatatgaacggttttgcaaagtttagggagctggatgtccagttttaaagtttagggtgctagatgaacttctatctaaagtttagggggtacttggactttttcgttttataaacgtggttaactaatgtgtgcaagtttgttatatgagagatttggcgagagacatgtgagatcgttacagatctaatcaacgagacatgaagatttttgtgagatgtgaaatctaggcgtgcgcacgccaggtggatctaatagcggacaagaatatatgggtcaagccaacaattagaacacctgtaaagctataaaatgacctgattctagtaaaaaccctatatcaatactactccctccatcctataaaaaaccaacctagtatcggatataacacattctaatactacaaatttagacatacatttatctaaatttattgtactagaatgtgttatatctaatcctagatttgttttttttatggagggagtactaattaagtagatgtggttatgtatgggtcgactagacatgagtctacttaaatgctcagaaatatcagttgattgattggattcatttcgaatggttgtctatcattctaacctcaagactacgaaatgagaaacatgttctttattctctctttctcatgtcctgtgctcatatgattttacggcattacagtcctaattaaagaccggattctacatttctggtaggtgaaatatacaattttacggttcttttatatgattctataagtgcaatcctatctggagacctctaatctggttcagggtcatgatttttaaaaccttgcctatgccgaagagtttcccctgctcttgttagctcaagccgccagttgcacagccgttcccgcttgccgcctcctcactcagtttcacaacaactccaaccctacccattgctaaactttctctgtttctcacccatagctcagctccgaagatgcctcaccgtattgcctaaatattgcccagtccgccactgcctagagctacctctaaaccttgattaaggtggactctcttcccttccctccccctttatctcacttaggtgattaatgttagcaaggtgatgcataacttcacccactagaatttaaatcctagtagccattaatatgatcgtgtgcatccttagttagtgtagagattggaagttatactttcttttattaaaaaaaatgcaagggtatataataccacaacgaattaggagtttctcaataagcttactgttctgtagtctattagacttctcttctccattgtttattttcagttcacctttgccctaggattccaaaggcattcttcaatcgctctcttccaaattctcttgctttcttctaccctttcttccacctcactgtaaatccaactcaatgtttcctagcaactttgcccatatggctatatcctcatggattcttgtctctgcagctttcatatatattctcccattatctaattcgcgcatgctttgtctccccttatccgtgctccgtgcatgccgcagtgtctccggatggttggctgctggagctttgcctggtacgccgacaggtcaaaattctggtgagtagctatcttggtgtgtgtcttttatgtgctccaaatcttttatatatgatccatatgaagttataaaacgatagtgtcggcatacgctagggagaaatatatgtgtgcatgttatgtgttatggtcattttgttaagttgtgcgttcgcaaaatgaataaatgatcatttttgttgtgtggtttggtagggtaaacccctatcagtcatcctggtgtaaccctattaacaagagcgattagctctcacagttaaattacacacgcaaagcaaccgatatggcgatcttggaaggcaagctacatacatcgatctatctgcagagtagttgaaaacttgaatcggataacaacatcaaaagtccgtactccgtagcttaagctagacagagagataccgataatgcatcgattgagaatgcacaacgtttggcatttcccctatttgtaggggaagatatgtgtactcagtactcccttcatactcgcaaagagagtcatttaggacaatatttaagtcaaaccttaggaatataaatcatgaataactctaaagttgttgagtttgaaaatgtaaaaatcatatgaatagatttgtcttgaaaaatactttcataaaaatatacatatatcactttttaataaatacttttataaaaataagaagtcaaagttgtgtttaatttggagaccgtgtcgatgtcctaaacgacttcctttatgagtatggggggagtattaggttgagcagaactaggcatatacaacaactaagatggttgttgtctacaccctccatcccatattataagggattttgggtggatataacacattctagcattaagaatttagacagagccttagtactaagaatttggacatgggccatatccagattcttaatattaggatacgttatattcacctaaaaccccttataatatgatatggagggagtaatatatttctccgatggtctattgatagcactagacagtacccataaaataggctctcgtagcaactaacaaaattaatgcgagttaatcaaattcagattagataatctattcagattagataatctatcactttgtttcgttaattaggattaaactttgatcaataattgctttattaggatatttaagtgataaaaacataatcggtgctcttaatagagtaatggttggtcaaagtttagcctaataagacaaaatatgacctacttcctccgaaaaaaaaaagacaacctaggaagagatgtggcccctcctagtacaacgaatctggataatcctctgtccagattcattgtactccttttttttttgagacggaggaagtatattttttggatgagagagtacattataaacatagctataaaataagctatgacatttattatggagacctataattcctgacggtaattgtgaaaaagaaaaaaatatttgcaccattagatcatgatgggtctagattataatggcatatattgattaataagttatatataaatacaaaagctcaaatttgtatatcaaatcaaactctactttttagaaatatacaaactataactgtatgaatgaaaacataagctaacaattgtatataatattcaaatatattttcaaaatttattaattatgtagatagaaactgcacttgtatttatggaaatagaaggcaagggttatatatcaaattcaatttcatctttatatagtttcgtgccatttgctcaagaaaattctctaattatattattattatggtagaaaaaaagctgccacatttgctctggggtctaaaaatttgcacgttgattgaagaaaaagataaatacttacacaaatattaggagtcgtataccaaatcaaattctatagttagaatatattgtatacaaaatataattattccatggatacataatctcaaagttacatgtcaaatacaattcaactttaaaatctattagctccgtgtaaatagtgctaaaaaaatccgctagttgctttcagatagcgctgaaaacgacttatgtcatcaaatgcaaattagcagaacaaaacagccctgattgcgtaatttcggaatttcaatatcccaagaagaccatcattaaggtagaagatattatcgctctgctttctttctgccgttcctttgaggagcaccattcaccaaagtgaagaatctttacgtctcttttcctccgagtcctctcttaagtcttaacgtctttctcgcctcactcaaagtcaaatcttaccgtatccatagactagacccaaaaacaactggacggaatatatgttctgaatttctggaggacatggtggagcccacacatctggtttcagatttgccacgtcgactcatcatatatatgatcaaacttaacattgaaactgtacgatgtcacgcgtgtgaaatgtttgggggtgtgtgtgtgtgttagtttttagttctttcagactcatttaacatctggttcttgttcttcgaccaaatgcggaatgaatttgagcagatttttcagtcttgcacttgctctggtataggtaattcgtgcatcgccttacggccttaccgtatcaaggttattatttagttacaagaattttagtatttttaggataataaaaatattttacatctccggcatctgccgttagacatataatcataacaagcattttagttgtgtgaatcatagatgtagagataatataattcatcttattaaaaaagggagatcgattcagtatccaagccaaaaattcaaaattaaaaccccacaagaggttcttccaaatgcatagtcattctagaaatttaatttgaacagaattaattctcaactaaaatgttttagaatgtgttgcaaagacggcgtgccaacgggcgcgctactttttctagtgtgaaactaaccattgaaaaaatataactgataaaaacatgaccctttattacataacaagaaataattttataaaatactccctccatccttaaaaaaaaggcaacctaatattagaatgtggcacatcctaaagtagtttagattcgttttactaagataggtcacatcgtaatatgagattggttttttttacggatgaagtatatgtcaagctaacctgtagcatttaattatcttataattagataatagaaaatgatctagtaagtttgaaactatgagggagtttacagtgcgctggacaattttacagattctgggctgctatttaggatgaggaacttcgtaagtaacaagtctcatagtgcgaaatccctatacatattatttttagtgggtcccacatatcacaagtcacttttcatcaacccctcctctcctccctgctttctcctgataaattttgaggaggttcggtggccaaataaagctctccgttcttggctgctcctccctccataccgatgatgccacctcaccgccctgtgaatagcttgaagagacattttataacagcaacactagctccttttcccgggtcttttcctgcctgagagactgagagctgagaccgctggctgcttgagggaataatatggcgatgcgacctgctcttttgacgatggattcgactgtattttccagctgtgctgtcgactaggaatgctgtccacgtcagcgccgcgccgtggcgacaaacctctggacttggcgttgcatgttgttgcggactgcgcgaggcactgcgaaaaagaaaaggcacttttgcgctttgcttaggaataggatagcaggtacagtggagatcgaggttgctggatgacgtgtccttgcccttgtggcttagtactgctgccgaaaattgacacgttggtgattggaattggactggctgctcatttcggcctagctagtcctcttttgacgtcgtaggccggaaagcgaaaggtgaaaagatgccgtaagcatcacctaacagtatctctaaatgaaacccgattttaaaattaagatttattttatgacaaacttgctccaacagctttcttagagaagtttctggaaattagaatcccttctcctcctttctcgccctccacaaatggggagacgctcttgctcccaatttccacaccaaaaaaggaggggcgccacgcggagagatcattagcgcgagaagggatgggcggagttattttttatttgtgtatctgttggtagttaagaatgggtccactttttatagggagttaatttaatgtacctattggagataaacatcacttacatcttaaaatcaaattaaagattccaaaaacagaatgttagagacagatttttgggtatctgttgggcatgttctaagggcgttcagcctgagtaccacatcatcaattccacgtcatgtatgcttcacctggtgccaaacgaagaacacagaacctaacaaagacccgcgctcctcgtcaatggttgtcagagcgggacagcctttgcgcgttgctactgctgacaaggtttcacgcatggcaaatgaagagaagggaggaagggaagatggcagtggtcgagctgttgccactgagacattgtcttcgagccgttgccgccgacatgctgccatcgcccgaggtcgatctgaagccacctctctcgatccgcgcaaccaatggcatggcaccgccagcaacttggcagccaggggagggggatgtgaggggaccgagcggaggtgaggatgtcgtcggctttatcaggctcccaccggatcccccaaggtcgccagccgagagggagctgagtccgagccagatatgcctcgagctccaatccggcgggaggataggagctcgacgacggttgggtgtggcgtcgacaggagctaggcggcggttgggtgcagcggcgacaggagctcgggcacaattgggtgtggcggcgattaggtgtgaaggtggtgaagcggcggcaccccaaccccgacggatggatctggctggcccgtcgctgctctgcccggtgccgtcgccgcttgggccactgcgcccagcgccttggcttcatctaccggtggggaaaggaggagaggagagagaggggggagatgaagagtgaaggagggagggagggggagggtacttgtgggatccactgtaaataacttgtattatggagcatgtagctaaacatgttcttaatctatgtagtatgtgaggttcagcaaatctggagacacactgctattccctaaatactgctcttttagattcaagtaaattaggcttgccgtacacaaatttaatataatcatattaccttcattctctttcgtatatcatttttcagctgagggcatacttttttctcaatgtaacatagatacatcatgaggcaacaagacaagggtgaagtgtgggtattggtgatcttaagtactagaatgagatgtgtgctctagctaaggcggaccacttatttgattttgaagcaaaacacactcactagccaagttgctatagcaatacgcttttttttttcaagtttcgatttcaaccttactattctaacaatctatcctcaaggcacttcatcctgacgttgccgtcttgtagcagtatagtactcataggttagcagttgagatagcaaatcaacacaagggaacaagttggcaacagtgttcattcacctgcttttgtattatttcaagctctttaaaaattcactcatcaggatcaggtgtgttcgtgatataaaaatatgagtatgagattacagtttacaacacggtcctaaaattcgtggcaacgatgatgtgacgatgaccatagcagatacagtaacaagagttcagttcagagcgcagcaaattcagagagctcaagattgatgggctcacatcctgctcttccggaccgggcccaattccttggccttggccctcagctcgtgcttcttgatcttccccgtcgccgtcttgggcagcggcccgaacacgacggacttgggcacccagtaccccggcagcctctcccggcagaaccgcatgatgtcgccggcgagtgccgcctcgtcggagctgtcggcgccgtccttgggcgtcacgaacgcgcatggcgactccccccactgctcgtcggcccgcgccaccaccgacgcctccagcaccgccgggtgctggtacaccgccttctccacctccaggctgctgatgttctccccgccggagatgatgatgtccttagccctgtccttcacctcgatgtacccgtcggtgtgcttcacgccgaggtcgccggagtggaaccacccgttctcgaacgcctccgcgttcgccctggggttcttgaggtaccccttcatgacgccgttcccgcgcatgacgatctccccgagcgtcgagccgtcggcggggacgggcgccatcgtcttcgggtcgacgacgtcgaggccctcgaggcccacgtagcggatgccctggcgggcgtggaggcgggcgcgctcgtcgtccggcagctcgtcccactccggcttccacgcgcacaccgtggacgggccgtacgtctcggacagcccgtaggtgtgggtgatgcggaaaccgagcttcgacatggacgcgagcaccgacggcggcggcgcggcgccggcggtcatgacgttgacgacacgcggcagggggaggatggcgtcagccggcggagcgttgacgatggtgttgaggacaaccggtgcaccacagaagtgggtcacgccttggttggctatcgccgagaagatggcctttgctgtaacctgtgatgatggcgaacagaagtgttagtgaatcaatttctagtttgctactcctagccagcatcaaccatcaagcaggtaatgaactgggtaaagtcactaggcatgaacaagagtccatccccaacctaatctatggtatcaaattcattcatttattatcttgcaacttatgactgcatcacaaacaagtccatcaagcacacctagtcctaatgtctgcatattcatttatctgggaggcaaggaactgatgagcatttgtgtactgaaaaatacccccatgagctagcagtacaatagaaagatgaccagaaattggcttcttaaatttcaagatatataccaactgaactaattatcctgaattccaccctggtattattgcagtaatgcatcagttaacaggacttgattttcatgtttatatgtctttcacgtaacaagtgaacaacttgtaccatttcactgcaatgctctttagagttgaaaaatgaaagtaacattgataatgtagtatcaggactagtttaaatttgtctgggagtattcatacttgaatgacgcacttttaccaaaaaataattcattgcctctagtccttatggtaattttgtagacatgaacatgttgtgaaggttattgcgttaatctaagtaatatatttgctaatgatatgattgttgtctcatacttactattcatataggttcgatagaaataatgaataggtctcaggtgtacacttgctacttcagttttgcagattgttcatgttccacatgaatgctcgagtgataaagttcttactgaagaagttctagatatagcatagcatacctgacgaagacaaatgcttgttccacaaagagcagcaagtgtccatgtatagcaccagccattacagtggaacatcggcaaagtccacaaataaacagcgccttcattcattccccataccagagcaccactcagtgacattaggtaagcacccctgtgatgcagtaccacgccctttgggttggaagttgtcccggaagtataacctaaggcaatactcttccattcatcctgtggtggtttccaggcaaattcaggatcgccagtttccagaaactcctcatactcaatggctcctttactcaaagcacttttgagggacacgggatcacaagtttgatcaccaataacaattagaagtggctgtttgaaagctcctttcttttgctccgcaataatcctcagagaatcctctgctagggagaaaaattcctggtcaaccatcacaacttccgctgatgagtgctccaagagaaatgcaacagtaggagcatttaatcgaatgttgacgcagttcaccactgctccagccattggaactccaaaatgggcctcatatactgctgggatatttggagctattacagctacctaaaaaaattagaagaaaccagtaatcagtgcaaatttgatccaatatgttgtgtgcatgcaaccacagaggttttagctagcacaacttagtcagatgaaagtattggagtatcacataagaagatattattgtctgccatatgatttctacaataatttgcagcagacagttgtaatcttctcatgtgcatccaatatatcttactggatttggaaggttcccatttcccatcagcatcaagagaaagaaccattcagtttccattgagacatagcatggtaaaaacctaattttcgttttgacaataactgatatgttcaatcttagcatgtgtttgttcaattaaaatgcataaaacacatgcattggaaaaaggacaagttttaggatgcacacatctgaggactgaagaagcacattatgcatactacatctaccaccagtctaactacatgatgggacctgccctctgtttttctcggcctatttagttcgcgaaaggaaaatttttgggtgttacattggatgtttgaccagatgtcggaaagggttttcggacacgaatgaaaaaactaatttcataactcgcctggaaaccgcgggatgaatcttttgagcctaattaatccatcactagcacatgtgggttactgtagcacttctggctaattatgaactaattaggctcaaaagatttgtctcatgatttcccccttaactgtgcaattagttttttttaatctatatttaatgctcaatgcatgtgtccaaagattcgatgtgatgtttttaggaaaaaattttggggaactaaaccaggcctaaggaaaacagtagggcaggatctatcatgcatatcatgtgaagatattctaaatttcttcttggtccgccatggattaccatggcaaactcatgcttgatagttgatagtaatagtctttaaaaatcctgttatttgtgttaatccaaatgctccaaagtccaaactgccagtataatggcatccgtataaaaaaggtttattgatacatgatttcaaattgacaaaaggcttcttcagtacgcagattctgatgttactgaaatgaagtcccagcattgggaggtgaaagggcaatatattgctgtccaatgttatctcccacccttcattagaaaaataatatgctgcgtttgaaacctgaaaattgatttccccaataataagccttctcctttattgaaaaacaagtcttttttttgtgttcttgaggggaaaaaaaagttgtggcacaaatttaactttttactgctgccaacttggaagcttcatgtgtttggggtgtttgactttgacatcgccatctccaggattacaggggcacacagaacagtagaacactaacaggaacaagtagagggaggcggaaacgaatcggagaacggggaggagagtgggagccgtaccgtgctcccgtggccgacggaccggcgctcgagggcggaggcgaggcggcggcatcggcggtaggtgtcggcccaggtgtagcgcacggggccgtgcacgacggatgcccgcgccgggtgcgccagcgcggcgcgctccaggaaccagagcggcgtgagcgccgtgtagttggcgcccccccgcggcaggtcgtcgatgtccctctccgccgccatccccgcgatgctctctctctctctctctctctctctctctctctctctctctctctctttctctctctctccgcacgcacgcattcgtttggggtggcttggttaggctttgactgggcaccggtaagccggacaaatggaagatgatgccccaatggttttttaatattcgttgaaccagcgtgccgccaaccaaggccaataagaaccggtggctggcctgccgaaggattctggttgttggtgcccgggccgggaaggaattttccaagtttttggcttctagggctcagcgcgcggagcccgacagctcgcgcggggtggggaagttgtgaactggtggtggtggtgggtccgtgaatcgtgtgagttgagaaattcctgttgctttttaacgttttttatgtcgcctgcagacggggccggcgggcggcggctagtatggagatctcgcttcattggtgggagaatgcccgcgcgcccatgccacccacccgtgtgtgatgcacgatttgcaggccacgtctcacgtgctgtcagtgcacccgtacatgtacaatagtattcccacgtcgattttgctatacactaccccgtctcgaaaaaaaaaaccttaacataaatctgaactagtatgtatccaagctcataagctcatagttatgattgttttcttttttgatggtggagtatgtaccaacaattatttttataaaaatttaacaaatataaatatagtacaatcacaatgtaattatattgtaacttgcatgtaattgaacagttcgatttgcttttaaaattcatgtgaggggattcggtactattatactttcgtataatggtaggaaataatcacaacccatgcactaccattaaacctttgttttcacgaaaatagcatgtcacctagggatttttaaaagttacatataattaagttacattataattacaagcaatttataattaaattatatcacaattctacttatatgtacgtatgtgaaatttttgaattaaaatctgacgacaaatgtatagcttatcctattttctgaaaaatatgagtattcaagtgaatatccatgagtccccttggcccgtccatgtggacacgtactggtatttcctccaaatgattttggagttactaaatttatgtccatgcgctgcaatagaatcacaagatagaaatatgattcgctttttttaatgtctgtttttcacgatgggttatgtttctatggctttttgcagtttttttaaggggaggggggttttgagaggaaggaggacgtctgtgctttttaagtactactgtactagttaagataagatgaataacataaaaataaaaactaccagtacacccttaccttatcacgtatttgaatgggtacgaaagatgtttaggttggttgtaacagaagtttcaatatattggcgcgctggttctacaagggcgtacgtgaagctacataaggcacatgtacttaaaataagtcaacaattgaagtttgactagtttgatcaatttattagtcctgcaattttagctataaatgattctaaaaggatttttctttttctgaattcatgtaaaatttaaaattcataagcattttagtgtcacgtcatccaaaattatttttaaattgtcatggttgtgcactgtagaagtttaggatcaaaagttgtctggatataaagttcatattaccttttaaatttgaaaaaaaaaaggctataaataaatttccaatatataaagcatattcaggagaactagttaatgcagagctgcagctacgctacagccgtagctacaacaactgcagcgggctgtttgagtgggctgtgcgcaacagccttgcacaatccaaaataggggtgaaaacggagcggattcaggcggatagtggtaatataattttttccttaaaccatattttttaagcagatgaaaagcggattgttttggatgtcggaaatagtgcggagtagatgcggaatcggtttggaagcggattaaatttatcggatgttacgtgtatgcaatcaatacaatatcaagttagcaatacaaagaacaataatatagtaatcaaataaacgacccatcgtaataattacgtgcttaagtgctaaacaacatgaatacatgatgtccataatataaaaatacagttacgcaagtgtgatatgagacagtaaaagcctcaaactaagaaatctaggttaattgatgaattatgccattggatggacgaacttatgttatatgcaacagacaaagtggttacatgtgttgataatttcggattatccgatgaaacgtcatataggataattcaacagaaatgtcggataatccgcatccgccggattttagagataccatattctcatccgcatccgcatccatatccgtcggatttctaaaagctcataccgtatcctcgtttcggacggattcggatcagatattatcttatccgttttcaccacgatcccaaaatgttgtagcttggccgaccaaacatgctgataaaaatgccagtcaactaatgtatggcttacttcattcattttaaaataagtttttttttcataatactacatccgtcctattttaagtgcagttgtgggtttccgtgtccaacgtttgaccgtccatcttatttaaaaaaaattatgtatttttttataaaaatagtcacacataaagtgtattaatgctttacgtatcatctaggaacaataaaaacattaatcataacaaaatttttaaataagatatacggtcaaacattgaaaataaacaatacaaaactactatctttgagacagaggtagtattattttgttcatcaatcatctacaatttaaatttcttccatcttagtatcttatccgaaccagtatcccactattaaccacacccatttaataaaggacatataactttttttttcgaacaataatctttactaacccattaaaaatggtacttattatgggagtttctcaatattgttagaagttataaaagttttaatttattttaagatggtagggagtatgatagcagatagaatgcatgttagacggaaagataacacttctccacttgctgtgagtcgaggtctcgaggaccaaaactcaggagaggagtatatgccgctggtcacattccctcaatggcacaccaacctctaaagtcaaaacagtactgagtactcctaatccagtgcgcgccgttcgtcatcaaaagattagcttttctgactttctccattgactcgccggccacttttgtcctatctcaagccctggaccgctgtacggatgcagacaactctgtgtgtttggataatggaaaatggaaggtaagattaagattaggaaatgaataaattgttgaaactaaatggaggaggaagaataaatggttaaatttaaagatgaatgaaaaatcatttcccttttccatttgccaaacattgccagtgagcatcacggagaaactctctcagtacgcagcagccaacggcaacggcccaggaataaaaacggaggagcgacccgcgaggccgcgactcgcgtcgaagaaaccgcaatttctacgcctgctgccaagccgcgctgtcatggtgtcacctcgtcacgccaccacgaacaaatccaagcaatttgcgttttgcggccggtgagcgggtgattcgtccatccacatggtcagaacgggacgagcaacgcaagcatcagcacgcgactctccatctcgcctggatcaagtcaagct

SEQ ID NO: 41015 - DNA, 1041 bp, Oryza sativa
cgcgcggtccatccgtcgcagcgtagcactaaccaactcctctcttctctctcctgtcacaagactgtgcctcaccgctcgaacgttcggatggggaccgtggtagattccacccgaatttatgtcccgcgggagcgccggttttccccccgggatcgcgtctcgcacgcaccggtttcgctgctggtggggcgcctggtttttgcgttccgcgtgcgcgcgcgctggctcgcccatgggttggcgggtggcgagtccgcgacaggtgggccccaccttgtctgcaacaggataaggacgaaaggccggtgccacgtggcgctaacgtgtctgaatgctacaacggattttccgtttggattttgatgggcttcggtgatttattatgggctggaacaccgaagattcatcgcgctgggccggcacgaaattaacgggctaacatgcttgtatcagatgcacaagtcagcccattgaatccaatggttgggtggagtaattagtggagctaatcatgttcgtgcgccccgattaaacgccacgacccgcaaactgcaaacgagctcgccacacagcgtccacgaccatggctgccgccgtggtagtgcaccgcacgtaagccatgcacccacgccgcaacaaaaatacagctccagcctacgacgccacgaacagataaagcactagctgagacatctaccggctcgagctccggttccccggccggcatcctgcgagcgaccatgtcgacggtggcgacgcctcgcggcaggtcgtcccagcgccggacacggtgcaagtgcgccggtggcggcggaggcgaccgcgccgcggcgtgctgcttcaacccgctgaggtccctcttccggtgccccggccgcggccgaggccgacgcagccgcagccgcagccgacacacgacgccgtcgaaggtccgtgacgcgtctgtcgcaggcggcgtcgagcagcagagcgaggagccgtccttcttcgtctacgccatgccgaaccagggcggtggcgacggcgtcaccgccgacc

SEQ ID NO: 41016 - DNA, 732 bp, Oryza sativa
ccactgaaatttgaagaaattggaaccgtgccactccatcacgttttccgttagacccctagacgcgggacccacatgtttgttccatcttcctccatcctccctcttctgtcttccctatctcttccttcatgccgcgactgctacaaggacagtgacaacgacagcggcggctctcgatccctcccgccacggatggtgtcgaggacggtagtggctcctaagccctcccgttccagatggtgtcaaggatagtgacgacggcggcagtggctcccgaaccctcccgcgcggatggtgtcgagggaggcggcggcggctcccgagccctctctcgcggatggcgtcgaggagacgaaggtggcgatgcgggcggcggcccccgagccctcccgtcgcaaatggcgtcgaggatagcgacgacagtggcggcggcggctccggagccctcccgtcacggatggggtcgaggacagcgatggcggtggctcccgagccctctcctgcagatggcgtcgaggatggtggctcccgaacctcctgtcgtgaatagcgttcaggacggtgttggctcccgagccctcccgcgtcggatggctcggcggcggtggctcccgaaccctcccgcgcggatggtgtcgagggaggcggcggcggttcccgagccctctctcgcggatggcgtcgaggacgaaagtggcgatgctgccggcgtcccccgagccctcccgt

SEQ ID NO: 41017 - DNA, 1882 bp, Oryza sativa
  unsure (1)..(1882): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggttgatggcattaagttataacttggttatatcacagtatgtgactcgtaagtatagaaggcgcggcaatggatgtgtcacctttatttcaccaccaatatggcatctaactaaactcaaccattcaatattaaagcattgtgataacaaatcttgaagatccttctgagtagatcgtattaagtgaaggtcaagattccttaggtttagaaaaccactgaaatggggaggtagttccaaagatgcaaagctaagctgaatatgctgtagacgggagatgcttccattgtcgaaacgctcaaagggaaatctgtatcgatcaagaagaccaacaggattggttggcactaaatcaaaagccattttttttgtctgtgatgatacaacaaaatcaaccaaaccattgaggtgatcaactagcttgctgtcgaattcaaacttcacctcaaactcttcaacaatcttgccagagtgctgctgcaagattgcattaatattatccctggataccataacaccatcgaatcttagttttgtgcaacaagtccacatgtgcctccaatttcttgacaaaacactggtcctcacaacatccttcagtggcaatttttgagaaaattgtgcacagcaaatcctgcacaagagggacatggtagaagttattttcgataagctattttttgaaaacagaaacctgaagaaggtttctcgtttctaaacacacctcaggaagatctgcaaactgaacttttgccctgctttgtttgaagggctgctgatggcatcgcttcagcctttttgttctacgaatcagattgttctccattcctgttctgcaacaacatagatggccagatttagtaagggcgcagactggaagggaggagagagaaaaatcaagattaagagaaatcctactcaaacttcctgcctagtacctattgtaatcattaatatcctgcctagtacctattgactattgtaaaaagatcataactcactgatgtgtttcaaccttagcattttcttttcaatttccccctaatcaaataaaacaatttctagcaaaacaacaacaaaaaaaaaaagattgttccatatactgatatgcagataggtttgggggagaaatcagagcataattgtggctggcagagagagattacctgcgatcctctagctgctctccgagctggcaaccggactcctctgaactctgcagataaataaagcaatcaatctgctgcaatccaacatatatagtaggcaagcagtgtccggaaacaaggattggttcaccccgaaacctagccggaatcggatcctattctacagagataatcgaatcctcatcgttactcccagtataatcggaaagacaaaaaaatttcacccgaaaacgagagcaaccacagagatgttcctctccttccgggtctttccctggtgcaaataactgagagggagaatgagccgagagatagtacctgagaaggaggctgatgacgcgcgaatctccggacggaccaaggtggcaggggtatgaaccggcggcgcgggggggggggggggggg

SEQ ID NO: 41018 - DNA, 7798 bp, Oryza sativa
cggcggggcgtaggtggcggcggaagagtgtacagtgtgtacttcacttggcgcgacgagccggaggacggagcgctcagggtagctgggtgggctcccttcttgtttttttttttttatcttttcatcgaaagaaaattaactcgcgatcattttcaacatgcacgactcgggctgtaatttcttttcttgcccgattgacggtggggattttattattactggcaaaaaaaaaaggaaacacttacatgggccaaaaccgaccggaattaagaaaaaaagaaaaatacttactggtcgaaatttcgatgaatttgatcggaattttaccaaaaccgaccggttttcgagaacttgtcggcaaattcagggaatttgtattcaaattttgatttattaaatttgttcagaatttaacagttttccaccggatttcgcgaaattccgaattccgccagcgcccgaaacggaagggcttgtcggaatcgtaaaccctgggcgaaatgtgtcactactagaaaaatcgtttttccagacggccaaaaatagctttttcatacggggaaaggaccaccggcacgcaaaggcctacgaaaaatagatgatttttgcaggcggctcagcggtccgcctgtgaaactcatttttccaggcggcatctattttcatagacggtagaaccacccgcttgcgaaaatatttttagcgaataaaataaaatccgccgccaccacccccaacctgccagcggctctgccggcctccccctctagccgatggctgcctaccctcccctccccggatccaggcggtcgttgcagtcgcggtggtcgtcgttgtcactgccgggcgcggaggagtagagctgccagagagcagagggaggggagccgcacctctccttcagccgcgccgccgcctcccctcccctccccggatccaggtggtgtcatcgtcggtgttgttgttgcagtcggcgtcggcgtcgtcgtggccggccacggagggataggagagggaggggagccacacctcccctccggccgcattaccgccgacgccgtcttcggccacaccgccgcctccgctcccctcccctccctagatcaaggcagcgtcatcgtcggcgtcggcgtcgtcgcggctggccgcggagggagagaagaggaaggggagccgctccaccaccgccgcaccccctccggccgcaccgcagcctcagctcctcgtcgccgccgcctcccctctcctcctagatccaggcggtgtcatcgtcagcattgttggcgcagtcggcgtcagcgtcatcgcgaccggccgcggagggagagtagagctgagagagaggagagggaggagagctgcaaaaataaaggtggaaaaattaatttttgcaagcgggtggcgagcttcaccccggtttttattttcattagcggccatttgactccaaaagtcatacctgccatagaaaaaaaacctcgcttatgcggaaatgctttttttctgtgtgtacagcatcttttctgatcctcaacgggtcaaccacaatcaacctgccaacatcagagaaccactttccaaaccactgaaagagtcgattttcaatcttctcggcgtcgtcttcccccacccgcttcgctcacctgaactcttcttccccaactccggcgcctccactccttccccgttccccggctccccgcctccggtccgcccccttcctccccgcctcaatggctcctctccgaaagaatcccctcgatcccgcacctaagaacagaacgccccgggtgcggattcctcgggtcttcaagaaagcagtggaggcagccgccggggagcagaggacgacaagactcacaagatcgaggtcgggggcggcgtacggtcctctcgcctccaaggcgttggaggctctccccgttccattgtttccggagggagttgcttcctttcttggagcggaggcagcgaccagcagcagcgccgtcggcgtcggggtcggccacgtgggaggcgaccacaacaagatgttgtgcggagggaagatggcgcgacagggcgcgggcatacggggcaacatgcaagatgaggcgagcgccttcgacgacgtgtctcaggctcaacaaggcgtggccggccgggacatgcccgcgggagcaggcgtcgaacacctgctgtgcatggccgcgggcttccgtgacgttcctcaagaaccatggagtcttcaggcgcaggcgcaggcgccgcaagaaagtgccggcaactcgcaagaaggcgtcgccgccgtgggcgtggaagcggacgcgggcgtccagcacatggcgggccaggacgcgagcgtcaacgacatgccgggcgcgcaccgggggcttccatgacaagccgcaagaatccgccgaggaggctggcggtgagcaagaacgcgtcgcagtgggcggtcccgcctgccatggcgatctgatcgtcgagtccacgagtgcggccgcgactgctgttgaagatggcgttcaggcggcaaagaacatgttggtcacataatccattcttgaagtcctcgctgccttgttgccgcctccgccgccgccgttcagagttgtgactatcagcgggccggaggatattggcatcatccttggcgccagccagcgaccgagccactgcgattcttggtgtcgcgagacatgccactgaacataatctgcaagatttttttttcattacaaaagcgaaaaaagagcataacaggagacgaccacaacctcctcccacctaatctaggtgccatccccttatacatagtcccttaacctgctcaacacacattcaaaacgccatttcagccattctacatctaagaacttaacagtccatactttcctaatagcacccaaaaaaactcagccatttttgctcatattccaaaccctccatgcttgagagacgtcgtcttccttctgtcatccttggatccttccagctctgaagctccagccatgccgagcactgtagaattcagcggctacctgctttaacaccctggccccctccagcaagcttcttgcctcttcctccttgttctccaaaatagcccgatttgatatattatgtgcaatctgaaaaatcacttccacagatcatttggaattatattatccaagcaagccctgtttctgattttccagatactccacaaaatagcagctattcctattgaaagcaggctcctattctttttagagaacttgcttaaccatccacccattacttcttttaaccccccaggtatagaacatgcaaaaacacaatgcatggtatgccacacaaaacgtgctaaactgcactaaaaaaaacaagtgatttatgctttcatgtttgttgcagaactgacattttgcagtacccttcctccatcctctttttataagattgtcttttgtcaaaatactattttttagagctaaccaaatgagcactttaattttaataggaatcttgaatctccagattttcttaaagggataaccactatcttgcaacttcattgccaattgagatcccctgcagtactgcatgtgcagtactgtaggctgacagggcccacatgtcagcctgcagtattgcacgacctgtgtcccttcattgcatagtaaaaagatttgacagtaaaaaccccactttttgtaagtgtccaaatgagcttgtctttcccattttgcaaaattttcccattacaaagcttttattaatgttctcatttcacagccatatccccacctagtgtccttctgaattcaaaggcatcccaacccatctcaaagacctttgctattgttactattttagtgaaagttatattatataaccgaaaatgctgcaggccgggcgcccgacgggggtggagcagatcgggcgctccccccgcgcgccccgtcccccacacgggtgcatgcaggcgcctgggccccaccatgttttctgcccccacctgtcatgtgtctccactatatactccattgcaacaaatcacccacatagtattttggaaaccctctattaaggaaattcgtttcattttttgttccacaaaaaatgtttcacctagtgtacttacaatgtttcactatgtataaatctaatgttgtagtgaacgaaacattcttttgcaataaatcacccatatattttggaaaccctctattaagggaattcgtttcattttttgttccaccaaatatgtttcacctagtgtactcataatgtttcactattgatagatctaatgttgcagtgaacgaaacattcttttgcaacaaatcacccacatattttgcaaaccctctattaagggaattcgagggaattcgttttattttttgttccaccaaaaatgtttcacctagtgtacttacaatgtttcactatgtatagatctaatgttgcagtgaactgaaatattctttctctatttgctaaaatatttttttatataaggtgaaacaacgcccgatttaaacgattgaaacattttcgatctactcagtgaaacaattccgatatacttggtggaacatcgtgcaatatttaaaaataattcaataataagctaaaaaaatgttcgtcagaatatatccatgtgtggtcttgttttgaagatttaattgtaacgaatttaatgatgcaatcggatcatgctgacgtcagcggccgattttggccactccggatcgggtgaccgatgcgtagtcccctccttaaataactctcggaattgttcagccaaagtcctgtctcctatccatatgtcttcgcaaatcaaagtcatagtgccattccttacttcctttctacaatatttcagaaaaaaaaaatcttgtatctcatctctcaagtagcccagaccaaaattgtgagtctcctgttttgtgtttatctaaacacaaagttttgttcttcaagtacttgtcatacaacatactctgccgaagaccctcatcattctccagctttcaaagccacttccccaataatgctactttcatagtatctaaataaatcaagaatccccaggccaccctgatcttttggcctacaaatcattggccactggactaagtgatatttccttatgccttgatatttctaccataaaaatctagttctataatgtatagaggtatacaccttttggtagtctataaaaagacaacatgtatagaggtatactacttagccctatatattcaactccaaacttcaacttccactgcaaacttcaacttactcgttttcctttagcatgcttttcaaacggttaaatggtgtatttttttaaaaaaatatagaagttgtttaaaaaagcaaataaatccatttttcaaatttataataattaatacttaattgattatgtgctaatgatgtttctcgttttgcatgcaacaaaaatccaccctcccaaacgggagattgaacggggcactacattttacaagtcaatatagaacagaatttagttccttttctttttcaagtccaacaataatcagctcattcttatcaaagttgatttttaagccagacatattttcaaaagaggcaaagtatgaattttatgttttttgctgactcctcagaggcatatgcatattgcataatagctaccctatcttccgtatctcctttctataactcttttttctatagctagatagcaagggaaatatcggatcactagtttttgttaggaaatctttttgattccatcatctgatagatgaaaggcaatttaattttgtcagatgcttttttaaaatctactttaaaaagaattcattttctctttctaaaatatagataattcagaaccttataaagcatcgctaccccataaaggagatgagtgacatttaaaaaacaaataagtataaatttatgtatctgaatggcatctttgcacttgagttattaccatatggttcagtctatctatattaaaggtcccattgtaaaagtcatcgatttaatgataacttcataatgccggtgtgaatatgaacatgttgacaacctgaacctttgttgccttaggctttagctaattattacatcgattatacctcctttatttcaaaacagaggtgagatgaataagaggtaggctttagctaattattacatcgattgtacctcctttattccaaaacagaggtgagatgaataagagggatactagtatctggagctaaaaggaatggaaattcaatttaaaatgagtatatttgccaaatccttaactaagggagacattgatatttctcttcaactatctatatagaaatgaactactcctcccaataggaaaatgggggccacacagcaaaatgggggccagacatatgaagctctcctctttacaggaacaacaaaaaaaggtaaactatccaaagtttcagattccctgatgaggagggagtcaggcagacagatgcagtatctgcatgctgcagctgctcgacacgaaatcgcactaaacggagctcattgctaagccaattcgcttggcttagcttcgcagccagcagagctgggtcctccaccagggactgcccaagaacattgtccttgagaatttcacctatatccaacactgtgcccaatgatatattgaacggcacccgaatccgaacaacctcaccaacaagggttgaagctgggcatatcgaacggcacccaaatccgaacaacctcaccaacaagggttgaaggtatggctgcgtcgacatcctgtgcactctgtaccgtgactatgccatactggggaatcggtggtggtggcggcggcggtggcggcgggcggtgctctaatcgggtctccagaagatggctcatcgtccctccgccgttgctgccgcgctcgacgtcattgtcgccatcttgacggggagttaccattgaatatattttgataatatatttgttttgtattaaaaatgttcctatatttttctataaagttagtcaaacctaaataagcttgactaagaaaaaagtcaaacgacttgtaatatgaaatgaaggaagtactttaaaagaagtagcggtggtggttgtctggctgacaccaccatctgctctcattgtagttttgtaaattacccccgtaaacttctatttactaaaaatcaatcaaatctatcaatagatttgatctattgaaaaatgataggtaacacattttatggcaaaacacatgttatttctggtacctattaaaattataatatatattttatccgcaacaaagaacgagcattcagctttttttaaaaaaaaacttggggaggaattctgtacgatgtaaacctgataggaacatttggccctttggattgaaaccaagggttagagtttttcaaatataaaatactagtaagttcccaaagaattgctagatatatgtggatttcttttaggaaagtcccttgttacttatttaaacaaagtttttgtagataaaaaaagttgagcattaaattattgtagcaaaaaaaactaattacatgtaataaacttaccgttcataacatttacaaaattacaggcataaacattaaaagtctttaaagttagataaatcgtagttaaaatgaacaaaagttgcacattgcatatgcgcctaaaatctagaaaaatactccccttttctttcttacaagttacaaagggagttaaacaactctattaatcaacgtttcccttagcaaattctttagacaaaaaacatcaggaccaa

SEQ ID NO: 41019 - DNA, 70966 bp, Oryza sativa
gccgccgccgccgcctcctcgccgccgaccgtgaacacgaacgggcccatgggcacgtcgtcgtcgacggcgagcagcggctcgagcgcgtcgacgacgtcgcgcatgcaggggcgcgacttgggcacgctctgcaggcactggtgcgccaccttcgcggcggcgtgcgcggcgcgcgccgagtactgcagctcgaggctggggtccatgatgcggtgcagccggtcggcgcggcggaggtaggggcgcgcccagtccacgaggttctgctcccggccgcgccgccgcttgtcgacggagcggcggccggtgagcagctccagcagaacgacgccgaagctgtacacgtcgctcctcgccgtcaggtggcccgtcaggatgtactccggcgccgcgtacccgtgcgtgcccatcacccgcgtcgtcacgtgcgtcgcgtccccctgcggcccctccttcgccagcccaaagtccgacagcttcgccgtgtaatcctgcaaatttttcccatttgacaagtcagcaaatttggcatcaaagtgtgcctattttaatgggtctattaagatggagtggagttgtggagcgacaaaaacccagctacacctctatagtataaatttatggagcagctccgctaactccgctctaaaattgaagaatctgtaccgtttgacagctctaactctacgtaagttagagttgaaagctgtagttatgccaaatgggacctaagatcataaatattcttgcaacttcgttcaaaactaaaaagaacttgtgattttgttgtgcattttgatttcattgatgttgctgtggcgttgtggtagtggttggcatgtaccgtactgacacgacaaagccagtatggcagtttggatcgttgaacttaaaaaaaccgtgggttcctaacgaaccagacaaagccaatcagttctacgcccaacgaccggcttgtgtaataaacaatcaaaggttttgctgctaatttgtcgcattatttgtcgcattattttaattaatcctactgttggaagctacgatttttgacccggctggaaacagttgacaacgtgcgatccattcgcctgattgggcgtgtcgcgtatacaaaataaacaaccactactacattctcaattcatcctacttgccctacactctgcagcttaacaatgattcaatttttaaactgtgctctcaaattgtaatccccccaaattgcaacacaaatcatgtggtcaacaccaacgaattttgctgtaaattaagcttgctgtgtgatttaccttgtcgagaagaatgttggaggccttgaagtcgcggtagatcaccggcgtctcggcctcgtgcaggaaggcgagccccttcgccgcgccgacggcgatcttcagccgcgtcgaccatggcaacgaagcaagaagatctgcacacccaatgaatcacacactcgattagcaaaagctgcaacagctaacacacggtaattaaccccaaatcatgtggtaattagtaactacttactcttgaacaggtggttctcgaggctgcctcttggcatgtactcgtagaccagcatcctgtgatcatcttggttgcagaatcctaccagcttcaccaaaagaagattgctcaacatccccagatacaccacctcagcctgatcacaaaaattaacgagaaaatcattattatcagttcatcatcacatcagacgagctggatgtatgattcggcagcagaagagccagcggcaaactcaccagccactcgcggtggccctggacgccgtcgctgtcgaggtacttgacggcgacgtgctgcgactcgagggcgccggggcggagctcgccgtcgacgaagcccttgtacaccggcccgaacccgccctcgccgaggaagttgctggtggagaagttcttggtcgccgccttgagctcgtccagggtgaaggcgtgcaggttcgtcttcgccagcgtccgcgacaggtcctccagcgacagcgacctgaggttcaccgtcctccgccgccgcagcgccggcctcttccctgcttcctcctccgcctcctcccctcccctcccaaagcacgcaaacagccccctcgccatgcctcgcctgttgatgcccgcaagctgttcgaccgctgctccgcccgaccaatcaaccaaagaagccaagaatcgtcgccgccggagaagaaggcaagtcaagaatcgtcggcggcggagctggtcctccgattcgagctgggagaaggagagatggcgcgggaggtatataaagaagaagtgggtggctttggattggatcagatgctactctaatcagcttgtggctgcgtgaatcagtggcttccgggtgggtgggttaataataactcgtcaggaaagagatgggatgtcctcttcatttgacctgattactcaaagttaattccagcaggtggtgtaattcgatgggcttacaattaattaatcgactatgctttcatttttttaaccgtgtttatcattgaatcattggcgatgctgtacttgaattttcctcccagttagttagtgggtgaaagctacttggaaagcataatatgggaccaatggctttggtgatgggtgatgtatgtgagttgcatccatggatggatggcttgccatggatggtgacacactaacacccactgaaacttccttggtggaaaggaacaagaggagtggtttgttcttatcaatttttaggggagttgattgctgtgttttaggtgagtgatcctggcccttcaacttaatatacatggataataagatcatattaggtgatctactgatgttacaagttccaacaggagacgaacatgattggctggctgggtgtttagaattgttacaggcctcaccaatttttcgtactccgttttgtttttttttcctccgggactgaagtctttgtaataaaggaaaaaaaattagtggcaactattttttaaacatggctattttttttcccaaataaattctagtatgggtggtaaaaagtatgttcggcttttcaaatattccctttggttatatgatgttttagattagatttgaccaaatttttaactttggactatcaatgaagtttgaaatacatagtttaacgaacataaaaatgtcttgtgtaaatttgtgttgaaaagtactttgataatctttaactttattttataaaaaatattgtggtcaaaaccacaactgaaagaaccgttaaaaggttcaaacatgattttttttcttttttttttttacccaggggagtaacgcattgaactcccaaactgtaaacatagggtactttgaatactccattcatacttgtaataagtttaggcatgttattatagacttcggttcacgtttgatttgaagtttgtatattaaattatagtgctttaaaactttaaatttcatcaaaatagaaacaaaatgatttgtcaaaatgttattaacgtgatcatagatctaaatctatgaaattataaggttagaaatacccagtttaaaaactttagatctgaagctgtgtaaataaaatcttattcataatggaattattgttccaatatgttgggttttttttttacagttctattcaaaatgtgacgccgccgtttattgcatcttgcatacttgttcagttctgcatgcttcatgcgcacaagtcgaaaaaaaaaacgcacggattcttccacgaccgggtcaaatggatcacaggaatgtactgtacagatcacaattctttatgaaaaacaatgttcagttttttttctgaccgaaaagtacagattacagtacatgacaaaacttgatgccaactcgttgacacgttccgttccgttccatgacccagccaggcagccaaacgcccaaacgtaccccggttagttgaagaagaaaaaaaaaagccggcgctaagggttttcctgactgataaaaactggcaccgtgacacgaatgataattataaatgctgattctgtaaaaaaatttggcactgataatagttatatatgttggttttctattaaaacacaacaaaaaaaatagtgcctagtttttagtgagctagaaaaatatatcaaaccgatcagtttcatttgcaaccactcgagactccgagcgcatacgtctctcctcctctcttgctctctctctctctctctactctctccattttctcccaaccacctaatcctggccaacgagcaatggggccaacaaatccacctctcctcgacgggtggccaccaaatccagttatctcgaacttggggagcggtcagatccgcctttgtcatcgtcaaggtatggggagaggtagtgacaacaagactagatccatcctgatcgcctccccttcatcctcgctacgctcgaagaggccagatcctaccatctacatagctcgatgaaacaacgaagcaaagatagagaagtgataaccttttttgatagctggggaagggagacgcatagggtgtgggcggcggggtgacagaggctaggagcaaatctacaagctcaactctagctcgatggatgagcgacgttgtctccacttcacccatagatacctcattgtgttcccctccacttggctctagacaatgatgttgaatttatagtgtgatttaggttttcttttggctcgaagcatgcacatattctgggatattatgtgaatgatttgtcattcttccattcatttagttttttaacagttccattaatttagttaatacaatcatattaacttgattcatggatctgactcagtgctttttttttttactcgtggaaagccatcaatgtcggttctcaaatctaacatcgatgatcctttcacatgagtggctggatgagcagtggaataggcaccacgtagtgtcgtggggtaagagaattatggttcgtatatcttggggttttttcactgttctatctgttctatttaaaatgtgactcggtagtttattgcatctggtgtagtaaggctattctcaacccaataattaggatagtgtccatagcattaaataagctgccatctagaatgaaaaatgatgcggcaagtgaataaatgaggaaagagaaggaaaccatgtcttgcatgagacatgatttctacacaatattcaagatatcatatgagataagatatcatatgagataagtagcattaaattcaagtatgaaataatggtgtttgcattgaaagagtagtgtctagtactagtttttttttatgatatggagtttatggaaactatgtctagtgttttgggttgggaatgacctaatataacctgcatgcttcatgcccacatgtcgagaaaaaaaatgcatgattcttttacgaccgggtcaaacggatcacaggaatgtacagatcataattcttttgaaaaacaatgtgaagttttttttttctgacagaaatgtacagattacacgacagcttgatgcactccgttaacacgttgacactttccattccagagtgtttctcacatgcctctgttcagtctccgtacgagttttactttcacatttctttagcaaatatatatacgggtagaaagtggcttcccacaaataagaacaacagaggcgatcgtgctttctgcacttcaacttttaggccaccttgtatttcgtcgaagtagccaagcaagtatatgccaactggtaaagttatcaaacatgttgatagcatagttaggttgtacactcttcatttcacaatgtaagttactctagcatatcctacatttatattggtgttaatgtatcaagacatatatatctatctagatttattaacaccaatataaatataagaaatattagaatgacttacattgtgaaacgaaggaagtaagtgggaatgtcatattcttttgcttggtcctcatgtcttggcatttttcttaagataatactctctccatcccaaatataatgcgttcacgtatttcaagattccaccttcaaaacattttgaccaacatttagtacaatataaatttaattttacttgctaaaaattatatcattggattgacatttgaatttcctttcatatgattataattttgctactacaaaccttataatatataagaaattataagataaacattagttttgaaaaccgtgtcaaatttgaccatgccttatattatggaatagagggagtagaatagaactccaatctttactcaacgagctacaaccaattattacataaattcgtgcaaaaccagcgcacatcatcaagtctaaaaaaacacacccaaataattgaagcaaacgcaagctaataatcgctcacacaaaataaagaccccttaattattgaatcccatatatgaatctccaaccgaaattgacgaaaagctatatgaccgttgcatgtcttggcaatttatgccggtggtaaagtgtttagtataactgaacgacaaggagagctcaatctgtacaatcgtaggctaatggagttttctttgtcccttttaggtagcacaaaatctttgaacgttcgtaaatcttgaacgactgtctgcctgaccgcgtttgtgacttgtgcaccaatagataaaacttttgaggcatgttaggaaaaccctttcggtccttttcaaaagaatttgattcattaattcaaattttcagagcagcgaaacttgcaaagtgaagtggagtattcaaattttcagagcacgtggtgaaaacgaagcactgctcacactcacacagaaaatcgtggtgaaaacgagagcactgttcacaattcacacctaaaaacgtcggacccaccaaaaatagctgagatataagaggatataggtgagatatagcaatcacattttttttaaggaacacgggggaaatccccacctaaattagattaaaccagacaatcgtacaagaacaatcacattaggaaaaggcaagaaaataatattgaaaatgtgattgcatatttttagcaaaattgcttgacaattcaaggagagcttcacagtttaatggattggtaaaccaccaatcgagctttctttttcctttaagcagataaaattgaacgattgtaaaatgaaaaaaaaaattgaaccactgtcagtgtgctgaccgtgtggctagggttctgggatccgattgcaaaaggaaaaaggaaaaaaataataagaacccgccaaaatatatgagtttgaaaagtttcgaacgaagtttgattcaaattttaacaaatttagaccaggctgagacgaattgggagttacatgttgtctttgaggcacgttaggaaacccttcgttctcaatagaatttggttcatgaattcacatattcaggggcagcgaaacctggaaagcgaagtgatcgatcgcacgtggtgaaaacgttgcaccgctcgcagtttccacaccgaaatcgtggtgaaccggtgaaaacgtagcaccagcaccgtgttcacacttcacaacgaaaaaacgccgtcgcccggcacacgcgcgtcggcgtcccgccgtcgcgatcgctcgctcgctcggcgctcgcgccaaacccatcgaataaagcagagtccccgccgcacgcaacgcagccgacgcacacgtgctcaacccgatcgatccaggcgcgcgcgcagccacgcaggcaggagccgtgccgcggcgccacacgacaaaacgggcgcaagcgacgcgcgcgactctcgcgatgcgttgtccgagctgtttgacacaggactagctctagctctagttctcatcaaattagaggtcagccaaacagttttaacttaatctcaaataagagttgagttaggtaaaactcttttataaaataaaactagaaatatgaaactgggtttaggcagctccacaaccccacttcaaattcaacttttaaagttaaatttaagagttaaagctctactaaaggtctgtttggcatagtggagctagagctcagccaaacagctccacctaaaataagagcgaagcttggtagagctctcttacaaaatgagatgaagctccacaactttatttcagatccaaatcctgaagctaaatttataattggagctctatctaaccgacgctaaacagacatggatctctccttcgctccgcgccgcgagccttctcgcgtcacgactcacgtgccgagagcggagggactagccgcgactcctcctccgtcagccgcgcggcctgcgcctgcgcgagccggggcctcgcttgacggccttgaccgagatcgcggttcgtgtccggactctggccagggctgactaatctttcaaattggcacgttttctgtgctgttttgaccgtgttttatcatactgtggtgggttttttttttctttctgagcaaagacaacgtgtattgctattacagaggggataacgtaaagttggggacttcaggtgtgctgaatttaacgtaggacaggtgggttgggttgttgcaatagttgacttcatatgtaactttacatggtactacttcggtgcgatataggccatatgctccacatttggggcacagactttttcttcctctggcactgcttctttctggcccccattttacaagtttcggctttgcgagcagcgttctgtgcaacggttgaataatgatgtgtcacagttttctggtaggatatggagtagtaattggacgactagaaatataggataacacgcatggatccggatcatgttccatcgtaccgcggacaaacactgtggatgcaaggagaacaataaataaatcctgtgaacagtacaatctggtgcgctaaaccaactgaaatattcggacgattaaacttagactatgtgtcatctagatacgtaaaggcgttgtagaggccgggtttatcctattttataaaagaaagatatataaaagcgtaaatacacatatgcttatttaatcatagtttaatatatcatccgaagttcaaaatacaaatgagatggatcaggagttgacgtggctatccagcatggcatgatgaaagttttgcacttaggccactttgctactttatgcccctaattcgactgccgccacttccactgtgcccgtgaaaaatgaggcgaagagctgacgattagatagcaacaatcgttggggataggagtttcttagagccgagatagaagatgcgatagggagagagtgatctcgcaagttttgtgtggcgtgattgtgatcttgaagatggacggtggatctcggattgtgcgtggatcacggtgacaataacattgcaccggatgcatggatcatcttctctcgtggcggacccaaaaaaaattacacttggtgtgcccattctagcgatcactccaccatttttttttaaaaaaaaaacccaattccgatggcaaattttggtcggatttttgaaaattctattcaaatgtcgtccataattcatgaagggagaatagctatacggtccctgaagttttgtttcgggctcagtttagtccctgaggtttcaaaacgtccaaacaaatcctccaaattagtcatttgggttaacatagtccttggacccaaaaaaatgccacataagcatgccaagtcattcttgcatgcaacaatacaaatgaaagacattctacccttatcatataaaaaagaaagaaaagaaaaaataaaggaaaaaaaaggacaataggaaggaacgaacaaaaaggccggcccattactctatctgtttgttttctccatctaaaccctgattataatgtgtgaaccatttatcttcttttgcatgtattgtatctaataatatatattatttatttattgggagtagttaaacgtgcacgcaaacagatatagaacaattcaactctgtactgcgcggaattatcaaaatcctataaataacaaaaccgtgtaagtaggtaaaagtagcaactatattttacccaatcaactcaaattgcaatataaaagtatagccaacatgcatgacataattgtgcatgacataatataaatggttcacacattataatcagggtttagatggagaaaacaaacagatagagtaatgggccggtctttttgttcgttccttcctgttgtttccttttcttttcctttatttttttcttttctttctttttatatggtaaggctataatggtcatttcatttgtattgttgcatgcaagaatgacttggcatgctcatgtggcattttttgtgggtccaaggactatattaacccaaatgattaatttcgaggacttatttggacgttttgaaacctcaaggactaaattgagcccgaagcgaaactttagggaccgtattagctattctcccattcagtaaatatctgtaagactcagaacaatcaatcccatatcctaatctatctagatatttttctttttttcctccactgtttcttttcatcaagtcctttcctcttctcctgatttgattttttgatgattaaaagatctccaggcaaaccatgatcattgttatattctattttatgagagaattctatttttatgtcctctgattacgtactacatcctagtatttttccaaaaaaattgggtataccggtgccaaccaggcacaccccctaggtccacccatgatcttctccctaccacgccatctctcttgacacggggaccaactttggtcctcttaatcatcgtctcttttccttctctcccaccgacgtggtgagagtcgatttggctgtagcaggagttgatttgggagtatactatagttatagtggaatgatctaaatgtaaaactttcagacactttggatggccgttcttgagctgcaccatctgttgtctagattccatgtgatacattacacattttataaagcacaaagatgacaccagtttcccccaaaaaaaggaaaaagtataagtaccagttgtgtttcttgactgtgcattttcaatcggatagcaaagagctgatgcaaattacagtctctcttcatggattcaattccaatgcatatgtcggcagtcagcacaagctgcgacaagttgagcaatagggtggttttgatccgaagaggcgaagaatcaacgatcttcttccggttgtttctgcagtcattcacgtacggatattcagcactgttgactcaccattttgggctcatttgaatagtaggattaagaaaacataaaaatatgaaaaacataggattttaatatgaatgtgagtgtaaaacagaagattgcaaaacatagaaatgaccgtttcatcggaccgtaagaaaaaatgcaggaattagatgagaaataaaaaactcaaaggaaagtttccatgagattctacctcatgttagatttccaacaaaatttacatgccattaggcattacataggaaatcataggatttcataagatttatttctttaattcaaagcactataggaaaattttctataggaatgaaattctctaaaatttttatgaatttcctttaaatcaaatgaggccatatactcttgtttttttcagacacatcacacatgtatatctcgaaaaggtatcgtgctctctgttagattttagccagacggaaatagatatacacgaacaatgttttgcagaagaacgatgggcgatgcaacaaagttttggaacaacgctatatttcctcgactttattttcctcttcatatcgcagcccaacttattttcccctttctgaaagcccaacaattccaaagttcatgttcttttttatgtatactcgtgatcaacacatcagtgatcgatcgatcactgatcagtttcacttgagttcagacttcagaggataccagcgtagctgcaagaatccctttcttcctcctcggctcgtaccccatgtcccggcacatctcgtcgttgtaccacgtgctaacgccgccgaggcacggcttgccgccgccgccctcgccgtgcctcctcatcgccaggtgttcgtcccactccgccgcgctcgcctccatccgcacgacgctcggcagccggaacgcgccggcgaggaggtgcgccacccacttggccatcatctcgaaggtgtagatgctcgtcaggttctcggtgtacccgatcaccgccatctgcgggatccgcgggtgcacgcactgcctgcacgaacgaatgaatgctcatcggcggcgagacgctggccggctcgccggcgaacggatcgttgacggcgatgtgcggagtatcacctgtacagaggagctgctactatctgctgcttgaacgtcgccgagacgaacatgtccgtgagcttctggtcgccacggaagccggtggcgagcacgacgacgtcggcgtcgacgcgctcgccggtgtcgtcgtcgtcgagcaccaagccgtccgtgcagaagctgaaagatcttgccctcttgatcaggatgctgccttcctccaccctgtcgtagaacttgtcggggaggactccgagccggcagcccgacattgatcccgcgaagctctcctccggcaccatcccgtgcttctccatcgggatctgcatcttgaagtaggtctctgccagcttcgacagcagccatctctgaaacaaaaaaaagcattttcagtatcaaaacagctagtacttgatatagttaaaattcgtgagcacttttctggtcttagtagaatcctatcatcactattatatcgaagaaatgcccggtgaaaaatacactactactattgatataacctactccctctgtcaaaaaaaaaaaacaaaccatggtttctatgtccaacgtttgactgtccgtcttatttaaaaaaattataaaacaattaaaaagataagtcacgcataaagtattaattatgttttatcatctaacaacaatgaaaatactaattataaaaaaatttcatataatacggacagtcaaacgttggcacggaaatctacggtttgtctttttttttttggacggagggtttgatttttttttgatagagtagtagttctaaaaaaaataaagtaaaataattccaactatgctaaaaattcaattacaaatttgaaattcattttaaaattacaacatggatattgaaattttcgaatttacttgtctgttatacataattcgaatgtgtacacattaaaataaggaaacattgtttcttccataattgggatgcaataattgatactagtatgctttcaatatcaatatatctttccgccgcctagttggatcgatgttccgtaaatggtccaaaatagtttgttgtcccttaaaaaggtccaactacttttggctccatcgtttggtttattcatggaataatccaaacgacatatttgtatacgaaaaataatttatgagtaaaacttttatatatgtgtccttagcgatccaaaatcaaaggctgaaaaataaacttcgatgaaaaaaacctcaaaatcaactccaaatttaaggctaaagatttaaattttggctgagtataagcataagcgaaaagatgaggttatttatttacaagcaatagctacggtaatactagtaaccagtcaaataaaaaagaaaagacgaaagatctaaattttttctactataccgatataaataccatcgtaaaaatgcatacataatcaagttgaattgggaaaattattctaaattatcgagggatgtatgtcacctaaataattaaaaaaattaaaaaaatcaaccgtataaattaatgtacgatctatcacttcacaaacgtgtaacatcacaaaccaaaggggtgagcagaattgcgaggagggccaatgcaagcccctcgccgggcttgtgaacggtgagctcggccagccggttgcagaagaggtgtccaaggctgacgccccacacgaacccgccgttcaccatccaccgcccgctccggcagatcatggcgcacggatacctgccacctgatccatggcaggcagcacgcacgctcaacagttcatcacagatcgattaattactctcgccgcgaaatgtggatcttaccgtttgcagcggcgcactccgccaccgtgtcgaaggccgacttgccggagccgacgacggcgacgcgcttgcctctgatcagctcgtcggcggcggcgtggcccatgttggagtagtccatggagtgaagcacttggccgtggaacacttcggggcctcggttgggtggaaatgttggggtgtgggcaactccactgaatctcccagtgcagagtatcaggaaatcgaccctgtgtatctgtacaccaagatacctctctttgaaatattctgatcatatatttctctttgaaatattctgatcatatatttcaagttccgtttgaaatgttactgtaatttaactgtacgtgtgcaatttgtgataaaccaattgaaatgagcttgaaattggtagctaccctctccatttcatattaattataaatcgttttaacttttcgtagtcattttcttaatttgatgagaaaattagaaacatctacaataccaacctagtttcattaaatgtaacgttgaatatatgtttgttttgtgttaaaaatatttctataaaattgatcaaatcaaacataaataaatttgacaaaaaaattcaagtagcacgtgaacttaattacctgggtagcttcggatccagggtgctgcaccgtgagaagccactcgccggagccgtcgccgaaggcctcgccattccccgaccaccgctcccacgccgccgcctcctcatcgggcaccccggcgtactcggcggcgagcaccttgcagccgaaccggacgcactccgtcacgccgtggcgccgcgcgtaggcggcgaggtattcgaccacctggtcgtgccgcgggaacacctcggcgcccgacacgtccgccggccacgggaagtcggagaaccggtaggcgaacgccggcgtctgcagcctcgtcgacgccagcgtgcgcctccacacgccgccgacgccgtcgccggcggcctcgaagaccaccggccggaagcccttcgccagcgcgtgcttgcacgccgtcaggccgctggcgccggcgccgacgatggccacacgcttcttggtcgcatccatcgatagaatattgaagcgctagccagcctgaacatttatatacttcatccgtttcacaatgttattcattctaatatttttcatgtttatattgatgttaatgaatctaaatagatatatatgtctagattcatcaatatcaatatgaatgtgagatatgctagaatgacttacatcgtaaaacggagggagtagatatatagtagtaatgtaacatggcctaagcccttgttggggttaatccccttagagaagggattagagggcattaagggagaattattttacaccatatccttcttatttttttggggattaataattgaataatgtcttacagaaagctacggataaacaatgaggacaacaactctatcatccatcgagcatcagtaggtggtaatgggtcacgggccctttcagaacccatctcaatactttaaatccgtacttctgggaagtttaaaaatctattaaatcttactccaatctctttggacccattctttatattttgtaggttaaaaagtttggctccgttaccaccgggctgtgtttgcaatcctaagttcccaacatgtacagtgtacatttattagcgtgtgattaattaaatattagctaattttttttcaaaaatagattaatatgattttttttaaacaactttcgtatagaaacattttatgaaaacatagcagtttgaaaaacatgcgcgcggaatatgatggagaggggttggaaatccaggattgcaaacacagccctaagcaccatgctctagaccaagctgaaaaggttcacaacaacatgcttcctcgtgcagcgctcataaactggcaagcaacagttttgggtacttttacacatctcttcctttaactgggatgggataacgatattccacttttaagcactgacaaagcttccgtatagatttataaccagaaatgtttatattatagaacggatgaaaagtactctcttcaattatcccttttaagttatacttgaaatttcaccattgctgccacatgtttgtcatggtctatatgtgcaacatttgaaatacaattaactctccacttattattattattattattattattattattattattattattattattattattcagtttgtgacacatggtgactagatatcagcatagtcagcggctccatagggctctatccactccgcaactatccctttctttcttcttgggttgtatcccatattgcggcataactgatcattatcccacgttgtgatggtgccaatacatgacttgcggaagtagttgccgctacacctcctcatatcatgcgcccaacaaacccactccaccacgctcttctccatacgtgcaatgctcggtagctggaatgcaccatcgagaaggtgcgccacccacttggccatcatctcgtacgggtagatgttcgccgcgctctccgcgtaaacaatgatcgccatctgtggtatacgagggtgcacgcaccgtctgtcgatcaataaatcacaccactcagagatgattcaaaagaaaaaaatatattacagtaattttatggtttttaagaaagtactgacatagttaaattctgcgatacatagtgattggtgaaacgcaatgacctgtacagaggtacagtggcgtctgaagattctgcgacgatcttgctgaaccacggcgacacgaatatatccctaagctgccggtccgcctggaagccagtggcgaggatgaccacgtcggcgtcgacgatgtggtcgccggtggcgacgtccagcaccagcccgccggcgcagaagctgaaagacgggtcacacctcctgagcacgatgctgccatcgtccacccggtcgtagaatctcttcgggaggatgccgagccggcaagccaagattgactgtgagaagctgtagcctggcaccatgccatgcctctgcatcggtgtgtgcctcttgtagtacatctccgttagcttcgacaataaccatctctgaaggaatcaatgggttgtgaaattgaactgttaacgattagtgacgatctatttagcgtttcttcttacaagatggattaacttggttgagtgctaccagtggtgtcagcattgtggcgagaagactcaggaggaggccttcaccaggcttgtgaaccatcacctcggccagccgtgacgtggtaaggttctggaggttcacaccccacacaagccctgcatccaccatccactgtgggctcctgtacaccattgtacatgggtacttgctccctgacaaccacgtatgtgagatacttagaaagtgagtaacttataaaaaatgataaatttgtccttttaatagagaatgggtggccgcgtaattatgcggctagcacccaaacaaaataatatatttttagtatgattttacttaaaatttattaaatagctatctcattgtcttaagactttgaaagaccaaacattatcatcctcgtgtttctaattatatagtttttaaaagtcacaccattatcatcctcgtgtttctaattatatagtttttaaaagtcacaccaattgctaccccttatgtcatctctttctttatttgcttactcgatctatcactatttctattcattctttttggaacctttaaaatttgtattttatagttttagagtttattgtcacattgggtttcgtttttataatttctagatgtcccgtcaaacgttgccattatactcctctacgacccgtccactgtctcttctctttattgtcattgagattttaaaaatcgaacataattatcgtttgggttcatttttactttaagtcccgtcaaaccatcagcggctttgccattgtactcttctacggctcgctcgctgcctctcttctttattgtcattgagattttaaaatcgaacatgattatcattaggttttttttactttttggaagttccgaacctttaaaatttgaacgatgccactatgcccctctacagcccgtccgtcgcctactctttattgtcattgtgattctaaaaatcgaacataactatcgttggaattcattttttattttctagaagtcccgtcaaccgtcggcggctctgcaaccatactcttatacgcccgcccgcttcttctcctttttattgtcattgagattttaaaaatcgaatatgattatcaatgggtttatttttttactttctagaagtcccggctactgccttacttgtttgcttcacggcatgcccgacgtccctccttataatcgtcattaggattctatttgttgttttattaacattttttatatggcgtatcaaccgccatcactctactcttttataggcctgttacttaatttatctcgttatgtgttttagatggttttttctttcaatagtctttatttttatcacaaattttagttatttataaattgtatttctaatttaaatattatttttccttttctaatttcataatttatttttttaaaaaaatagttaataccgtattgtgttcttttaatgtttttattttttttaatttcagttgtttcaaaattgtattcctacttaaactctcttttatttttttctaattttgttattttattggatattattttattttttatttgaaattttaattaatctcgtattgggttcatatattgattcttcttttaatattgcttatttttaattccgaatttcagctaattttaaattgtattcctacttgaactcttcttttattttcttttgctaatttctgatttatttttatttttattccgaattttaattaatctcgtattgggttcttatatggactcttcttttaatattccttatttttaattccaaatttcagctatttttaaattgtattcctacttgaactctcctttccttttctaattttggattttattttatttttatttcgaattttggttaatctcgtattgggttcttatatggaaacttctttcaatattgcttatttttaattctgaatttcagctatttttaaattgtatttctacttgggctctcctttccttttataatttcggatttatttttatttttattttaaattttaattaatctcgtattgggttcttatatggactcttcttttgatattccttatttttaattccgaattttagctatttttaaattggacttctacttggactctcctttccttttctaattttggattttatttttttttatttcgaattttggttaatatcgtattgggttcttatatggaaacttctttcaatattgcttatttttaattccgaatttcagctatttttaaattggacttctacttggactcttctttttctttttttctttttcttcgattaatgtgggaatttctagcccccacagcgaatgtggtgccttctttcaaggctgttttaataatataatagatagatagattatatatcatacggtaaaaattgtcataacaaattcaaattcaatttggaaaatgtgatcaaggtgaacatgttctgttgcagcaatctcaccgtttacatcggcacattgcgcaacggtgtcgaaggccgatttgccagaaccaaccacggctatgcgcttgtcgcgaatcagctcggccgcggccgtatggtccatgctagagtagtccatggagtggagcacttgtccatggaacgcttcaggtactcctttgggtggaaatgttggaacgctcgcaacgccataccgtccaatgcaaaggatcacgaagtcgaacttatatgtctgtggattgataagcgaggtgaatccgttgacaagtcatttgttaccatactatgcgagagattgataatttaacactcattaaaatgggtttcgattatttgacatccagtttcgattatcaagtgggttgggcgggaaaattcgatcaacctgctgaaccgacagtgattgagaaaccccgtcggctcaagccaaactgacggtgataagccgacaggaatgacacttttctgtgtgctcatgccgtcacgtattcaccaacctggaggttctccgattcgcggtgctgcaccgtgagaagccactcacccctgccgtcgccgaacgcctcgccgttgccggaccacctctcccacgccgccgcctcctcctccggcacgccggcgtactcggcgctcaccaccttgctgccgaaccggacgcgctcccgcacgccgaaccgccgcgcgtacgcgtcgaggtacgcggccacctcgtcgtgccgcgggaactcctccgccgccgccgccgccggctacgggaagtcggagaacctgtacgcctgcgccggcgtttgcagcctcgtcgtcgccagcgtccgcctccacacgccgccggcggcctcccccgactcgaacaccaccggccggaatcccctcgccagcaggtgcttgcacgccgccagcccgctcgcgccggcgccgacgatggccacgctgcgcttcgccttgctcgcctccatcaattcgtacgttgcataattttttcacttggagtgtggcaactggcaagaacaccaaggcactcgcgcgcttgagatatgtgcatgcatggataccatttgtgccatagttttcttgcttgactaacagagtcttactcaactccatggcagtcaatcaatcgtaaacacatgatatatacaagctgcctaatgcattaatatatacttccaccatttcaaatgcatgacgttgttaacttttcacacaatcgtttaaccattcgttttattaaaaaagtttatgtaaatatcatttatttcgttatggcttgttttatcttcaaatataatataatattaacttattatacttttacatatttgtactaaacttttaaataaaaaaatagtccaacgttatgcgaaaagtcaataacgctatacattttgaaacagatgagtgtatatatatattcatgtaaagctgccggagttccggcaccaaagaagaaagcttgacgcaagagcaagcgtccagctcatagatttcttacggaatcatatgtcaacggcgagtacagtaatagcgaagaaatccatcgtactcgaagtattcttctgctaattgtctttgatcggttgggaaatgctaacattgatttgatactctagttgtctagcagacaaatcgtattgatacatgttgacagtagagggcggaaacttatttgttcatcgtaattcgtaatccttaagacgtgtcgtgtatgtagccccagaggctgctaactagagcagcagtgtatgggcctgtttgacaattttttagctagttgggagttgggacttaggcgctcgtttggttcacgaatgtcactataaaagtatataaaaaccaaaatagatattattccatatatctttacttgaccaaaattacataatattaacagtctccttaataaactcagggccgtcccatgaaatttggaggccccgtgtgaaatcttctaacttaagcgataaaataaaccggtaaacttacactccatgatatattttagcaatataaacttaatagaaattgtctttgtgcataatctccaattggaaagtatctttctttttcctttagtatttcttgaaataaagttttcaatgatttgcagatgacatttcttagaagttgaaatactacttaaatctatgcatatatagatacaagatgaataaaatttaatctagtatacatattagatacaccataaacctagcgatcagaataaaaatttaggtcatgtacccggcatccttgctggtgtgtgcagggcagctaagcttgccgcttgtgctcgctgccatatcgccggggaggtcgcccaaagacgttgctcgctggttgctaccttgccgctttactgcggcacgtcagcagacgtgcagacggtaagagcaagtataataatagtgagctataaatctactataaacttatatggagaagagaggtaacaaaaaatcaagagggttggctctcatgcaagagctagcttaacataatctccaagacaaattcattaaatatataagtgagagatagagagaagtgaagaaaattatagccaaccttatagccaatctattatgtatgttagctttaaaatagtctaatagtaaaaagtgagctatactattatcttatactattatcttgctctaagcgacgagggccaaaagccgagcgacgagcagccgagcgtcgagctggacagcgagacggtgagtgcgagtgcgagagcggcgcagcgtatggattggggtagacggacgggaggacgctcaaatcgacacacgcgccgaaaacgaatcgacgtgctcgctcagcctttgtttccaattgcacatttcaatagatttaatctattgggctaatggtcctgtgacacgtattaagttatttgggccccttaagattgggggcctgtgtggccctgaataaacttaactattatactgaaccaaatctacctaaaatcccaatgaaacccaacacaaaactaaagcttttgttctagtggagcttatcactgtcacaatgtgcgtagagcagtaagctagcataataataaatatgtaaatgactaatccccgaatctatttataagttaaaataatctggctcacatattagccacttgaaccgatagctgtgaaagaatcttataatacgaattcaatgccaaaaaacggaaggagaatggtgccacgtggcaacaccggttttgcaggctcgacgacgaaacgtgcgtccgcgcgtgcagggatcgatgaaatgctcttgcctgcgtgcgtgcgcgtccagaaatttcttcccaatccgtcgcctttacgtggaagagacgagatggtatgcatacatgttgtagtgcaaacacgttgatttctcacattcccaccgaacagctggcaacaaagcttagtcaggcaggccgctatttcttgtggatcaaagtaataatacggattagcaggatatagttaaatcatccactaaaatttcctatgttccaaacatccatcttttcaaactttctatggtttttattcctctgttttacacacgtatttatgtgttttatatttcaaatattttatttcatgtattttgtttttctgagttccaaacataccttaggctatgtttaagaggagataaaaatattaaggagatatatagaactaggtgagccattatcgcatgattaattgactaataattatttcaaacatgaaaaaaattgaaatatgattttctttaaaaggtaacttttctaaagatttttttatgtaaaaacacaccgacatgtgggtgaaaaatgatggacgtttcctttatttgtccctttattagcaataagctagctattgaataacgaagaagagagaacaaaagtagactacatatttgtagttaggtgtagtatgagctctaagatagtatacgagaagtaaccacccctcatgcaagtggtaatttcttcacaaactccaagaaaagaatggtgtggtttggatgcaaattgaaaccagtatgctacatcttaattagttagttgatgatatgaataaattagaggtcttaatcaccttgctataaaacttgcttataaaatttgctcttagagcaaagataatagactaatagtggactataaacttatgtggaggataaagatttttttaaaaaatattgttggctttcaagtaaaatctagctctacacatgctttaaggtaaatatattaaattcttataagtaacataaagagaggaaacgaaatatagagataatcttatagccaacttataagctctaatataaacagcttagttatctttactgttaatacggctcttttacatatgtgttttaattttttacaggcccaattggccaggctcactgtaccatgcgtgacaaagccgcgctttttctagttgttgtcttaaatcgtaaccgtctaccccaagtctgacgaatcaaaacgagcaagccccgagcaccgacttgacttgttcgtcggccactttttaaaatccaaaaaagaaattcattttttttcttctttactactttctctgttcccctcgccgtcgccgccaccgccaccgtgaccggcaagtgacctccgcccctcgccgcggctcgccgcccggccgccgccaggttgcctcggatgcgtggaggtctggtcgcctctgcgcggctactccctcgccctctcgtccggtggtttctccagcgacgagctcagcaggtaggaattagggggtgcgtgttttccggcccttctctctccgcgccacgcttcttgttcccgatctgatttgctgtagtccgtagattagattgaaaatttctcgcaggatgtgagaatcgtcgatgtttaactactgctttgcttatttagttctaagttctaacctactaggggggagaggtttactaaaaccctcgaacgaagtctttagtggtcttcggggattggtgtactgttgttggcaggaaattggtgggataatctcttgcgccgtgagctaaattcaatatttggaccaaaccaacacatctgtgcaccatgaaagggtctggacttcatgatcaacctagaattggatagttcttactttgtggtctgctatgcatgtgcaatgttgaatacatttgcactattgctttatacttctgaatgatgcatatttcttggttctattgcaaaatacttatgcaccaacttgatgtttagtctgaatcatgggggtattcttgtagccatgagcacagccatggatgatccagacgtccttactgaaaagaaggtagttttttcttacattaccttgcagttcttatcagattcctggaggattcatctgcagttcattccatcgtgagagaatatggttaaatccatgcatcccatggatatgtattttacatagtatttatttatgcatacttgttcttttaacctgtaagtcagccagccatttcagttaccaatttgatttggatcctgaatttgaccctcatgcttatctttttgtgttcatacaatctgatgggttaaattgtccttctgcaggatattaatgagaacatgttgggtggcaagaaagttaaaattatatttgttctaggtattgttttctctattctttagaagtaatttcatgcctttgactgccactttatagaagaaaagtgaacttgctgtcagttccttcttatgctgttgttaattcataactgtatttatgtgtgtgtgttgtttaatctgatgtagcatccatgaacaggtggtcctggaagtggaaaaggaactcagtgcagcaatattgtagagcattttggttttatccatcttagcgctggtgaactcttgcgtgcagaaatcaattctggttcagagaacgggtaaaaacacacacatgcatttgcccatgtacacatgccatatttattgtttcactcacttagttactggttctatattttgcagaaccatgattgacactatcataacggaagggaaaatcgtcccatctgagataaccataaagcttttgcaagaagccataataaaaggtggaaatgacaagtatatcattgatggatttccacggaacgaagagaatcgtgttgtatttgagagtgttgtaagcttacttagtcttcattgttttgaatagagcagtaggagaattttatttatgtgtatgttagtgttcatattttacattttaaaagcaattacagaccttggttacttacttccaactgcttcagataagcatatctcctgaatttgttctatttttcgattgttctgaggaagaaatggaaaggcgccttttgggtcgcaaccaggtttgcttcttctctgatattaatttgttaaataaattttgacacaatcacttgagtatttatttcttcagacattatttttttcttgttgccttgcagggaagaagtgatgataacattgagactatcaggaaaagattgaaagtttttgtagaatccagcttgcctgtcattgagtattatgagtcaaaaggcatggttaagaaggtgtgtacatttgtaatggttatgcatgcttcttgcagtacagtttattctccctaccggatttatagacttgtcatcatttaagataatcacacaatatcatatagtaaactgctgtatggttcagggtcaaaacttgaaattcacagtacacatggaataaagcatggtttactctgatctcgttttgtgcactgcaatcagccagtgatgcacaacatatcatatccttagcagggaccatggggaaaaataaaacccttgagtagagcacacatatttgtgagctgattggatgttttcttaagtctgatatatgtagattgtcattttcagggtatgttaattgatcgtttgtgattgaattaacatatggcctctatcctttctcatcacttgattcattactcgattaagttgttgcattgtgcaaatgctatgtcagaaagtgtacaataaaggccctgaaactccacatatagcaacaaatttgcgctgcatgattagagtcccattgccacaaagaaatatgatattcagttcagcaaacaggggaaggttaagtaagtgcaagaactttgtgttaaaatggtatctgtcagttggagactacttcgatcaccatcatcagatatggccatatttttgtgcacgtgctctatcagtttctggttggtatgttttgtcaacgcatgcgcttttattacctccagctaatccattgtttgatcagattgatgcgacaaaaccagcccctgaggtgtttgaagatgtgaaagccatctttacccatatggcttgaaggtaagatgtcaacttctcttgccctgtggctgtgtgcacctctagtatgcagccgtgcacacggatacttcctgtatgactaccctacatgacttcttaacatctgccattataattttcattggcatctgtgtagaatataattttgattgtttataagtcgtatccttctccagaccataacattatgttatttttctgtcagtctgcttagattcatcagaaaggatggcaaacggatgaagttcacaatgtatcaccttataccactcctcgtcatcatttcattttttatcctaattaattgtctaaacaagtcgcattagaagctgtgaaatccatgctatttgcttaggtagataatcttcctcctgaagtaggatacagaatgtctcgcacacagttgttgcccttgattaaaaattttgatcaatacacataatgattgatcagatcatgcatatctatcatcaacagacatgccctcatggcatccttaacgttttgcaggtgtctcagaaaagcatgtacgcatgcagactatctctgcctttaacaccgaaagctcatgtgctgccgacatgtcactagataatcctttgcctgaaataagtagatctgtttcttgttcgtgctggggagccggagcacatgcctagtgtttttgtgcactcgtcgttgccctgtgcacttccatcagttcttaaactgaaactgatgtcacattctctgtgaacaacaaatgatctctgacctagtttcctgattttgatattgagggtgggagtcagcagcttgctgatgcgatcatggacgagtctcccgtagtctgtaaccttctgttgttactgtgtttttctctgaaaactggccttccaatgatcgactggcatgttgcgtgtgattgtgtatggatcaatggagccaggcagccagcaaatgcttggtcccctgaattatgtagcttttgttgttcttgtgtcatctggaacatcgtccccgctggctggtatgtagccgcttctgttggaggcttgcagtacctactagcggctaggtgtcaacttccattctcgacatgtttgttaggagtggtacataagcagccatcgctttgacttggtagaaaataaaaatacaggaacaagggatgggctcaacaatcatacctaatacttcctccatccaaaaaatataaggtgctcgtcgtctaataatagtatgaatctggataagctttttcgtttactattgtttatcttaaccagttaaaggccctctttgtttaggcttttaagccaacttataagtcgaaaagtctaagccaaaacaaacaagcaaccttttcatttggtttttttaagccataagtcactctaacactattaagccaaaagttaggttggagaagcttttttgggcttatatgagatagatgtatgactccaccactaaacttaggacattaaatccactggcttataaatcatataagccaataagctgacttaaaagtctaggccaataagcctaagcctaaacaaagagggccaaactatggatcatccggttaaagtatgggtgtatatactattccctttgtcttctagcattcaaaacttattaaaactagatgggtatcccgtgtgttgctgcggaagaattgtgtgataatatagtatacacgagttctaaaattttctttgttacctactataccattttttttcatgtgtttatatatttctttacctttactaattatccaaaggttataaataggttataaatgattaggttgtatgatgtgccttttaggaggaagagatgtaatttacactcctgatgaatcatccaaaagacttaaaacaattaaggtgatgtgaagagatgcattttacacccttgataaatcatccaaaagctaaaaacaattaagttgatgtggcttcatgagagaaaagagaattagcattaactatacttagtggggatcaactttatacatatacatgatacataaattttagcctatcgtacaaatcaaaatttattactttcttatcatttaatatcacttgcctactcaattgccatattttttttactactccctgtttctaaaatataagcattataaaattgtttagcaaaaaataaggatgagacgaaagattctctgagtcaccttggtagttaaattttaaattttgaattgatttgatttcccttttaagcacctgatttgctaaaaatgctgagattttggtgcattgattttgaattgatttgatttcccatgtttcaaattatctatcattttaggtttattttaagtcaaacatgcttatctgtaactattaattttttaagttaatgtagttaaataatacatgaattgttgaaaatattttttatataaatcttgaaatacaaatattacgatattaaactatatgaatttataaaaaaaatgatggtgaaaattaaaatgtttaactttaagtctgaatgaagaagcatttaaaaatcgagaagtcaaaagtgacgtagagtcctactgtatccattccaaaatattacaacctaaaaccggatgatactacgaatatggatacgcccctatctagattcataattttatggtatgttctatctaatcataggtttttatattttgggaaagtaatatgtgaaatcaaattatcaaattactaggagaagccaacacgtgtccagaaggaagaaagacaaaataacggtccattttaaacgtgtttcaggcgccgtccacgccccgtctccacggtcgacgcggatcaattccccttattattaacctgtcgcatctccgtccaccatcggctccccaccgtccgatctcccccgccggaatatcccccccgcaccgcaccttctccgaaaccatcggggattcttacgcataaccccctaaacttatccaaaaacaaaactattccccatcccctggaccagttcgcacgtgacgaggacctatatgtaaataacaatttgttctagaacttttgtggaaaacaaaaagggagggaacttttattgagctctttgtcgccttctcctcgaattaggaagagcaaaacagagagaggagaggagaggagaggagaggagaggagagaggaggaggaggagcacgcgttcttcgcctcgcctctctcgcctcacgggaggagaggaggagggcgattcggaggagggcggttgcctttgatcccattcccctcccccatcttctcccccgggttcggattcggtcggtcggttggttgatccgcaaccgatcgatcgagggggggtggcactcgcggatcctctcgtgttcttcctccagtgcgctgatctggacacggcgcgatttatagtctatcggccaggtttggatcgttgcgaatgcatccagttcaggagaaattggattttcttttttcctcttttctttttttacgggaatgcttattattgttctccggggcttgtagggcgtaaatttgtgcatttgctggcgtagttacagggtccgattagattgattgaattgatactgtttgtcaatatttgcaaatggtatttgcatttcatataatgggggcattcttagtattcccaaagtaaagttctatttgctgatatgagaacaaagaaagctagtgttattttttatcatttaatcctggcaattgtaagggtaaatttgaaggacaactcattttcaggtccattttcaatagatgatgtgaaatttgttttttttttaaatttcacaaaatatgtatcacctccttattagatgctgtttgtgcaattcacggtgtaaaagaggttttatagctgacttccatagttttgttaaaattttcagatcacaaagtttttcctcgccgtacattcaaaagctttctctgaagactttctacattctgaagattatattgggaataacattttaacatgaaggccgatcggttaatgttgtccaatctcgaccatgatttgggatacctacacaagtttccctcagattttccaatgtctcatgatcttgggttgagcttgtttacgcatgccggtacaatggtgggaagttctttgcgacagcacaggcagatctgttcttcaggaaatttgattgttcaggaagcatttgatcgcctcaacaagtttgccagagctttctgctactggctttctagagtgtctaatcccaagaatttacgtaggctaatgagtatggaaggccctagctctggagcttgccagtcacatatcaatcatttgagctcccgtatgcaaaatttggctgtattgcagtttggttatctagtaagagaagagcatgctgtacaactgcttttagctaacttcgcaagcacaacacttgggcgactctggaatgattttcagcagcaacatgcctgcaatgttcttactctggctggtgccatggctattgtaccccctcttgaaaatatgtaaggcacacagtacgacactttatttgtgccctgctcttgcttgggctctatgcttatatctcactgactgttcatttcactgtatgaattaaaaagatcactgaagacgctcgcagagtcaatggcactgggaaatatcaaggactatgtcagcagacctatggataagccttatctggaggacaaatgcataaaaagtagatctgttgcagtgccaagcacaatatttcagggagatgcaattgaaccaaaaactggaatcaagtttcctgcatttctcgaagatgactccagtccatctacaacggtaatttaccttattttgctgggatactttaccttattttttcaggtactgccttttggtacacttttcttatttgttatgtcgtaaaattattatcatgaatgtcttctctgtgtacctcctctttaataggcgtgcaggctagtcatgtaaaatccaatatacttgtattatgaactggaaatgaaatcctctggattaattcatttctgacaattttgaatcacatagttttattttatgtgttgatttaatatgtatacagaaaattgtacactactacaaatgatctgtggacaattgaattgagttagttcagtttagtcttcattttacatataatgtgatacttctgaactatcagcatatcatttttctctgaattcttagtgtgacgtctccatgtaacattattattgataattaattgcaggtccttgttgggatgggtttcaaaggtgtgaaagtaatgagggtcaaaaatttggatctgtacgcttttggtttatgtgagtaaatattttttgtgcttctattatgttgtttacctgtacattctacaaaaaaatgttctctgatgttccatcatttctttttaacggtgcaccatgcatttttcttgatagatctgcaaccgaatactatttctgagaagctgggacctaagtatgcttctgttccaaccatcaacttgaaggacaacccagatttctatgatgatcttttgaggtaggacctcgatatatatctccagtcttgtcctgttgttacaattctgcctattcatatgcttagcacacataaatgtggtagtgcttgcaccttttttttggcaactgtttgcacaagtttagtttccctcacaagatccacaggatgtattaaaaattgaactgtttgtgttattgtgctagttgatctacgtacatttcaaaacatgtgtacacacttgtccattcatgtgccatacatatatccatgacattattgatattttgatcttatgaaagtctatatgaatctacttgttatgaaaagtgattcttaacttgatacttcttgtgcatgtgacacttctttccaaaaaaggatgattacatgtgcaccggggactaatgaagttttgtatcttcaatttccagggaaaaccttcctatgagagttagattggtacttcactacaacggccttagcattggtgcagtgcgagagtaagtagtactctcattttatgtttacagagatctgcttgaatgtttctttgatttgtcatgtttgtaaagatctgtttgattgttactttctcataaaaaaaaatgactttagtctattcaagacgtttcattttacctttttgtgtttttctcgcagtgtatttgagaagtcacttggcctgcgcctccagaaggtacttgttggttgctgcttcagctgatacttttaattcttttacgagttcttcatactgatgtgacttctgtatttgtattttcaacagatgaatcccaacactgattatcattgcttgaaaacttttggttcttacttcaatgaagacattcctattcctgcggtaaggttgaacacaggatttggctaccgtatgtttataacttttagatacaagtaaacactgttaatataactgcagggtacaaagatcgacttctgccaaacttctgatggccagctaataacagaaagtaagtaccgtagaccgtaactgaatcttctgtatgtcttgaggagtgagttttctactgccacatccacatattttgacaaaaaaaaacattttcatgcagttgatggcagacaaattggtgctgttaagagcaaagacctctgcagtaagtgtatacttgtcacaccaaaacttatacaaatttacttcattacttcacactttctcaatattttccacccgcttcacttggatcactgtccatgacttgcatctggataagtactttcttgcctagtgcatctttatggtacgataaagttcattgtttttaactgtacttaactcttgcttggtgaacaggggctctgttcggtatgtacattggcgattcaccggtctcattgcaggccaaaaaagatattgcccaaaacgtagccgggctcataggtaaatgctgaagaaactggaaaccaaacgcagctagtcggccaattatttcattcttctatacagtaagaagaggaagcacacattgaagagattaggcgaggatcatagtatgtatatacatcgagagatctgtaacttgtaaagtgaaaaaagaaaaagcaaaatcgtaatgtacatatggaagattagcatctgtttacggcgcaagggcacccattcctttttctatgtggatggatggaccctctgccatttcatacacaggagtgacaggttgtatagtacatgagaaattcagatgcctcttccatgagtataatacaagttctcaaatctttttgcccatatggatgacagagtgatagttttactttactgcattctgatcagtgcacttccattcagaattgctcacactactgcaacataatcatggaccctttttttctaagtccgtggtactgatagttgtgaagtgtgaaccatatctatccgtatgtaatgaagcttttttgacagttgaattctatcaaccaacattaacagtacatgcctgaaccatatctatctgaaccatgtgttagctgcctcgtaattagttaagtacagcaattaatcccaagcaaggacactggcataaatactccctccgtctcaaaaaaagacaaaccgtgggttcccgtgccaacgtttgactgtccgtcttatatgaaatttttttaaaattagtattttcattgttgttagatgataaaacatgattaatactttatgcgtgacttatctttttaatttttttcatattttttttaaataagacggacggtcaaacgttgaacacgaaaatcagggtttgtcttttttttttttgactgagggagtaagcatgtgcagctcgatacgtgtacatgtacctgctcgtactactgtacgttgaatcgattgattaacgaggtgacaaaaagattggttcacatcaactggatcgatcacctggtagtcattgcttccccagcgtctgtcggcggctggggcaacgtgatccgggctacccggccacaatatgtttagagctagtttaatagtaaaactcactaattatttgaaattcattttaaaagtagcatgtatactaatttagctttaacattagctctatgtttttcctcctctctctttttctgaaatttaatgcatatttttaagcacgtatagagctatcttttgcataagagcaagtacaataacaaatcataaaccagtggaagagataaaagaagatagaagaaaagcgagttccagatagaagaaaaccagtggatgatttagagttaatagttggctatactattaaacttattttgagaacgaacacttttcacttttcttcatctctcttctacgtaaacatatagcttgtactctctccatctacttttgatagtcatattttatcttggtataatgaccaaggataagtaattatacttatcatctatttaaacatgctactagttatttctcgtaaaaaagcgattcattaatatttacatttctcgatgcccatgtcgttaatcttgtgtggatgaatgaagagtcacgcattaaattcgagaaagttattaagaggatagggtgttgtattgaaatatgcctatcaaaagtaaattttttagatttagaaatatgactattaaaattagatggagagagtatatagtttactattatctttgctgttagcagtagtacatcgtcttgggttgagcaaattaaatcatcttcggtaaatgcgatgactatttatgtgggggtgtacggctgcacgtagtacgtgcgacagatcgtcacatgatccttgattagttttgtccatgcaaaagttacacatttatgatttactcttaggagtatatatgtatgtgccatgtggacagtggacctgaattggggtaagttttggatgtacattctttgtgtgggtagtatgtgtttgttctccaaatttggcctcaccactaccaagatctagcgcgtgtttactttactgtcagttctaatcctaccatgtttcggtattatcaaattttagtatggcaaggaaccaaacatgtttttaccaatctcatcctaccagtttttgacaattttagaaatttctactctgaaaaatttctatcaaaatttggtaagaatttaaatcaaacatatgggtgttaaaagtgaacaagcccctagtacatctttgtgatagctaaaaccattcctatgaacaactccaaaaactaaatggtatgttttaaaattgataaagtcaccgtagatatctcgctattgatgagtacatcgccctaccacctaaaaaactagccataaatatgaacacccgtaccaagtctagaacttgaactcaggtgtacagattttactactagaaacctaactagttgagctacggccaggggcggatccaacgtgggtgcagcggggacttgagtcccccctacaccaagtcctccctgcacccacaagacccatggataccccctggagcacccccttcgattttttcaccattaatgaaatttaaggcccctaaatggctagaggttaaagaaactgcgtaattgagccccccccctccaattttttgttcctggatccgcccatggctacggctatttcacggccaaaatcattttgcttgcacaaaagacaacttttttaagaaaagccggtaaaacatatactgaagtcttatatttggaaagaatgattttctaagtgccatgggaatcaaattaattcatataaaaattagtatgtaaaatttctaaattcaaaagtgcccatgttggtagtttgattcctgaacaatgagatacccacataggtagaatttcttgagaaacgataaatagcaaaatagtagtagtagtagtagtagtagtagtagtagtagtagtagtagtagtagtagaagaagaagaagaagaagaagaagataccaaaccattgtgtgtcaaagacgcacaaaatccaaataaataccacatgggtccttaaatccattgcatcatagataaatatctgtgggctgcaagagtgagctaataataatgtgtactcccacaggatcaactgctttatcaggcagtgtatcctcattaaccatttgaaggatcgatcttgtattgttgttggtagctaggtaggttagttagttggtcggtggttgtttggccgagcaatggaccatgggagacacgctaccgatcttttactatggtctatgggcactatatgttgatcgctagtgggcgagtataaatcaacaaatttcacatctaattattgcatttattaccctgagctttcttgtcttaattaatttgcacaatatatatatatatatatatatatatatatatatatatatatatatatatatatatatatatagtaggttctagatgcgtagttctctaatgcacttatacgttgagtcgagagaattacatcctctgcgttaaccttgtatctcccattaaccctgaggaattcgcatgcgtaatccctgcaaaggaccatgtctctaggttgcttgtgacacttaatggcatatcatagaaggaaaaaagttaaattttgtaattagaaaaataattgaaatatattaactgtgtggactattaccggccaatatgtatgtattagcagcttctccctggtttgaatttgctctccaccctttttcttgtagtagttgtacacactgtacagattctttaccgtttcgtattaaggaggagatttaattataatatattaatagtagacatgcaagagtatcagaatcacttactattgtaaaattgttagaaattgtttgtacgtcttgtgatgataatcaagggggtcgaggactgtcacggagccgtgcttcgggtagataatgaaacatatgtaatgatcgctacatggtaaggaaggtgcagttagttacggatgagataacacagatatgtaaaaaaaacctactagacttatttaaagttgtacgcggctagaatgactcttttattttgaaagcgtaagaaggatcatccaatgtattgtgcgacagtaatcaacttctgtttgtgtaagcccttcttatattctatctcttcaggcgtcttgtccttgagctgcttggaatttggtgattgtgtcacggtatgttgtgcttgacagatccttgttggatccagatatccgatagattgatttgtcttctcagcatccatgtattacatcctataaaagcagtttgttaataataatcacatgtaaacatgtattatatcaatttatttatataataaatgtgcactcatactcacaggcaccatgcaccgacgaagtttacgtccatcttatcgcgacgatagatggtgtgcagatcagcgaaatctagctagaagtaaccgtcgccggcgaagcagtcaggcggtgatcgaattgttaaattagttaggcctttcttgctggcgtccatgtaccacttatgtaaccttctcatcttccatggaccatcatcaagtgcatgatctgaccaaaaatgctttgccaagttggaacttttccaggcacagttgcaaagaattttggtccgtaaagtaaaaagaaaaaagaaaagaaaaaacattgagcttttcttcacaattttgcatgcatagattcatcacaaagagagttctaaaattataaaaaaaaatgcataacaagagtgtaaaggtgtagatctaaccaccgtagaaaaatccccctaagatttgaagttcaaaaaccttccccccccctatatttttggtgttaggggagagagaaacctcggatgaaatgaacagggctcgagaaagaagaagactttatagggctattttcgcaggcggaccacataaggggccgcctgcgaaaatacatctttgcaggcagcacacataaggagcccgcctgcgattattgcaggtggcgcattatgtggtccgcctgcaaagatcatttacgcaggcggcaccttatatggtcctcctgcgatatgctatcttcacaggcggacggccaactcctccccagtaatcattctcgccggcggggttttcgctccgatggccatacccgcctgccgaaaaaaaagcccaacatcgacgaaaatgctttttctaatagttaactcctctaaaaaagataaccagctgaattaaaaattaagacaaattacttatatatattctaacaagtaattttatatgtactatactatccaaagcggaacaaaagatccatagctaccttatctagaaatataacatcattacgcataatatccttcccctcttgtgatagtatcaacaaccaagtgttgtgctagttgaagttgaagataacccacgtaggattaggtgatttattattgtcaaaaatcatttcggtaatgccaaattaaacaatgcagtgcactggcccaaatagaaccatctttcttaccatggcaccacatccaatttccaaatatatttttggcattgccggaaggggatactaaaaggaaaaaaaatacacattgactatcaaacgacttgatatataggagtatcaattatttcttagagctccaaataggtattactaccttgcatagaatacccagctctctgaaaagcacctaagtcgaaacctctcttcccacaaacctattgatgtcctaatcctcaaccacgtgtatgtgacgtgaacgctttctgataagcgacatcatacaataagtactgggttagggtttcgagggtgagtaagtggaggttggaactgggaagggggagatagggaattgggtttagagggctagcctaggagacggcggaccaaaggtgggcggcgaggtggcgttagcgccggagccagggtcagtatagggcggtggggcaatgttggtggcatgagcacatcgacacaaatggggcggagaggaggacgatcgagcaagccgcactagcacattgacacctatcagtgtcggtgaggtcaggtgacaacatagtgagatgatgacagcaaaggagacatggaattgaagctaacctagatctagattttgagaccaaagaggagagcgcgtaagtaatgagctagactatgttttaagttcgtggctcgtctattaggagaatccacaaacttaaacaacgagaaaaccgctaaaatgccactgcatagactggactttcaatacaatgctacttcatgcaccccacactagaaaatggtactactctttacattgtgtcttccatattttgccagttttataacgttctagagcatttttaccaaagcagagcgtgtttctgccttatacttggtgggtcccacacgtcagtgtgtgcaaggccatggtgccaaatcccaacgaaacacccgtcgcaagcgcaaagccccacgcgactcgagccccccacccttcgtctcgtctccgaggcgccgctccgcttctcctctcctctcttctcttctctagttctcttcgcatgtgagctcgcgcctcgcgagagaggagtggggggtagggagcaatgccgatcaccatggagagcgggcgcgggcacggcggcggcggcggcgatctgttcggcctcgggggagctctccgccccgcggcggcctcggcggcggcgtcgtcggcggggtggggcagcgacagccgggtggggatggtgcactgcgaggacgccgcggcggcgggggaggaggaggagagcgacggcgaggtggagagctcgtacaggggtcccctggacaccatggacgcgctccagcaggcgctgccccgcagccgcaggtcagtttttcacccccaatccgcctcaaagcttcgcgcgccttaagatatcgagcttccctttggttgtcgtgctgggttattttggatttcgaatgcttttctagcgaaatcgttgagggtgccttcactgctcggatcattttgagcagtgtagatggaaatttactgaaatttcgattcggacttctgcttcatttggtgtcagaatcattgatcctgtgcctctgccgatggaaaatttgaagacttagggtgatatttttgtactattgcagtatatatattcggaatttttttgtcgaaatatgtcgatcactgatccttgagtttttttttgttttttttacatgttacgttaactaatttggggatttattgagaaatttctggcctatgagggatgatcgttttgatgatgcgtgaaaagtagcatgtgttgttgttgttgttgttgttgttgttgttgttgttgttgttgttgttgtgtgcttaattagttttcgagtgggcagatgtgattaattatcgtttttacttgcgttttaacaatgtggtcgggaaattgaacttttgaaacattgtggaaaaattaacttttactgaaggagctcgtggttttcggaaggactaaggagctgtttagctgtgcaggcttgatatttggtactccaaactgaaggagtagttttgttaggtggtgctagtattctctttcacgaatatacatacaaatttgctagctattgttcccatcgatccataggaacatctcgcgtcagattgtctggcactacagtaaagcaggataccttttgaatgctcaagaatccaaaaacattgcttaattatatttgcgttgagcactctgcagttacctagtattacactattactacattgttccagtcttccaaagaatatgtgatcatgctgttatcccgcagacatgttacaggaagcacaattagttctctaattcattcaacctttgttaactctcgtgtccattggacactctgcaatattactggtataaacaagtttaatgtaatctatacgcatcacaatgattttatttcttgatttgaacgatggatgcagcttctaagcaatgtccatgcaatattgctgctgccggtgctttttcttacagcgacatgagttatttattgctgatttaaatacatgtagctttgcttctgcagttggcagtagcactagcactagtgcttaatgggctaatatacctgccaacaatgttattcgcataaaactttaattgaccttatatggcattttaattataagcagaaatttatcatgtgcttctgaacatgatcatgtgtgtttggcacgtaattagtgcaagcacaggatcaaacagacaaaaagactttctttcacatgcatatgttagccagctggcaaactattgttgataaacattattaagtactaagtatttagatttttgggcacttgccttgaattttcttcacatttcttacatttgcctgagagctcgttaatctcggtctaatagcaattactggcaggtcctttttcatgtcttaatagaagacatatatattccattctgctgacttgtttattgtttacctgtgataggagaagagggaccaaattcgacaatagcaagtctagtttccttgtgagtgctaaggatgatgtgttgtcttctcaacatactaaaccggaagttccatcccctaagaagcgcaagggtcttcttccaagctctgtcgacaagaacaagtcacagagtaaagaactgagccctgttgacgatgccaccagcagcccaacaaattccaccagcagcccaacaaactgcaggaaggcattgtatccggctgttgtagacagttctccaggcaagaacaggggctacgacgagcgtgagtgctgtaaaaaccggccttgccattgcctgcagacaaaaagcatcaatgtaatggatgcctttgcttctccacctattgcacttctacctgaactaacctcagttcagacgaaacttgtcgcgattagtctcaatgaagtggcggagttgactgatgtgatttctcctagtgaaaagcggagaaagaattagcaaaaccagtgttatgacattttgatctgttacaacttcaaccaccggtgtccattttaggctgtgtatccagtggtgcgaatccagagaagactaaccggttatagtgtacaggtttcagggttattcccttaatatataatgatgtattgatatagatacgaacttgatcaaattaggctttgtcagcactaactggtggtctttagcaatgttgacatgaaagttcaaaagaaattgattcaaacatgggcaagtaagacactacaatacatggctagagctgagaagttggataatttttcgacagtatatgagcatatgcacattgtaaaatccagttgacacacttcaactttctgtaatttgtagcgacgatagctcaacgccgatcatctcttttgtagttatatgacgagtatgatcaataagatagtctatttttagttaattgagctacttcgattttttaaatgactgatttataaatcaccaaataatatattatgtctagacagaagaaaaggcagatttcacagatttcactaactttccgttatactcgaacgaatttgagtcaatttaataaatactacagagtcaaatttttatgacatttccttagtgctttaattttcctgaacacatgtcaaagctcaattccttattcatatatttttcttatcgcaagaatattcagtggtattatatccacttaattctagaagaatgccgttgcgttgtaatttcagaaattagacatctccacatatttgagtataaccctttatttatcttcagaatgtacaaccaatgtctgtccaaagagaaaatttgggttggataggtcagtcaatggagcagaaacacatcagccggtaaagttctcctgcagcaatattataattttcagtttagtcaattctcaattaattgtaaagcgaaatttgtactaattaacagcacaaaaatattgtacgcgagctccccgtcgtcggacagcacgctggtgatgccgccgctgctcttcttcctctcagaagaaatttccagcaagccgatgcggatgctgttctgctgccctcatatgccccttttctttatgaagatagctcagagctgcaggactaaagagagtaaattttcagtccatttttgattcattagctaaccaaaggtaggaataaggaggaaaagctcagagctgtaggagcttaactgtctgcaaagatgacattttgattcgtatgatgatctgatctcctagtaggtcgaaaatctgccaaatgttgtgtacatgatgtaaaggatgcgaaataaagtatgatttgtggtcctttgggaaaatctttgtgctggttgcataattctttgtttgatcagcttgtaaatgctgtaaatcaaataattgattgcataatctgtggtaatttgatcagtttgttcaatgcggaaaaaattttcatgatattttcataaattattaaccaacatataaagaagaccataagctatatgcctatatgcattggttgtaagtagtaagagcgccaagggcacgccaattttctagttctcacctagtgcagcttgattctcatgacctaaaaaacagtagtgaattagtagggaagaccaagaacgtgtaaaactgaatcagattagtaaattataatgattacatgctaccgcacctaaaattgcaaacattacatttacgttgtgtgactctattgcacaatagatgagcaatacagataagagcgcaaagaagatttggaggcaagaaaagtgcagactatggaaatcaagaaaattaatttgctattgttttttttcctctttgttgcattttgaattagaaactgtatgtttttactaacggtataactattgttttactattacttttttttaagtctcgaataccccatcctaagaagagatatgtaaaagagaagtaaacaatcctcacaacaatcgtcatcgtcagagtgaggaaagcagcagcaggcggtggtcagagaagtcagccgagcaatcccgccattggagcacctagccgctgggtcgaatgccaccgccggatcggccgcttcgccgtcgagctggaccagctgctggtaaggcgggggagatccgcgttccgctcgaatcgaccgcggcgacccccttgcagtggatggtcggcggtggccgacgaggaggaagctcgcgagcatgtggtggggagcgaattgaggagggaggcggctgcggacgtcgcagccgggggcggcgcccctcgcctccttgccgcctcgtcggcttgagctcatcgccggagggggaggggaacgctggttgctgcgcggcggcgccggcgacgaacgcgaggagccaaaggtgggggcgaagcgtgggaaaaggaaaggggccaaacgggccgcacggcctaggcacgattggttaaacgggccgtgctgtgatggcccaacgtgccgagcagggagactacgaacggcccaacactttggcgggccgtgttgagccagaggcaagcatgccagcccgtctggcccgcaaaaaattggatcaaaggaataggactaaatattcctacgtattgcaattcttacaccctatttcttaggaaatttagcatgagctcacatttcatattttatttttctttgctaagtccaatgcacattctctctttctctctactcttccacgtatgatttcctccaaaattcctctatttactgtgaaccatcaaaaaatgttacctatagtgtccatatatagtattttaaaatcctgtaatattacatagcttgtgataatctattcttatgcttttatcctattccttgttttaaaaatcatgtgttcaaaggaatcgtgatctttggactttgaagtgtgatcaagaacctatttggaggagcttccggccaccgtaacttttctcagaataaaaaactcccaagttataatctagattcggaaaagctactgttacacaatccaaaaatataacaatttttagccttcaaactgtcctaaaatataataacttctccatctacattctcttttcaaccaataacaatttttcagcatttaaaaattttctatctaattttttttctcaaccaatcacaacattctcacatttcattccacctactttttaaataccacatacccaagcctaaaactccttatatcttgggatgaaagtagtagaagatagaatccggattcttagaatctattccctccgtcctaaaaaaagcttaatctaggaggggatgtgaccatcattagtccagatacattgtcctaagaggagtcagattgagttttttttttgggacggagggagtagctactaaacaagtgatctattcagatacgttgtattaagttgtgtccaatccctgcttggttgctacattcctggagtaccagataggggctaagtttgagcattttcccttccactctcaatatttttccatcaaaaaatcgttgtgggttgcttttgtgcgactagattgggtttggaatatgcgtcctgagttcagtaccccgagttcacgagaactgcattgcgcaccgcccctgcccatcctccttggcccactcatcaatcaatcatctcaggcagccatggcagtacgccttcatctcttctgaactcccctactgttctctcccatccggccccagcatcgctgcacagcctcgcatcatttacaccgtccctgactgactgacgatgcctccatgggctcggcgacaacggtacaatacaagcacatggcgatgccaggagatgagaaaatccaagagagaattcaggtgtcacactgaccaattataccttctcaggataccatatgctatactaggagtactatattgctactactactgtatcagatgccattacagatgttagtgcaaaacagaaatgctgaaactgaaacaccaccctgcgaatttgtccaaaccgagagactattagtaataccagttccagcattccaatcccagaaatgttacagaacagaagaagctgtcttgagatttagtactagattcatggacacctcctaagttagacaaaaacgagataaaaaaaaaggaagaagaaagaagtaggacgcattttttttacagtaaagaacaccagccacaacccttgagaattctcttgttaattttctgggcacccaacatgtggacaaagtcacaaaacgtgagttcacttcactaccttgattagcttcaccagctgcttgcctgaatcccaagatcggatgacgatttctgcagactattctactctgtgttctgagaaatgacctcgccaaacttgagaaacagctcagcatcggaagtacacgacgagttggcgcaggagagcacgctggtgcctcttaagctgacatactcgttgatgtagctcgggacagcaggccgctgcggcatggccagctgctgtgcggacttcggtggcgggtcgggacgaactaggcagtccaggacgcgcacaacctcgtgcattgtcggccgatccgatggttgtctcttggtgcaaaggagcgccagctggaacaccttcttgacctcaccaagatccttgcaagtgtctgcaatgtccgggtcgactgtctccatgacagcattgttagccgtctttgacaagatctgcatttgcaacagtagaccaagaattgtaacagtctgtacattagcaaggaaaaccgataaatgaaaagccatataagcatgtaaaatcaatgagaaattagggtgactctccaagtcggaggtcggttaaatgccaagtgaaggcgtaaaaaatgtaaatggctgcaagaggaatttttatgacactaaattgtagctttcaatccacataattgatgacaggggacaaaagtggcaggctttaggggacttaaacactgcaattgataatggagctttcaacagccatatgcgatggatcaatccaccacacgtaaacagtgcaaatagatctactcacaggataggtttcatgttgttggtccccatgtaggaacacaagcctaatgggcatcattcagcaattattgagggctaccagaatccaaagtaaaataagctgaagaaaatgacagattaacagaagaatcacaagagcatgaatcatagttaccaagtgatggagattgcactcgttgtccactggcttttttccggtcagcagctcaagcagaacaatgccatagctgtagacatcagacttttcattgagacgggaggtgcgagcatactcaggatcgatatagccaatagttcccatgacataggtggacgtgtgagtttttgaaacacacaaactcttagcaatgccaaagtctgtaagatgtgcctcataatctttatcaaggagtatattttttgatttcacatccctgtgtattatccgtgggctacagtcatgatgaagataagcaaggccttgggccgcacctagagcaattcgtagacgagtttcccaatcaagttttttcttcttagttggaccttctagaataatgaaaaaaaagattttaacatggtaacaagatgtcatgtaacaatttggtattgcaatcaacagaagcaaatatcaatgtgtcaaatatcatgcttttgagaatggcatgttggtgcttctgtgcaaattgcaatgacaatcaaactgtgcaatgagttggcagtcggcacttaccatgcaaaacatcccagaggcttccattttccatgtaatcgtagaagagaagatttccaacaggagatagggaatatccttgaagactgactagattccggtgtttgatgctaccaacagtctcaagctcagtttcaaattccttgaagctctgtggatagtgggcatatagcttttttactgccactggtttgcggttcttcgaaacacatttataaaccgtgctggatgctccgtacccaatgatgtacttctcactcaggttttcagtcatcgtcattatatcctcgtatacaagaagggaaaggttcatatgaaggataaccagcttggggggaacattgctcactgtgacagcaaatatacagcgctttagtgttgctctaccattaacccagttatcaggtaaaaacaaacaattgactaaatacaataattgctggacaagatagtatcctaatattgaacttggcaggagagaaatgagttgatttgttgagcaaaactccttgcagatgcattacctggtttgctaacagagacatctttgaaaacaggtggactatgaggcctgcagaccgttactaagatcatcaggaggataacaagcccacccacggcaattccaagtattgcagcctttgagattagtgctgcaaataaaatgtaggtaacgaaaagttgactttgtctattaggtatgaaaaaattatgtaagatatgaatggaatatttgttacgtttctgttgatggccagatgaacggcacgaagaaccaagccaatatccacaaagtcctggattacccaaaaagctaagaaaagtatcacattgttaaactgctatttccaaggctgagtaaatgaacatgatagtgatggaaatgatggagcacactacctgtcaggcgaaaaccgtgagaagttgttatcagtaggtacaacaccagccaaattattataggatacatttctgatcataaaacagatagataatgtgagcaaaaaacatatactggagcatatgcttcaaaaattttctggttattcaacttacaagatattgaggctgaagcagttcatcagtgaagagacatccccagttatgttgttgtttttgagatttctgagaatgatagacagatgtctctcaggctacagattcaatgtccttatgggtttaaaaagaaggctgacatgaaaggtactacttacaacaacatcagattttgcagcattccgagttcttgaggaatcaaaccgccaagatgattgttggacatatcactgaaaaaccacaaatatggggtatagtacctatgggactagatggttaaaaaattcacacctaagcaaatacttacatctccatgatactcctcaagttgccaatttctgcaggaatgaatcctactagaccattgttgctcaagttactgaacaaacaagttcaataacatcaaacactgtaagacactataatagatacatacaagatggggacaacaaaacctacagtcttaatagatgctccaaactcccaatggttgatggaattgggccagtaatcatgttacaggataaatccctgatacaggtacctcatcacacacacaataggatagaacagatattttcgaattcatagatggagctaacaggacttacaaggtgtccaaattgttgattctcgatagctcaataggaatagaaccacttagaaaatttgatgacaaattcctaagaaaagaacagatgaacatatggtactaatcaaacatgggaaacaaggtttttctatgtgaaatacaaaaattaaacaagtatagaagttcaaaaggaaaaataatgtaacaacacaatttaagaaattaaaattgttacaacttacaaataagtcatgctctcaagtttatgcaatgaaggaggaatggtcccatttaatctgttgccataagcattgctgtaaagaaaatccacattagatacatgcatctgaaattgtaagttccaccataacaattataattaaatcatgcttacaagctattgagattcacacatgagcttatgttatcagggattggaccttcaaagttgttgtttgcaaggtttctgtgaagcaaagagtaagataagccgcttgttttactaataaattatagaaaacataacaaattttgaagagtttgaaaaaagagcttacaagtcaaataaccctgttagctttccgaactctggaggaatgaacccgctaagttgattatcgttaagttctctgaaattagtcaacaatgacataaatcaggtcgcaacaaatcagaatatgctatgggaataaaataaaacgtgcacttacaagtaatgaagggttgacatatttccaagctcaggtggtattggacctgttaacttattgccttgcatatacctattggaacaaatataacatattaatttacacaagaaatattcctaagcagaaccttctaaggcttttgttttttaactatgaactggcagtagaaaatctatcagggaaaatattcacaacctaacgatttaggagaaaagaaaacttacagcttctcagtgtatgttaaattgcctagtatcgatggaataggaccagacaattggttgtaactcagatccctggaagagtaaagttatattgatgaattaaaatatcttgaaagcttcatttatcaataaccaattgtatgatgaatattcagttcatcattgtacttacagtacagcgagagcctgcataagtccaataactgatggaataggaccagtaaacatgttcccttgcaaagatctaattcaaacaatgtgaataatcatgcagatcagcaaaaactgtattaaacatttaattgagtttttttttgtcaagataatcaccacatacagtgtagcaacttgtaggaaaccaatgttgaaaggaattgatccagaaagtttattgtaagacaaatccctaacatgaaagaaatgttaggaaaacctcacaaacacagaagcagaaaagttgtaattaagaggggtaagctgcaaatacgtacaagacctgaaaacttgtacagttcccaatggtttctggtatcggcccagtcaagctgttgttctttacgtcactggtccaaatgattgaaacataagtacaatacggtggactcgaggcaaattttgccgaaaacatagtatgcatatactcacaagtaccaaagcccagtcaactggcatatatctggggagatgctgccttctaaattattaccgcgtaatcccctgaggataatattaattcagccacaattcataaaaaaaatatgagtattttacataacgcaacttgcgtaaaatgctagtgaattcacataaagtcaatatagatttttaccagcttaacaaacttttgacatgctcttaaatacattcaaatgattttcaaaaaaaagaaaaaaaaagaaatcgcattcaagtaggtacataactaaaatacaataaaatactgatatactagaactactgcacaatcttcaaacttccagcgcaaaataaggatgacttacaagtattgaagaacctcgttccaatatatcagtcttggtatctctccactcagtttgttctgtgccaagtccctgcagggcacacaacaattagaaaactgggagcacggtaattaaacaccacaaaaataagaagtttcgcgcaacttacaaaatcttcaaatttgggagctgtgagagcgttgatgggatcactccgatcagttggttgttcttcaatatcctagaaaaccacaaacaccggcacatgaataaaactatttcacagaacacgatcggcatgtccatacaacactgcttataataaatgaattccagcaagaataggccatacaagctctcaatgtgcttcagcttcgatactgagaacggaatgtccccatccaagctattgaaagacaaatccctgaaccaaacacatgtatcaacccacattctctccgtaagttaagaagaaatcgataatgccgtccacactccacacaactcacagagtttttagtgatgaacaatcgccaatctcatcagggatctgcccagacagcccattcgacttcaagtcactgcaggtacaaacccaagctcacaagttactgcgagtccaagcaccagcaagccacatttccaaacaacaacaaagtacaccaccacgtcttccatacatcgagacgatgcccttcaacctgccgacggccggagagatctcgcctccgaggttgagcccggataggttgctgctttgcaatcaacaggcatgatcagtgacgaaccagtggacttgtcagcaagaaaagtagcgaactcggtggtgttcttcttacagcgcggcgacggcgaaggtgacgttgtcgcagaggacgccgcgccacgagcagtagtcgccgccggcccaatcgtacagtacgttgtccacattgcggaaggacttcttgatctccagcagcgtcgaccctgaatgcaaatacagccacattagaacacagatcacaaactgcaagcctgcaacagcaaatggattctagaacagcacaatctgcacagatttgttcgccccggaaaaaatctatttacgtagtagtactaataaataaagatttatgtttcttagccttcaagacaaaaaaaaaaagagttcaagaacatcagattggaaagcacaaaaatcagcacaatagtaaagtaaaaggttgctacaaagcctaaagattcctgacgcgggcagcagcattcggctcatcagattggtagtaacatacaaaagaagaaataaagctccttccttgaacaatgagcacaaagattcaaaaatggccagacgacttcttgataagtaacagaataccaaagcagaacggagtcccttgtagaacaaaacagaaagtgaaaaaaaaaagaatcacattatgaaatattggtggattacctagtggctaccaccaccataaacaaaatgccagcaactgtgttctagtacaagaaggaagagaagagatggaagtggcacttgtcacaactcactcacaaggattagttaaagtattagactcttcttagggagatcttaggacaataaaaaatagtagtaggactatcacccacaagagaatcaccatgcctccaaaaaggaagagtacttgcaacactaataaaatactaatcccatcaaaccaactcccccctgaatctctctgctccccagtacacaaaaccacacactccccccagcaagaaaccaaccaaaaccgaaaaccaacagccagctagctagccagccatccacccaccatcatcggcaacggcgacggcgacgagcaggagcgcgacgagagcgcggtaggaggcggccgccggcgccggcgtcatggccactgctgctccgctgcgaggcaccgccggggcggcgatgacatttacaggaagcgaagtatatggaagatcagaagatggatggattgaagcagcgcgcctttatgggacgcagctcttggttggtttcttgggttctcgcgctcctctttgcgcagctgcggccgctggcgcagtgacagcgggtagctgtatggcttgtgctgggcgatagagtggcaggggctagctacgtgcctagtagtaggctagtaggcttgtgaagttttttagagagagagaagagtgatttgctgtaggagaagatggtgagaggagaggagagagaaaaggaggcgatggccgatggacactgagatgtcacatcagtgtcgttgttttttttttctcagtatctatctggttggcctagagttggtaggagtagaactcgagtcgcaagtcgaggagcatggtctcactcgcctatgacatgtggtggtccactatatttttcatcagtcgagtatactcataagtgtagcttacgagtagctgatgcagtttatacttaatttagtctctctcattaaaatataagtctttaccatatggacttatatttttataagagggactaaagtttagccccactttagtccctccaaccaaacaccaccttactccggtattcaactagtagctagcaagcgcatgtttagtcggtgaaatttgtacgtggtttgaacggatgtcggaagtgttttcagacacgaataaaaaaattaattttataactcgtctagaaaccgagagacgaattttttaagcctaattaatccatcattagcacatgtggggttactgtagcacttatggctaatcatagactaattacactcaaaagatttgtctcgtgatttacatgcaaactgtgcaattagtttttctttttttctatatttaatgctccatacatgtatccaaagattcaatgtgatattttttggaaaagtttttaggaactaaacagcccctaactgtatattggtgtcctattattacctctgtccacagttactccctccgtaccataaaaacccaacatagtactgaatatgacatattcgagtactatgaatctggaaatacatctgtccagatacatagtagtagaaaacatcgcatccaatcctagattcgtttttttgggacggagggagcacaatagtactggatatatctcatccgattctactctcttactctatattttacgggaaaaaatacccgtacattgtaacaggtgaatgctattttaatcatattattgttattttttatctaaaaagtatatgggatttttaatttgataatattgatatctaattcagaacccttattaggatgatagctatatcttgtacgttgctttcttatgccagacaagaattccaaagaaattaggactacgactctcgttacaagatagcatgtgagtttttttaaggattttttatatgactccttatgtatttccaaaagcgaaagaacttaaaaaccgactaaaaaatagacgacgtaccaaaatatcagtggaaatatcttcaatttttacaatagtagatatacttcttgtcccataatatgtcacatcctccaaaatcccttatattatgaaacggagagagtagagaagaacgaggaaatacaagattagcctttgtttattggagtcctttttgggttcattggattcatgccattacaaatatgacattttagataaatgacactaatattcatgatattagttacgtgccactgaaatttgaagaaattggaaccgtgccactccatcacgttttccgttagacccctagacgcgggacccacatgtttgttccatcttcctccatcctccctcttctgtcttccctatctcttccttcatgccgcgactgctacaaggacagtgacaacgacagcggcggctctcgatccctcccgccacggatggtgtcgaggacggtagtggctcctaagccctcccgttccagatggtgtcaaggatagtgacgacggcggcagtggctcccgaaccctcccgcgcggatggtgtcgagggaggcggcggcggctcccgagccctctctcgcggatggcgtcgaggagacgaaggtggcgatgcgggcggcggcccccgagccctcccgtcgcaaatggcgtcgaggatagcgacgacagtggcggcggcggctccagagccctcccgtcacggatggggtcgaggacagcgatagcggtggctcccgagccctctcttgcagatggcgttgaggatggcggctcccgaacctcctgtcgtgaatagcgttcaggacggtgttgtctcccgagccctcccacgtcggatgggtcgaggatggtggcggcggcggctcccgaggcctcccaccacggaggtggtcgatgacggcggttgcgacggtggtggagagagaggagaggggaaagagaagagaagggagggaggtatagatggaagtgacaggtaggtcccacgtgcagttagggctaatggagatttttcacgaaaaacgtgatggagttggggctaatgggccaatctcccctaattccattgtcacgtagccgatatcgtgaatagtagtggcatttagctaaaatgatatatttgtagtccatggatccaattaaccccttttttatacagcgaagtctagacaattttatattttaatctttgattcttggtgttaatttaggtggtattatttttttattctcagtctttgcttttgaaccattaaaatagaaaatcatattcttacgctagaagtatgaaaatttaaagcctgaagctaaaactatttcacattttttaatttatctttagcttgttgtacaagtgatgggtagaaaatgccttttatcacttaccctgatgtttttttttgtgtggggggggggggggcgcgattcatgcgtttcaaaacaccggggttggttaattttgatattttgatgctgtcatatgtttggggatgtgtgtttcaacaggctcatcagctcgatcacttcctctttagcttactagccaaagctaaaatttgaattttaacatttaatttttagagttgatttgaatgtttttagttcttacgtcataatttattttaacatacatgtatgaaagttttatatatagatgattttttattacttataagcatgaagattttaagtcaattccaaaacgattgagctgcaaatagaatagagagatgcgccacgggaaccacgcagtaaggatgagacctaaccgaggacaacgatgattagtttgcttagcagcttccagacccatcatatttgtaaataaaaaataattttgtgaataaaacttttatatatgtgttctttacgatctaaaagtaaaggctgaaaaaagactttgatgaaaaaaaatcctaaaattaactttaaatttaagttcaaaaatttaaattttgactgataagcataatcataagcgaaaagatgaggccgttcagttccaattaggttgttttccgttgacggtttatttctctagccgttataacagggatggctttccttttagtatctacgtacgtgatatatttctaagttcgtgcatcaaaaacaagtattttataagtttatgtattagattgcaacttgataaattcgtgtatggttgatgcaatttacccgtcttcttttttttctctgccacagctccgaggaggccagggtttccctactgttttggtaggaaatatcgttatcctaccatggttttgcgaacgacgagattaccaagaaaaactataaacattttaaaaactaataggcttattacttagggtgtgtttagttcctgaaaaaagttaaaagtttggaaaaagttggtagtttggaaagaaaagttactccctccgtcccataatataagggattttgagtttttgtttgcactgtttgactactcgtcttattgaaaaagttttggaattattatttacttttttgtgacttactttattatctaaagtatttacgcacaactttttattttttatatttgcataaattttttgaataagacgagtggtcaaacactacaagcaaaactcaaaatcccttatattatgggacggaggcagtaggagtttatgtgtgtaggaaaattttagatatgatgtgatgtgatggaaagttgaaagttgtgggtgaactaaacaaggccttacagtatgagattaccatgacaagtactctctccgtcctataaaaaaaccaacctagtaccagatatgacatatactagtactgaaatatgtcacatccaattctggattcgttttttatgggacggatgtagtaccagataattgtgtgatattgaactcaaaaaattgttcgaatttccctttgaaactcttgcaggatccccttgaccacttccttgctttgcttcgacctactaggaatctccttatatgttttcagaccaactaggatttgatattatcaagtactataaacctgaacgattgtgtctaatccgatattatattgttatgttttaaaacgaaaggagtacttcacatatgtagaccttctaatagtaaacaagcaacaaatatatagtttcataaatcatgcagagtacttgttcttatcatacttgttcacaaatcacaatccttcttatcacttttttcatatcaaacccccaaaaaaaaaataaaacgagtataagtatactctcaatccatatattccactcagactagattgatttgaaaaaaacatggatttcagttgggccttcatgtaatggataatggaaaatgtagtttttgtaatggataatggaaaatgtggtttttttcagttcatcaggaaaaatgaaaaccatattcactgttctcttctgtctaaaggttcctttcaaacatatgaatgtgcaaaaaatcaacgaagctaacgctaactggaaatacatggactactttgaactaaacttcagttggctggattagcaaatgtaagcacgtcaactgaaaaacacacgactaaatttagccgatttaagccaataccgacatgtggggccagggttcactatacccccacatgtcagcacaccatgattgatccaacacgaaacgtgatgtttatcaggctcctgcaggaaatgtcagggccgcgcttttctttatctccagcttttgcctccttttctcatccttttatttattcttctctatttattctcatctttacaagtccaggttaaccaggactaatatttgcagagactagttactgaaactttcaattagattagagagaatctattctataccacttagtttatagtagttcaataatttaccactgactttctctctttctacaatatactggcgactttatcaattgctctacaatacgctattgggttgagcttatttttcaataatgcctaaaatacccttatggacatatataaggataacagttgatttatatcattaaaagttttaaaaaaatatgaaaacatttatatggactccttacacagtataaaagtttgtatacaagttttattttttttcatttctatttttttaaaatataacttatttgttatatgatatatacaatattttttgtgttgttgttttgaatgtaaactatatttcatatgcaacataagatattttttgctattatcttttgtgtaatctatttctctatgatataccacaaaatatttttttctaaaaattaaaaataccaaaaaaaatgaaacttatttacatacttcaatgttgtgtaaggaggccatatagaaaatttcatatttttcctgaaactttctaacgagataaattaattgttaaccatgtatgtctctaaggctattttggatatttttttaaaaaagatgtccatcccaatagcatattgtacaacaattgataaagtcatcggtatattatagaaagagacaatgccagtgccaaattgttgaactgggataaactcagtggcatagaatagattctctcattagattaatataaaataaccactgttaataatatgttataaatccaggatataaaattgtttaggccgtgtttcaacactctcctgatttttatgtgcacgcttctcaaactagtaaatcgtgtgcttttaaaaaaatatttgtaaaaaagttattttaaaaaatcatattaacttatttttcaagtttattttagctaatactcgattaataatacgctatggattactccattttatgtgcggagagacgagagttcccaaccttcacttccaaacacaaccttaggacatccacagtatagtgtagaagtagtccataagcaatagaatagtccatatataaaaaataacaaaagttacccatatagatatggactttccacatgaaataaattatattatctatttctactcatctctcttctcttagtgataccttatatctatatacattgtaaagattaccatagataaaaactatttatatgggccctatctatatggatcactttgtcatatacattagtgatgcccttagggtgagtcacttgtgggtccatagggatggatcccactaggtagagactcatgtctctttgacattacgtcaaaagagtgttttcgttcgtaactaactttcctcctacggaaaaccagatgtcttattagcgtataaataattaaatattagctaaaagttttaaaaataaattaatataattttttataaaactttttaatatatcatggtacaatttagaaaatgtgagaacgaaaggaatagaagttgagaaattttagcacccaactcagccttgcaacagctgtgtgcctgtgtcctggtagaaaaaccgaggctactgtggtttctgttgcagcgacagttgcagtagagatgatgcagtgcacagcgaaggcaacgtgcactgtggatatgattaacagttggagaggctggcgtatttttggccatgagatggtgacgatgtgcatcgccacgtgacactgtcacccgtggtgtttgggaatggggctcaagctaccatggctgcatactgttgcgctctgcatggtgaggtatgatgctacagttgagtgagcccttctcatttaaagccttgcataaatttggaaattccaatcggtgtactccctctctcttaaagaaaaattgtatgagtgcattatttagctgtggatattcgcgtagtgaggagtgatgatttttggacttttggattttggtcctacagatacccaagttatcatcaatggttattaaatattttccgcaatttagccataaaagataaaaaacagttacaataaataaatctagccaatactccgtatgatatagagtggtgaacatatgtatcaatatgatagtagtatctgtacttctattacatgctatgaatgtcttctgtgtaatagaaaaaaaatataaagcctattgttgatcaaggtacaattctaccaaaacctcttattgtttgcttgttacaagtttattagacacccaaaattgttgatgaaagtacgatagctattatcaaagcttcttgtcgtttgcttgttagcttattagttggaaccaaaaaataatatctgaaacttaactttagatataatgttagggtttttttattatagtttatttttcaatatttctttttaaaccactaatcacgtaaatatattagttttatctttagattattttcgattgtttcattaatttttcatttcgctaagatacatatttgacctcagttttcgttagcacccttttaaactgctaaacggtatgtttcatatgaaaattttctattctatatagtagttggattacaatatcaaataaatatattttctaactttctaaccttaattaattgtgcgttaatggtttactcattttgcgtgcgctaatttaattttcatcatcatcccttcaaacggggcaaattatgctcatagctatttcgccaacgacctacaatgtgcagggtttaccaaaccgttctgggtggagttagcgccatcccacggtttaacgatcatcacgaggtgtaccgtaattttaaaactgagaaggttagtgcacgtgattttttaaaccctctcaagccattcatctatgatgaaaaagcatatagaatccctgcgtgactgcatcggtagtacagtagtactcctactagaatggataagcatccctcccaaggcattgccttctctttaccatttctcttccacatgccacatttattccaagcggctgtgatctccaaaccatagtacagtaatcccgaggccggagtatatgtttgtttcacagcgaggcgtcgccgtcgcagtcgtcgtcgttgcgtttcaccggcgaggaaaacgaagccgcggtgcgttcaccggtgcaccgttcgagcgagctagatcggtttgcccgcagaagaaactgcagagagtagtagaggcatgggcatctcctggaaccgggagacgatggcaggaagagataggggccactgttgcttgcttgctgcagtaaacagcagctgcattttgggagcggattcgatcagcatgcttcgtcagttttagaagtttgtttgctgcaaatgctgcttcttcttccgttggttctcgctgtcgtactgtgaagctgtgagcttttctactggattccttgctctgcaaatcctggtgtaaaaaagcaagctccgagcctccgagagtgtgtatccgtgcatgctggagtacacacgaaaataagcgtctgtttcggggagtttttaactgctgcagcttctcccagaatttctagctccgccaaacagttcagattgtcacctaaattctgagaatctatacctgtaaaatctagaaaataaactagacctcagaagtagaaaatccagcttcttccgatttttagaagctagctaccaaccagcatattcttcccaaacaggacctaaagcgatactaccactctaatcttcagaacacgattaacgctatagtactagtgattctgcaggatggttagattttcagtgaaatttctgaagattcgatcttaaataggagtatactccatcaagcaaagcattgcgccgtacattgtccttgtaggacagtaggagtagtacatggtgatgatagagaaatgccaagtgagtggtggggcgaggggcatgccgctctgccaatcactctctctgcaatctgtaatctggagtgctactatctgcatctctctccacgtgatgatctccctttcaccctagctagcgtagccgcatgcatgcatgcccagagaggaggagagagacactgagtgagacgtgcatgagtgatggatgggttgggagaggggagaaagaggggtttgtttgagaacttaaaattaaattctgagaattaattgattggcactcagtttttaaaaaattgaaaagaataaatttttcagttttttctagtttaattattttctaaattctatacctaaagtcttttagaatttaaacgaaaaaactaaaatgtttagggagttttcgattatggaagaagctctccaaacaagttcaacagtgtctgtgtgagcctggtggagcctgtgcggtgcgtttgcaaggacagggcccttttcaggggtggcagcggcctccattgattaccagtaccctcacctctcctttttctctttcttttcttccctggagtacgtgagttattgctgtgttcagttgtgctgcatttttcactttttgtccctttgaaaaacttattttacaaataaacttttaaaaaaacttaatctgagaatgaatattttttactatgtcaacgttattggcgccagatcccgctagctttcccacggaagctaaatcacttatatcgatgcatggggacggctgatacgcgatcagccttctatacgtatgtatatactatatatacacacatatatatacatataaatatatttttaatatatataaaatatatacacatatacaaagtttatatatgatgtatataaagtttatataggacatatacaaactttgtatatgataaatacaaactttatatacatacgtattaaaaaataaaaaatagaaaatacacaacgtatacaaaatttgcatgcacgtatataaactttacatacgcgtatacaaactttacatacgtgtatataaactttatatacgtataaatacaaacttggtatacatacgaatacaaactttgtattcataaaaaataaaaaaccgggaaaaaacagaaaagaaaccggaaaaaaaaatgaaaacacacgaacagaaacggaaaaaatggaaaaaaaaggaaaactggctctccctcctcacccgcggcacgcgtccgccgccccctctccgcgcgtgacagtgtccagtcgcgcgggcagggggggtgggcgcgtgattgatcgccaactagccttctcgtcgatgcatcatccatgcacacctattttttaaaaataataataaaagaatatatttataatacaaaaatttacaaataagtcctcaacatcagtgttattaacaccaaggatctatttgtattttttattacaaataaatcattttagatctcattggcaccgttgtccttcgtatacgtaacttactgtatcttctgcggggagactaggggatgacatcaatgtcattggcattatcatgttggaccacgacactaatgatgttggtggcaaaaaagaattaattttcagaataaatatttttaggagtttatttgtaaaataatctttcaaaaaaaatctaaaatgtgaaaaaaatatccagttcacttgtgctcatctcatctctctcgctgcagctcgttggagctagatgtagtctggacaagtactccctccgtcacaaaataagtgtagttttatactattcacgtttaatatttgatctttcgtcttatttgaaaattttttatgattagtatttttatcgctattagataataaaacataaatagtactttatgtgtgactaaatatttttaaatttttcataaattttttaaataagaaggacggttaaacgttagacacgaatatctacgtctacacttattttgggacggagttagtactacacatgatgtgcatggggtgatggattgatgtatgccttacagcattccatatttccatccatcccctttctgtgctgccgtctcctcggcgcacagctcccggcaccgccgcaccgggcatggcgagctctgtgtttgtctgacacgggccggggaaatgggcgagcgagcagccagcagctgagccgatgaatcaccgccatcatcgcatcctcgttcaccgcacaaattttaacaatttgagcctttaaaaaattaattttacaaatgaattatagtcaaaacttatttaaaaaataacacttttcttcagcgccaaatcgtatggcgctgaatttagacatctcagcaccaaatagcacggcgctggatatacgttggcatgccgactcagcctcccatctgtagtggcacggcattcagcaccagttgacgtgacgctgaggtgtctaagttgagcgtcatacgatttggcgctgaacaaaatggttatttctgaaataagttttgaccacgattcatttgtaaaattagtttctgtaaagtatcaaattatcaaaatttgtgtatgctaccgcacggtaagcacgcttaccgcggaggtatgtttaaaggaaaaccacagtaacctccataaatttaaaaaatattttaaaattttgataaattttacacggtttgccaagtttactgcacggtaaccgtgcttaccgccaggacacggtaaccccagccccggaggtttaggaaaccatggattcagataacaaactcaccacaacacgagcagatacttgcgtagtagcacgtaatactcccccgttcacatataaacataactgtcggtttcataactactattgattttgatttggagatagtacattggtcaataatattttctgaataatctaattatttagtatcagagctgtaccgtctgatttttttaaaaaattgattcactctgacatcgtttaagaaaacaacggccaaaatcaatttaaccccaaacaaaactgatactcctactcccctcattaggcaaaaaagaaaaagtgatctttggcaggacgattttgatataatagtttatgacaagtaactaactctgatctttgtcaaattcttctaacttttcctgaaacgatttgtgcagtaaatctcattaggcaaaaaaagaaaaactgatctttggcaggacgattttgatataatagtttatgacaagtaactaattctgatctttgtcaaattcttctaacttttcctgaaacgatttgtgctgtaaatctcattaggcaaaaaagaaaaactgatctttggcaggacgattttgatataatagagagaatgagtgatgcactgttgtcttaagaaggaaaaatgagcaagtttgaagctggactaaagacgaaaaatatatagatgcgaagcttagtattctagtcctgtgtttttttaattattattcagttgtaaggcggtgaatataaagatcagatttttatttaatatcttcagaaaatgcggccttctgtctctcacaccgattgttgttccgttcgcaatggtagcgtagcgtggccatcctccgagttccgatgaatcctatccgtcaccaatgaataagctgctacgaacaaataaacgcgacagtacatcatgagctctctataagtaccgtatttcctccgtttcacggaaaaaaactaacttttcactatgaatttggatatagactatctatatttatagctgaagattagctttttttttaacggatgtagtactgtgagctaatgagacaagtctattggaggagtaggttgtacttcagaagttactgcatagaaaaagtacaaattatccctcctcaaactatcgcgatcaactgaattaccccctaaaccaaacaaccggacattctccatctctagctacacaaatcggacgaattacccccaattcaatccacagtggttctggtctacgtgacgtatgcgtggcagtacagtcaacattttatttataaaaaaatataggacccacacactcttcctctctctctcttctctctctcacaggtcggcggcggcgggagacacggagcggaggcggcgggtgacgcggaggctgcgacagcgggggatgaggaagacgacgacgaggatggtgacggagaagtggtcggcggtgggtgatgcggaggatggcggcaggggactccaccggcgccgccgccagggaggaaccgctccggcaggaacacgtctaggcggtccggccacgacgtcgggttgcgcgcgatggcacacacgttcaccagtacatgcgtgccgacagggacgtcgttgcaagcagccaccgtgtcctccatggcgtggtgcgggacgagcagcgggcccaccgggtgcagccgcagcgcccccttcacgacggcgtcaacgtaggggaggtccggcaggtcgctctccgccacccaccgcgcccgccccaccacgcggtcaagctcgtcggtggcggtggcgatggcgtcggggcagcggaggagctccgccatcgcccactccattgtcaccgcgctactctccgtgcgccggaacacctccccatcagcgctgccgtagacgcccgaccacttctcgccgaccgacatgtggaggatgttccgcagcgtcgcgttcacgaggcactcgcgcacggcaacggcgtggctggcacatccaaataggttgcgaacgagcgcccggatctcctctgcacggatgtgctcgtaggagtcgacgctgtcagagactgagagagagaagagagagaggaagagtgagacaaagagtaagagagaggaagagtatgacatgtgggtcccacattttttaataaatagaatggttactggactaccacgctggactaccacgcgtacgtcacctagatcaaaaccacagcggattgggtcgagggggggtaatttatctggtttgtatagttgtggtggaagaatgtccggttttatggttcatggggtaattcggtcaaccgtgatagttcagggggataattcgtactttttcctttctgcattgcaaacatactgacaagaaagaattagggcccctttaatttgtaggaaaaatatagaaattttggaggatttcaatcctatgaaaaaaaatcttatgaagacctttgaaacaaaggattgaatcctatccaatcctttaaaattcctatggaatgggtaatcctatgcacattttggagaaaagttagtaagaggtctaaccttttggaacatttcctctgagtctatctctctcatctgattcctgcgtttttcctgtggtccaatcaaacggtcattcctatggttttcctgtgttttgcaatcctctgttttacaattatattcctgtcagaatcttgtgtttttcttattcctctgttttttcattcctacgattcaacgattcaggggggcaaatcaacacatggtccagttcaagcagcaagtgggcagaaaaaaaggcagcacaaaaccgagaaaaagggtgacgggatgcaacagtgccaacaacgaaaacgtctctcatctcttttgctttgctgcagcctttttcttccacgagcatcagagcatgcatgtgaatctcccatctcttcgcgaagaaagcaggaagaggaggcgtggaggatcgagtggcactaccagtttttgcccgcatcgggccatcatttttaaacgaaacagacatggggcgcacgtacggcggcacgaatacgtagtactacgtacagctgcagcgctccattttcctatgccgcttttgatgcaaccaaacgtaatgcttcgttgcaacggaccgccaccttagcgaaagcgtgcgctcatctttgttccaccatcgcatctaattatcattccaaggattatacgtatcttatcatctgcttgttagctcatctgccatagccattttaagttggttttaagattttcttgatcttaggctattttttggcattaggttttataaacagccaataacatgtactagtacataaaagatgtattcatatagattaaatttcaaaaaattacaactatattgacaaaactatcattttgctgcaacattagtggtctatttcaatttgttgtaacaatattgtggggaattattacaaatctataacttttacgtgatatgctgctacatgctatatgggcaacgaaacctagggcacctttgatttagaggaaaaacataggaactttggagtatttcaatcctgtaggaaaaaaattctatgaatgcctttgaaacaaaagattgaatcctatcatatcatttgaaaatcctatggaatggacaaacctaagattttggaggaaatttagcgagagtttcaacctcactatgccgaaccatgctagctgtgacgggcctaaaccatcacctctgacggattcggcccctcgtcagagattagtggtcagtgatgactttcttcacctttgtcgggtgaagggccgtcagtggtgaccagcccctataacgagccgtgtatagaacccatcacaggtaactattatctcaaacggcccattagtttgtgagacgtcagtgatgtctataatccagcaaaagaaaaggaaaaatagattgcaacccatcacaggagtgaaaaaaccctagcaagaaaattggcgcacgctgccatggtggtgcttgctgtcaccgcatcaccatcacaaaaacttcaaactgaccgacaactagtgttcagatctgcgcatccccggcctcgtggaggccggatccggcggctagcgcggtcggtggtggaggtgagggaggcgtcgatggcgttggcagccgggaggcgggggaggcgccgtcggggggtggcggtgatggatctgaagggaaggaggggggaggtggaggcgtaggtggtggccggctggcgcgggcggaggcagaggcacggttggaggtgtcgccgacagaggcggcggaggtggagaccgatgccgccgtcgggcctcggccgcctcccctcccgccatcggccgctaccgtgccacggctccagatccgtcgttcgccaacgcgcctcccctcccgcccctgacgaatctggcggctaggccggcgccgccgccgcgcctcccctcccacccttgccggatctggtggccgggccggcgctggcgcccccgcccctcccgcctctgccggatctggcggccgggccagcgccgccgcgcctcccctcctcccctgcatagagaaagagaggagagatagagaagaagtggaagagatagatgaga

SEQ ID NO: 41020 - DNA, 9150 bp, Oryza sativa
  unsure (1)..(9150): unsure at all n locations
tatatatatatatatatatcaaacgggctaggacttaaagccgtttgaggtgagtaaacctcacctctgacgggccatccgactgtgacccgtcataggtaactagtcacctgtgacgggttaggacttaaacccgtttgaggtggggtaacctcatctatgacgggtttcattttcaacccgtcacaggtgactagttacctgtgacgggtcgcagccggatggctcaccgatgaaagcatcctgtaggacccgtcaaaagtgacatttatcactgaccaacacttatgcccatcacagatatgctgttaaagctatgaggatctggcgtagtgcctcttgaaaaatttcctataattctatctctctcatcctattcctatgtttttcctatgatccaataaaatgtttattcatgtgtttttacaatcctctattttgcactttcattcctgttaaaattttttgttttttctaatcctacgtttttttcattcatactattcaggtccttagggtgtgtttagttcacgttaaaattagaagtttgattgaaattgtaacgatgtgacggaaaagttgaaagtttgtgtctaggaaagttttgatttgatgtgatgaaaaagttaaaagtttgaaaaaaagttttacaactaaactcggccttagactgcgaacatttcagcagcataaataatttggatagttggaatactgcatgcgttggagcgaccgggagggacggacgcgtacgagaggagtataatccaatagaaaaggtaatggtcatcacgacgccggccggactcgtactgtcgcacgcccatctctcgctcgcccaatcctccatccgccacggtccggtccagtcccactccggcgcggcgcattggtacttgcacatactcccatcgccgagctatcgcagatagaccacgcacgcacagggataagtcaactcatcacagggctttgtggcgcagcagtagccggagtagtatcacagattcacaggaccatctcgtctcgtctccctcctgtttgatccgccgcacgtcgcgtcacggcggaaagcagattggattggcgtcgctgcccaatcctgccgaaaccgcatgccaccacctggcaaaaaggatgtcgctgccaccaccccacctctaaatttttacatgcatatggacttttactcctacgcgagaaaatactcctactgcttcgggtgtgtttagttaacgttaaaattagaagtttagttaaaactgaaactatcagggttatgtataacacatatctaataggagttgattaaatctctacaggacccaccacatgccatatcctatgcggaaacaacctgtgaatataggaggagttccggataaggaaagacaaccataattctacatggaaacgacaaggacaactcggattgtatccatattggtttccctagttttacttggacaagaggacacctatgggtataaatacaagaccccctaggaggagaggacacaatcaacatacacggaataatagatcaagacacaagatcaatatacaagccaacatacaccaagataagccgccggatatcgacatcagagatatgcctggatcgaccctgtccggtacctacagaggtcggccgtagggatctagcgtcgtctctaatctcgccgggcacaaactcgaagaggaagactaccttgttgtcgactacgagtcagaccttcagaccgccatgtcaacaacagttagataggctaccccaaatattgtactggtgtgattatggtgaataagagcaatacctgcttcggccaacaggatgtagggttattacctgacaattcaggggcccgaacctgtataaaaatccctgtctccatctcttttacctcaatctcgcatatactctagtaccaacgatctccatactatgcaaataccggaatcgcgacatcaaactgtgactaggaacnntgacggaaaaattgaaaatttatgtatgtaggaaagttttgatgtgatagaaaagttggaagttcaaataaaaattttggacctaagggcttgttcacttcactaccatttttaaccttacattttttatggcaaaattaaaaaaatggctacatttagtttgttatcaaattttagtaagtacatatggaatcttgccaaaatttgataaacttgtcaaaattttagtaatcttatatcaaaacttgataagattgaaaataatagcaaagtgaataagcccctgaactccgtcgaaaaaggaatttctcttcgtgtttcactacacatgttttgcccgtgacacccgtggttaattgtggtcaaatcggcgaccaaaatctgctctatccaaatgtggcgcgacgtacgtacaataattaaagacaactccatcgtactggcgtactgtagatgcgatgatatgcgagacgccccctatacgatccagtagctattgctggtgggcggtacactctcagacgttcctcgtgccggacgttaattcaattgggtaatttattagtagtattacttctaccagtatacggagtagtgtttcaggcagcagctaggttgcccgtgcgaacgcataatggcacgtctcataaatgcaccactgtctcgtcgtccgtccttcgctttgctttgcagattgcaggcatgcgctttctgatacggtacacgcatgtactccaaatgtgtataaacgtagcgatacgtacgtgttggtgttaagggcaggtgacaatgtacgtttctggacagattacgatcccatctgatctcgcatgcacttggacgtatgtataccaccataacgatacagtatatgtgtgtactcatgtactgtagtagacatggagtacgtgcgtatcgccggcacgagcagctgcaccctgcacggcgggatgggctcgggatggatggatggatggatggagacgtcgggagacgcgaaaaccggcgcgttttacaggcgattcccctgcgatccagcggcagagagacgtacgccacggaggagcgacgagaccggtggggagcggcgcgtgacggcgtgaggccgccgggtcggtggatcatccgttccgtgacgcgccgcgacgagttgtggacgacggaaaccgcgcgcgatgggcgccgcgccgggacccgggagggtaccggagcggacacggtggcccgcgggtggccgtgtgtgtagccgtaccggtaagtcgggcactggcgttgggccctttttttccttaggcctggttagtttctaattttttttctaaaaacgtcacattgaatatttggatataaacatgaagcattagctatagattaaaaaagctaattatatagtttgtatagaaatcgtaagatgaatattttgagactaattagtccatgattagccataagtgctgcagtaatccacatgtgctaatgatggattaattaagcttaataaattcgtctcgcggtttccaggcgagttaagaaattagtttttttcattcgtgtccaaaaaccccttccgacatccatcaaacttccgatatgacacccaaaaattttcttttcacgaactaaacacacccttgctcgatatattgcaggacggtatcttgttcggacaatgtattaaaaagaaaaatagaagacaatgtattgtgtacttcagatacctatgagatatcacctgatatacctggtaggtttattgtcccatagaagtcccctaaaatttaaaagaaaataggtgacattgtattgtgtacttcagaaattttagccaatcttttccatgatcccgagtttttcttcttcccttatatatcctaaattttggtttttgatatcttccatacttttttcggttagtcaactgttttaatgatgtaaaaaaagaagtcaattttgccattggacaatgcataaatttataaaaatcttttattgtgtgactatcatattcataagtttgttgaacgagaaaatattatacgcagaaaatttagtatatatttaaaaaaatgtcatttttttaaaaatggaaacaacaattagtcattgtagcatttcttttgggataatacttatgacatgcaacaaatttgttgtgctactattttacaaaaatatgctacatatactattgttaataaataataaatgttatgttttgctatgaaatctaaaaataaccttctgacaataatatctcacacaacaaactcataaatatataagtcctatgtacaaacttctagacttcaacaatatagtactccataatttctttcttccatgactaacagcaaaatatatatttttatagaaattagacagttaactaacaaaaatgtatggatagaatccgaatcaaaatttggaggtataaaagggagtgagcacaactcataggtacaaaaggaattggtcgaaattctagggcatacaagaaattttctaaaaaaagagacattgcctttggcagtgaaccataaaacgtggtcccacatgtcggtcgtggtagctcgggcatcgggtatcttgtttggctccgtggatggctgggcggctatatggcacgacaaaaatatagaaaaatatagagttactcctagttactacctctgtcttctaaaatatagaaaaatatagagttggatataaatattaagaaaaatggtagaattaaatgggaagaattgtgattgatcgagaatataaggttggtagggaattttgcgtgataaaaggttgtgattggtcttaaaaaaagaatgtatgtgttgaagttgatagtatacctctcgtgtttggtgcgactagtttgatccatgtaaatgaaccaaattttggtttcaatttgtgggaaccacatgaagaaaatgccgatctcactagcgtttgcctcctactgccgctgctgcgcaaccggatggagaatatttttattcggttgtggtcgacttcagtttgaaaaccgatttttttttcacttagacacatcgtccgactctcacagtgtgctcagtttgtcttttatttcattctatgagggtccgattttagtcttatattctctttcctaaaatataaaatattttagttaaatgatatatattccactgctacaaatctgaacgtgctaggatatatatcacccaaccaaatttctttatactttgagatgtggagaatattggagttgctcttatattctagataaatttttaagaccaatagttgttatgctttaggacggatggagtacaagtcattacatagctttttagcattgtactgttcatttttttcgttttcttttctttcaccgacatgtcgctgtgacaacgatttatcgggcccaccggttagtggcgttttcgtacatgtgtctttgccttcaatttgatgttaaaattttgaaatgcactgtacaaggggaacacagcggtgtgggaaatgcgtcttccaagatccatgctcgcgatgctagccggcgatggcgaggggaaggaaacacagcggtgtgggagatgtaaaggttggcctttgcgacgcatagtgatatacccagttttctttctgcgtttaaggtgattagccacttattggagaagacaatcaatttacacataattaactaagtattaactattacagatatttgagttacttcaaaatcgcatcgtttatactccctccgtaccaaaataagtgtagtttttacactgtttatgtctaacgtttggctattcgtcttatttaaaaaaatatgtttagtatttttgttgttattagatgataaaacatgaatagtactttatgtgtgactattttttttaattttttcacacatttttcaaataagacggatggtcaaaacattgaacacggatatctatggctgcacttagggtgtgtttgagtagaaggggattgaggagattgggaagatacgcaaaacgaggtaagccattaactcatgattaattgagtattaactattttaaatttcaaaaatggattaatatgattttttaaagcaactttcatatagaaattttttgcaaaaaacacaccgtttagtagtttgggaagcgtgcgtgcggaaaatgatgtgcattctcactccctaccacccaaacgaacgcaaccttattttaggacaaggtagtagcgtgttagattgcccatgataatcccagtaattaaagcaaagttaataatacagccgacctgttggttataaggttctttgtagacttctattagcctgcccatataatagttagctctttacaattaatacatgcctacttgtctctcttacatagtttcttggttcttgtgtttaagccggctataagtttatggcccgcttctcctctctctcctctcctttttctccaccttagcatttagccggcttatagcttactattatacttgctcttagtaacttataagacagcagggcctagtaagagctgtccactgccaagttcatgccagctcgtccagaaaggatatgatcatatgaatatgaatccacggtcgattccgtcgatctcgccggtcgccacagccttgccgtcacctgtcgcgcaagggaaggaagcgtgaactgttgcctcgctgagccacactgggctgtgtatgttcttattcagtttttcttcttcttccacggagccgaagcgaagcccagaagcgaggctgcaactattgcaaatgtcagtctccagcgtctctagccgtcgccgttgtgcatcggtacttgcagagtgagcgctttgccgctggctggcagctcagctcgatcagggacgagtcaactcagagggaagagctgtatgcgtgctttgtggagcaggagcatctcacagattcttcgcaggaaacactactattcccagtcgcccacttctgtttgatccttgtgtcagttcagagaaaaggattactatctgtaatcctgtactccaacacgagttcagaaacgaaacctttggcgaaaaatggacagtatatgatactcggatcgaacagctaaacctgtctctgatcaacactagtatactgctgtagttgtattttttcagacaggattctgaactgaagcagcagtcatccgggcaccggctcttcttaaactgctcctccccttctgctcgtgctgtaattcttcgtgacagtgaagaactgaatcctatcttactctactaacttcttaagcttgacatgtgaagatgccacatcatcatctactaacaaaataccacatcatcatccactaacaaaatgccacatcatcatctattaatccactaattaacaagatgccacattatcatccactaacaatcatcacatttaaacatcatgtaaacatgctatatctttatagctattataatttaagagcttttcaaatataaacatgttaaattatcatccaacataattcatataatgtttcaatgtatatctttattatattttatgatatcctatatacttatatagttcatcctcacttagttagtacttaaatgattaatctatggtccaaattatctttctcctttttttcctttaattaagtcatatcacatcaattgtttttagcctttagatgattattctacggtccaaactatatccctatttttcttcttccataaagtcatactgaatcaccattctacatactatttaaatttaaattatcataaactacattaatttacttaatctgatgttatctagctatcttatacgttatttttttttgttatcatactaaattcccgcaacaatacgcggggtttcacctaattgtgattatagtagatggcttgtgctcgtaaaatgcatagatttggtggcattgactggttctgtctgcttgctcatgctgttggagcttagctgcaatctgtcagtgataattcctgggcagttgcaccattatgctcgtctgagccatggagactggagttcaaccagactttttaaaaaaataacagaaacatacagtaatgtggcgccgaaacaacaggtgacgcattatggtagacatgcaaattaaccagctacaatcatggaacgcttttgtttgctcaaggcacgactccacacttgcaataatagttcatcctcctgtcatctaaatagtacaaaacctatcgattccttaactatggaacccaaaagtacgtcaaaagctgggtgtacaacatgtacatatataggactaaagatatttctgcattacactccaaaagtatccatctgcatcaaacagatcaaacgactgcttgttgtggtgttcaaggggcaggaccccaggatgcacaccgatgagatttggtatggccaaaggcaaaaatatctggaacgaaacaaggtgacagaatgcctcctattgctatgtaagaactcagaacacattcaagcctcttttctagttatcctgtcaaaaaagcaaaaggaaaaaaagaagttgatgagacaggttacttcctaagtataggaagataacaaatagatttacagacctgaagcaatagattccaagagcatccttgatttcatgcacaacagaaacggcaagatgcaggtaaaggcccactgcacaaataaataacacactaagactacgtgttggttgtaaacctataaaagcagcaagcagaaggtaaacctagaagttgacatcaatctataacgtgtatactgttaatagaatactgtggagtatgcatcacacaattgataaaaagaggaccataatgagttttccactgtaacagatgatgcaggatttcttttttaaaaaaagtttttgcgcttgtgagcaaactaggccaacactagccattaacctgaaaccagtccatcaataaaacataggcatatctacatgagactttagattccggactttgcaatacatacaacgatatataatccaagggaacaaacagaagattaatgtcaaccaagccaacaggttcccacaaaaatgagtgatcatacaatgaaactaagaccgagtacttcagcaatctcacaccaaaaataaataattaaggtaaatcagttcacctgtgt

SEQ ID NO: 41021 - DNA, 38757 bp, Oryza sativa
  unsure (1)..(38757): unsure at all n locations
cattccagttttgagacctttgggttcatcacataaatgagcaagtatcatccttccctgtccatgcatggcaactcaaaatatgagcactaattccaggaaggaaaaacaaggatgatggtagattagtattatgcactatgtttgcaaatctcactctacagaaaaatgctccatcactattcagtaaagaacaaagcgcagtggcacattaggtgaaccaagtggcattaggtgcttcttcagcaacagtatatcagtaccaatatgttgtgcatgttagccataaatgcttttcataaaaatccaggcggataatgggactatcaagtttttaattgtcgcaatataacttggatggttagatataacctaattagtgatttgtgatggttagataaaaattcctagacttataactgctgtgcagatagatcaaagtagatcataagaaagttttgcaaagatgaaaactataatgaaaactataagaaagtaattaaggaactgcaagttgatgaaatgctgatccacatttaatgaacacaagaatatccaatatgatatatcgtccacaaaacaagctaaacagtattcagtttaccaccctttccagatcaaaaggcaaggtcagctgatggcaggcatgttcagttgcgtaactaattgctgccacaagacaacagtgatacaaatgcccaaataccattggcctgatttatctgcatatggaccctttgcaattctgctgcacagttctgtataatttggtcattatttcatatagtttatagtatttttataggttagatgggttgatcaaaacctgattgaagcagcctattgtttttctagtaacctactaacaaagatccatttccaaaatgtaggaagtttttacttgctcttagcagaccacattttgactctaaactcttagcaggccgcattttgactctaaactctaaaactggatacttgacacccctcaggtattgaaacaaggctggtttcaaaaacgatttttgtccttggtgccctctcaggctctcactaactgaagcatgaagaatgctgaaatagtgaagagaactggagcatggagtgcccctggttgctttgaaatttgaactcatagcaggtggctgtttttaaggataggcaaggcctagcaggaaccatgtggttagaactgataagcatgacaacaatgggtatgacagtggctgctccagtgaattggtgattgcgcactgaggaaggaggtagaatcctgtgttaaaccatcgattaaaatccatgctaggggcaaaacaaattaaaaacttaccaccaaatatccaaaagcaaaaccagttccgatcacaagcagatgtggctgattcctcataatatctgaaggagagaggtaagacctgcacaataatatacagaatcctaagtatttcattcagagcattgcatcatataataataaacaacaagattactgatatccataccagacagcaactccagttaacaatgcaatgaaaggaaggagctgcaagccaaataaatatatatataaagtaagaattgctatctgctgagatgatcagatgaaagcaaaagtcatatggtctgttattattggaactgttcatatgttgtacttcagaaaagtaacattctttttaagaacatcaggctctgtaggaattttataaaaaaaaggatgttgttctataaatagatatttcatatatgttgactgaaaaaactttataataacatggttaggacagattaaatcatgccatcatttttctattgaaggcttgagcaagattattatcaggggcatataatgatcgagatgaagatatgctatcatgtgctgtaccaaaaaagagcttacaacagtatttaaagatgcacgaatgctttgccctgttaaacagttgtttcttaaataaaacaagattcactcaacaagctccaaaatatgtactcctaggtcttgtcttattgtttgagaacttgaaaatatgtactactagatcttgtttcattgtctgttgaaaacacactgcccaagcagctacaatcttgccaactatccaacaacacattgttaagaacattgggcgcccgtttaagataaagcttacgatgcaacaaaattgaaattaacagctataaaagatgaatttgacattttacaagaactcagggccgattcgatttgtaatgagaagttgtttattaaattttctgcattcataccacaagataaacagacctaacagggaaaaatatattcatagacataaatgaatggcttagaatttccaaaaacacacaggactatcacggttctacagcttcaaaagtttccaacttctagtcttactacataagaaaaaaaatgcaataagcttaccattgccaatgccaataccatgcttccttttcttgcttcaactactttttggacattgctgacactattcaacaggagaatagatctcattaagtaatgataggtaagaagacactgtagaacagtgctgctttttactcttacatcttatggaaagtgccacaaaaagtcacttaaggcaccgattcatgtaacagaaaatagcaaccattaataagatgaacttgatacttatggaccaaattctacgcaagaatcaattgtttgtaagaaaagatgagtcaaaagatatatggtacatgagtgctatttgttaatcttatttcatgctgtggagctgctgcaaaagttacttcagaaagaataagaaagataatttacactcacttggatccaatggtagggattacggcaaacaggatcataagaatcatcacaataatgtataaggggatatctgatacaatcgaaacaaaaaaatcagaaataattctagtggcaattttgttgtcttttgtgcagttcgttggtaacatgtgccagttgatgtcaaagctgatagtaaatatgtgattatgttcatacagaatggaaataagtattttcttgtgcttgaaaaaacgtacctggaataaatggaaggggtacccaacttaaaaggggtatcgacttccgaaaatcttgtgcccaccattcagcgcctatattgggacacaaaagtttctataacacaagtgcttacactagaacattgcaacaaagatccatagaataaatgtgcacaatgtgttagtttattacagaaattaccagtaagaaaggtaaaagagtgggatagatatatcagcatcaggccctccgtaggtccatttattaaaggaagaataagtgtatttgtaaagaagctggtggcatgagaatagcaaatgtcaataaacaatagtcagaccatctgtgaatcaatgaattaatgaatgtattaatgtaattaaagttgaagaaaaagaacatttgccagacattttagtaattaatactagtaggttttgttacaagctgagccagcaaatatccatgtatgtaatcatcagttaaaaacttttctattgacagaattagaagaaacagaacccaagatgttacacaaactggaaaggtaacatttactacatcatggaaacaggataaagcagataatcatcatatatagtgattgaaaaaaacagacatttggtctgccatttttttttctccaagtatgttctcttgcattttgttatgtcacattatttcaaagcaaaatgagaaaacagcttattaacttaaacattacagagctagcttctcaaaactttaggaaagagtaaagtgtacgggcggtccctaaacttgtgtgggtgtgccaactaggtccctgaactctcaaaatgaatttttgggtccctcaacttgtctcgggtgtcatgtaggtccaaacgggtttcaacctactccgtgtgctgacgtggcatgtcatggtagcgcctatgtgtcagtagaactattatgtcagccacatatagaaaaagttaagaacatattttttctcatgtcttttccatttattttttcaaaattaaaaacatcattttctcctctctttttaaattttatttttttctacatgattgacatgtggatcgcactaacacgtaagcgtcactgtggcatgccacgtcatctcacggagtgggctggagcccgtttggacctatatgacacacatgacaagtttggggacccaaaaatgcattttgagagtttagggacctagatgatatatttgtacaagtttaaggaccgctcgtgcacttcactctttaggaaatattcttgttcgccactgaacctttcagaaaagccatactgcaaatttttacatgataggtccagactccagatccacatgtgtgacatataacacagacttacagaaaagattggtattgtcccactaaattagggcgtgttcagtctattgccaaaatcaaccataccaaattttggtatggaccattgcaaccttctcaatttctaccaacatttggtaaccttagaaacttctactcacgaaactatatcaaaatttggtaaggtgtcaaactaaacaccacattcacatcttgatcttgccaaaattttggtattgtcaaattttggctttaccaacaaatgttaaggtgtttttggcaatgaactgaacaaacctttaatcttcatcagagcaagaagattagtatagactaacagtacgtctaaaggctcagtggttgctacaataagcaacatccttcttggaaagaaaaggatgagagcagtttttgaggaaatatacagtaatcacaggataactgagttccaaagtacttactgttcccatgttgcaagatagaacgggacagcagcaatcacccagaaacagaaagtaaaccttccacacatcaaggtgcttccaagggctaatgcttcaaactaaccagggatcaaatcagtcaatatagaagtatagaacagagtgatttatataggtgagatggcttaggaatccttacagcacaggcaagagcatcacatcctgtaaaatgacaaatttgcatattgtgagtataagatagacatgtgggtgtggaaagagcattaaaccttaacacattaccatgatcaaaaagttctcctagaggacttgatgagctagtgcgccttgcttgtttaccatcaacagcatcaaaagtctaggaaaggtacaatacaataccattaaagcaaatgcaaggcaggagcatagttcataaaatcaagttgatgaacaactgcattatgatttccagtttatttggatatattagaaacacaatgcatacggtaaacatatacagaaaaaaaaatcagaactcttttactacttgcaatctcaagatgtttcacaaacctggtataagaagagaagtaatccatgggcaagatggacccacctagggggagctgtgtcgaggtggggcgaatagatctgcgaaattaatattctatcaagaaaagaatgggtgcaacataacatgaagcatgaaaagaacgggcgttaaataacacgaaacatgtaatgcattagaagatatcaaagttagggcattaggcattagcagctgatatttttaacagctccctcaaattacaaaaaattcaagcaagaaagaaccttacatagccaagaagtgctgatacaactagaaacatgaatccagtgagtgtgatctgaaatttcagaaaacatcataactgttgaccatagacaaggaagaactgagaatatgtagatcatattcttaccatattaggtctgagtgtggatccatacatgcaaatggaaaaaaaaatgaatcagcatccatgtttttgttaaaaaaagagtaatatacatgagtatctttgataattattatgacacaacaggaaagctgcaatcgtagccgcatactactctacttcttttacatacagttagacagtcatggttgttaaactcctacaaagttgaccattggtcaggcacatacaagtgaatcatcaaagcaaaactagctcacagattaagaaaaagaagcaaaactaaacagatcctcaagcagacttgatatagtaaatgccaaatatatgaaaacacatagatgcatcaattgaatttgatttatgagcataatcagtcatgctcactgtggtcctattcatgatgcaaaatgcctctcagagacatttgagtttattccttccctgtctagatgaaatgacatggcatactactaagtactgacttactggaattatgtcaacaaattaaggcaagcaagcaaataaaaaaataactaactttccaacctgtaaaattacagttcaaccagatgctatggttttaaaaccagctcaaccagatgtttcttttgactggtcaattcaaccagatgttacttcccagttaaggccttgtttatggaataatttcgcaccacaataggtgcggaataaatccgaaaacgcttactatcgaacgtccgatacgtggagaaattccggacggtcccacagtcaaaagtcgcaacccatcctttcccaaccttatcctcattcctcctcatccagtcatccctaacctctcgcatcgacttcttctccgtgcagctcggccacggcgtcatcaggtggcgctagcgccgctgtagacggcggggctaccgtcacgggtggccggattctagccgttcagccaacaccgcgagaaagtggtcgacgccggttaggccttgagctcgccggcggcgggggcaccatggttgtccgttgtcaaagaggactcgagctcggcggcggtggtgtcaacgtcacaaggagatacggccagcgacggttagggccctgagctcgccggtggcggcggcactgcgaggaagcgggctggagcttgaggcgccgttgatggagatggccttgaactcgccgacgaaggtgaggatggtgggagcatcgagctagcaaggatttgttccatgctagttgctagtttctttatgttgcacacaagtgtttcttgatgttgcatttggtatttcttgatgttgcaattcatatttctggatgttgcatttggtacttgatgctgcagttgatttctttggatgttgcatatgtttttgctcttgaagtatgcgttttttagtgttcacatccgactgaaacattttcggtaaaataatgaaacattcttccatgaagaatggaacatcaaagaaacaactctgatgaaactttttttttggaacagtgaaacattgcaacaacttatggtgaaacatttatttggaacagtgaaacattgcaacatctcttagtgaaacattgcaacatctctttaatacgttgtggaacaccgtccggagatttgtaaaactgcggccgtctgatgtgtagtcgtccccgaataaatctcgtccaatccctcccacttggggattaaccaaacatgggctaaatggttctttcctaagtgttcaaatgcaatgtcactgcctttttccctcaaaaaaggaaaaaaaaatgtcactacccccatatagtatgaccaaattcaatcccctcgcccatgctactccctacacttccacaactcaagatcaaacacacacaagtccctaccgcacactaacctaacaaatcacgaactagcagactactagagagcagagccagagcaccatcaactactcaaactcgagcgaggagcggggaagggaaggtgggggggggggggggggcgctcacggcatccagagcgggaagagggtgacgcatctgctccagaagggctggagcacgtacttggccaccaccgagtggtcctgcccgctgtacctgtaccgcttcagcgtctccaccccgtgcgccccgatgtaccccatccttcccctcggctcgctcgctcgctcgtcggcggggagctcctggtcgggggaggcgtcggcggggagcagtggggagcttgggggcggcggcggcggcggcgagatcgcggaggcggagaagatggggagcggcggatcagtgatggcggcgatgggtatattcgagtcgaaacggttcccccgtggctggccgtgggcgtgggctggtctttcgctttcgactttcgagtgcacgtcacgactcaggggagcctttttcggttgaaggggtggctgacacctgtcccggagtccaacaaactgtaccacaaaaaggactttgttgcttctttttcttttttttccttccctggaaaaatatccttgagttacaacgagttaatgttattttagtcttattattcttatatggtttgagctaggattaaattcattgtggaaattcgcttaaatatttattttaaaaaatcatgagctgcaattaggattccgactatcatcttaaattaacatgcgagttttttatagccgacttatatacggatctgtatttcgaaaagcaaacgaacttaaaatccaactcatacatggatctgtatttctaaaagcgaacaaacttaaaaaccgattcaaatatggatgacgtaccaaaataccggcaaaaacttttttaatctttataatggtagagatatacgcatagtagtattatatttattattgtatatgtaaaaccatattagccaacaataagcaagtttctcaaaaaaattaatagatttattaagctggtttcaaaagttacacacaataattgatccaaaacttgcaacaagacaagagtaatctctcccaaatcttaaaaaaattagattgttttgagatttgtacggtgccctctcaaccctaactcctctctcctcaacctcgtgccaccattttactaagattgatgtgacaagaacccttctcctcgtggcctgcctcttccctggtaccgtcgcctgaccttacccaagagcgccaatgacgctagtgaggcctctcggccaactttctcccctctctctggcaatggctcttcgtcgctaaatccaccatcgctagtcattgtcacctaattagtcactctgtgtttgccctccgttgttgatgtcagcccatccctgaggctgcatcgacattgccacccgctttgccgcgcctgtccaagtccaccgctcatcgtgggattctccgccacccacaaccatctctctgaccctcgagaaactcccttcttttgtctctcctaccctctttcaccttgatcctaaccaagaactataactggtcgggggtcgatgctgtcttgttggagctaccatgagcccatgacccataggaacatgaggaaaatgaggccaatacgaatatttgcacaggttcgacggttccgaaatttgtgttgcatgaaggtttagtaattccattatctttatttaatcacccactaacatctccatatattgcaagggatcataacagggacacatatcatttgcagaactgcatctatagtagtagttactaaccagatgaactcggtcccatataacaacggcacctattgcagatgcagtactgcaggcaatccatgtgttcatggcaagatagcctgaattgcttatgcgcgcggaagccaaaagacatcaatggcacagcatcatgggccgtcagatcagagacgaacgctcggaatcgtatctggagaaacagatagcgacactcgctgcctttaaaactaaacccacgcaggtttctgaaacttggaggcgggacgggaggacgacgacgcaacggaagcgacgccagcggcggacgcggcggcggctgctgcttccccggcggtggcgcgctctcctccgtctccatttctccggtaaggtagcgccgccatcttcgtcctcaccgatcccaaaccagcgacgttgtgcacgaagtaatcgcgcgccacgacgctctcgcaggtctcaggaaccgcgcgccgcgcagcgccaccgcaggagaggctcaccggcgagcgcaagcgaccttccctcagatcggagctgcagcgcttaccctgctgtgtcccgtcttcgcctccccgagggtcacccaccactgccgctgatttcacaaggtacgtcctcccagtcgccatcacatatccgccagatgttcgacgaaattcctacacggttcggtggttttagttggggtacattttgtcctctggtatgttattttcgagagcactgtatcaacagaagcagccccgcgcccagagcactagattttacagatcacccacatgccatgcttcaggggaagagttgataacgcgcaggagagaaccatccattgaaacatttgatattatctatgaagatgattgattgcattgtcctcgtgctgagaaatagcctagttggtctggtaacctgcaagtgctcaatttttaacatcttgcataattctcgcaggagaattgcaaaagaaaggcagcaatgaattggtttgctctagtgttgagattcataggatctgttcttcgtacgagccgaggctgtagtcgacttcgtgcacttcttgctgctgatactagtgaagggaaatctacaggaaaagagaacaagagcatcaacaccggtagatttgacagagtcaataacattgttgggggactacatgatgtattcagtggattagcggttgccgtggattgtgttgggggaatcggcgctatcactagtcttgttcgtcatgtttatggtgtatttgctgcttctgttcgaagatgggcaaccttggcttttcgctggatttatcatcgttagcagatcttgggacagcaacaaacctcatctttacctatcagtttcactgctgttgatcacacaattatttctactgttgaagatgcccaaatagctgctgcacagtggaatgggaaggaactgatagatgtgccagaagatataactctggagctcgctattgaaatatggcagatcttcttagaacatgcagctggcgatgtcattgacaaggccccaagtctttcagttaaggtggggcaacagattatactgcgagaaaaaatcaaagcagcatcaatgaagttacaatcgaagaaagcggctatagaggtacttgagagccatatcaagtgcacagaaggtgatcgggatgcatgtgatcggcttcttcagaatctgcgtggccagcgacagcacttgtagcttcaaaccatgacccaatgaaatttcaattcatgttcaagaagaggaatacaaggggcaatgacaattttgaagaatcattaacaatcctatactacctctaggagatgtttgtacaggcaacatacctcatagtgttagtagatagtagtactgtcaatatggttacaacttggctttaatagctgttacttagtaatttggctgatgcaatgacttttttttttggtgagaaattgtaaaagccaaaatagggaaagaaagaaaaaactatgagaaggaattttcttttgccaggggtctgggtggccatattccatatgaagcaatgtttgtatggttagttacagttttgcttgatttgtgtggtagtacctggtaatgtggtttgcaatagtttttaaatatcagttgttgccgttttactcgtatctactttgccaaggcttgaaaagatttgttgtagcatttttcttaactctagtacggagtaatagatattgtatggtttggaagatttaattgccagagtgatatgagacgtccataatgtgcttttccatccatatttccgcatcatattcatatgaacatgtgcagaatctgtttggtttgtgtaggtattgctactatttggagtttggaggtcttcacatgaaacgcgagcgtgcattcaatcaatcaggtagtgtagctgacaaagaaattttatttcatctgaggatattcttttctcatccgctcagctcaaccctcgtcggcggcgtggtcagtgtcccatgatccccatccgcgatggacctgcaaatgcaatcctagtagagtttccttctccgtttcgaacaagaacccctgtactttacatcaagctcgattacaaaatctgatccaatacttccaatgccctatgacccagattggccaaagaaaaaaaaatcgaaatcgccagacctgcaccaaaggcatggatgcggcgggccgccgcatcgttcgcgcgctcatccgggccaatgatgcgatggagcctgtgaccgacacaatcgcctccgccgccgcccatgtcggcctcgtctacggcgcgatggaagttgttcgggacattcgcgtcgtcgtcggcggcatgctcagagttgctcggggcagcggagatggcggccagctgaagctgctcctgctgtcgacctcgccggcgcgtgcgggctgggcacttcaaccagcaggtacgcctgatatgctccagtaccttttctatttccaatttgccattaaaactacttccttcaagttgttttgatttttttttccaaacaaacttttttaagtttgaacaaatttataaaaaaatatatatagcagcatttttaacataaaacaaacatattatcaaaatatattcagtacaatatttaatggaagtttttggtgttgtagatgttgctaatttttttaataaacttagtcaaatctaaataagtttaattgtggcaaaaagttaaaacgactcataatatgaaacggagggagtaaaatcttattcaagttgttggatcagatagtctctttgaagtttgaacccatcaagattacatcgtgtaaaaagagatgcccttttttaaatgcccaataaatcaagaactaatgacttacctaatcttcttagcaccaagaattacaaacagccccacattggatcattggatgggcccaagcatgtatagcaactggtagacattgtacgaatatcagcgattgcaattttgaaacaaaatttttgaaatttcagtaattttatccccatcagcaggcgcatatctcggccaaaatttttggagttccttttcctttcaattttttgtgaatttgatcgatatttattcaaaatcattcaaaatttattaacttcgaatattttcgtccaaaaaagttccaaaattccgaatttttgttgaaaaacaaaagtgtaagcgctgtacacgatagtgcagtgcacagttagctctcaatgtggacaaattacagcaccactacacttgggtcacaacagtcggcactaattggccatcggttgtttcggttaatcccatgacgaagcgattgaaataaatcaattccaaatcccacctaatcaaccttaatcaaggccttagagggccagacgtatgccttggagcatccatttggttttctgttgtaactgtaaggcttgtatttttttttacttcagtactggaatggagaatgaactgacctgcagacgaacgacatcagatcattgccatcagaagctaaaccacggaaaggggagaaatgttcaatttgatgatcttccagaggtttgtgaaaacttccttgcaaggtttatacggagtatggaattgaacttgcaagcttgggggtgtgacatttctattctgcaggatgtgatatgcttgatattttcgaagctgcagctgaaagatcttgtaagcaccagtgtcttgtcaagcaaatggaaacatatgtggacaatttgtccaacactaagatttgatagcagtacactgtgtggcagcaacatgtgcagtgcagaacaatttactcagaaattcattgacaacgttaatgcggtattgcagcagcaccgtggcaaactggttgaagcactagagatcaaaattgattttaacagcagactggctaatcatctcaacaactgggttagttttgctgtatcatcaaagacaaagagcctggctttttatttaccacaaaactatacttctaatgtcttttacatatttccctttgaacttttggacgtcaaaaccttatcccgtctgcagcatatccaacttggctttgtatctttaataaagctacctttccagtttagtggttttccaaacctgaaaaagcttgacttgctcctgctgcgtactacaagagaggaccttgaagatatgatagcaaactgtcccaatcttgaatggttgagtttaaatagatatacttgcaagttattcactgccagataacaaaaatagaaatagatgcagttaatcttaaggcttttgtatacaaaggatttaagctgcgtgttgacttaagtgaagcaaaaggactggaaactgtagatattgaattctttggtatagctttagattatcttcttactgcaattcccagtgcacttcccagcgtgcaaaatctgactattgaagctcgcattttacaagaggtttgttctttgaatgcgctatttgcaaagactcctactttctaacctcttacattcattttaatgactttatttccctcatgtcagtcaccctggtttgtggaaacttcatgcaagttttctcagctcaagtgcttaaggatgttgctgcatcaccggtttagtgataaccgcaatactctcggcttggcttcctttttgaaggctgcccctctcattgaacaattggagctcgatgtaagtcttcttgattgttcacttacagctcttgctatgcattggtgccaactcacccagtactatttgttgcgtgtttttagttgtactttttaattaatgttcttgcaactgaactgtatttctttttggggggaacatattgcctgaggcatccttaaaccaatccgataatgttcctccaacgagttcctcgaagttctaaactttattaacatcattttgccaccatccgtaaactgcactcatgttcttggcatatataacaaatctacaagtatatttatctagatatgttggttgcataggccatgttgagctgcttgtgcacattgtggaaaatgcaccggccttggaggccttaacgatagatcgtacacagagaagaggccgtcctttgcatgaatactcggcaagattggctggtatcgcttctagaggataccttgatgggaaaattctgcctactacgaagctcgtaattatctaacatgctatccatcagagaggggcatagttaattagggcattgcatgcgctgagatgggaacttgtgaagtgttaccttgtgtgtatactctcccatcttaaaataaatcaacttttatatatgaatctgttcggattcgtgtacaacagtttaactcattggtatccagattcgtgtaaaaagttaaacttatttttggacagaggacctatatgaaaggcaggctggttgttatgcaatttctacagtccgctttcacatatctggccctagccctactgcatttcttggtgatcttgtgttgcaaaatacttactagtatctgattttaactgaacatacgggcacacgccggtgcctggcacgttaagacatgtgttcagcatcaataccatacacttctactactgttctacacactgcaaacatttaaattttaattaataaaatgtgggttcaggcaaatcgccgacgagcacatcaagcacacaatcgagaaactcatcagtgttacgatggattcagttagagattagatccgatggtttcgaatttaagctgaacaatattttctagaaagtctaaatactcccttgaagtttatctaacacactaaacttcgaaccggacatccaacttctcgaactttaaaattttgttcatacaatccatagtcttttttcctataatttgcaataagttggatgagtctgactatgtgacatatacattggacataagtgttaaaatattcacttgagtacctttttactcagttttcgccatcacttataaataagtatcaatataaattagtatgacattattacagagtataaatcgacgactgacatttgatgatatgttactcaacacagctcacttaagctttccaaatacgcaaaaacaccatccaaaatcatcttaggtgtactatgaatggcatggtaaaatttaaggagttgagtgttcggttttacagtttaggattgtagacggacttctatccaaaatttaagtgggcatatggacttattcaaatttgataatatcttggattcaaatttgttggctatacatcgtcttgaaactaatcaacaaagttcatttaacttcggttaatcaagatgaattatgaacaatgggagatttaatgtacttatattcgactcacaaagatctggttcatgagtcacgatgagatctttgtatattattacctccgtttttggttataagacgtttttactttgaccaaagtcaaactgcttcaaatttaactaagtttgtagaaaaaaataaaaatattttcaacccaagacaaatttattatgaaaatatattcgattattgatttaatgaaactaatttgatattataaatattactatatttatctataaacttagtcaaactaattatttgactttgattaaaatcaaaacgtcttggaatctgaaacggatggagtatattctaccttatcttgttcggttaatatctcgtacaattaatttgaagtggatttgaagatgatttatttcacacttattaaagtgtggaattattttcactcatttctctctcatccttgtcttttttttttagccggataagtccttaaaagatccgatcacttataggactttaaaccttgtgtttgactcataataaaggtataattggttgattaagagtccaagatggagtacttcttgcttggagaggaggttactgtctagcgggtcctaccaaacctccaaatctgagtagtttttttaagaaaataatttttttttcctgatcaaaaagaaaaatcgcaaataaacccaaaattaaccgccgccgccgtcgaggaacacctcgcctgctcggaagccatgctggcgaggctgcgcgcggcgtcggacgcggcgcgcgagctcgacgtctgcgtgcgccacggcgacgacgacgacgactacgtcgtcctccacggctgcgaccgccgccgccagcactacggccacgggcgctcctgcctccacggctgctccggcgtccgcgccgccggcggcctggtccgcatcgtcagcggcgcgcggcacgtccgcagcgcggtgggccgctacctcgccgccgcggacgacgacgaggagcacgacgagctgtccgtgggcgacaaggtcctcatcgccgccgacgtcgtggtcggcctacgacgtggtcgtcggcggcatcgacgtcgtcgtcggcgtctgcgacctcgccgagtacgctcgcggcgctctggcccgcctccgccggatgtgcccgggcgttggcatcccagtcaggttcaggtatacctcaaaccagattgaattccataaggaccgtaactgaatttgatccagtacgtgttcaattgttcgccttgctgctgctcgtttggaagggtacaaataacgctagattttcttgttgttttagtttactttagcagattcttatactttcagatcttaaagagagggtttgagatcagatcatcccaattttgtccagagaaagctttgcttattactttctagtagatagattcagtgttatcttctagacttgtatcacttcagtatttgcattctttttttgttgtctgaatagattagatattgtagatgaaaagtacatacaattgataatgttcattgcaggattggaaagaagaaagaagattgcggtcccaaacgaatccgcaagccagggacaaaagaggttcgatttgaagacctttctgaggtatatcaaatttcccttttcggttgatatgtctacaaatctacaccattaaattgacagccatggtgattaactatggtgttggtgttgattctaggatatgcaaaacatgatattttcaaaattgccgctgaaagagactgtaaggactagcgttctgtcaagtaaatggagacatctgtggaaaatttccccaaaactaagatttgatggcagcacaatgcgtggggaatacatgttggagaaactcgttggcaatgttaatgcgaccttgaaacagcagcgtgggcggatggctgaagctttagaggtcaaacttgaatttcaaagcaggctagttgcttttacaggcgaaaaaagcattctggttgatcatctcaacaattgggtccatcatcttgcacaacgagcttagctcttgatttagcaccaaaggaattcagggatcgccatgaccgctacatgtttccctttgaactcttggatggaaaagccgcatcttgcttgcagcaaattcaactaagttttgtatctctcaagccaccaacccaattcagtggtttcccaaagctgaaaaagcttagcctgcacctagtacaggtcatcgcaaaggatcttcaaggcttactttcaagttgttctaatcttgagtggttgagtattgttagatgcaatcttaatgatgatgaactgaaggttgattgtgcactgtcccgactgctatacttgcgtattgcaaactgtgagatatcaaagatagaaatgtatgctctcaagctcaagactttcatttacgaaggagcacagctgcctgttgatcccatccaagcacaggaactagaagttgcagatatcgttttcaagggtgatataacttttcagtatgctctcactgtgctccctgtggtgtttccaagcgtgcaaaatctgactgtgcatgctaattttgggctacaggtgggtctaagaaaacttcgcaagtcaataatgatgaccatatcatacttgtagattttctgctgacatggttaatgtttttttattttcagtttccttggttattgtcaactaaatcaaagttattcaacttaagtatttgaagttgctattgcctcaatgttctggagatatggacaacattgtctatctagcttcttttctgaaggctgcccctctccttgaagttttggagatccatgtaagtacttttgtgggtttgtcttctctggtagatatgttcatgtgaatgtttggttgtactacttgtaagtagtatttattttcaagtccctaggattccaggtattttcactgacatttgtccctaaattaagttgctattgcacatccatcagcactacatgttttcttgttttcacatgtttatgctcatgctaacccagaatcaagttttggcatataccaaactatacttaaaaatactgttcttttggaaccattgcagttcaatgtacctggctacgaagatgcagggataccggttctcaggagcctcccaaagtgtccatacaagaacctgaagagcatatacatcacagggttcagaggcctgaaaggccaagctgaatttcttgtccacgcagtggaaaatgccccggctctggaggtgctaaccattgacacagcaacgaaaataggcgtccgttctgctcaacacatcgaaagcgccggtggttacgttgctagaagctgccttgcaagcattgtttcacccaagaccaagtttcagatagttgatacagctaggtagagtagataccgagtactagtactgtgtcaggtactacgtatgcagttattgcctgttgtgtttgtgaatttttgatacgtactacgctctttcgtctgggcccctggggtgcttgcatcacatctgaacatgcgtacgcgaagattggcacacagatggatgcagcatgggaaattttgcgtgctcggtttgcatctcttgcaggtcacgaactcttctactactccactatacgctgtgctatttgttccttgtgcaacgccagtgtctcaccatggttactgccacacgacttgatagttgatgcactcagcagtatccagttactgacaaagcgaaaacttggtctgtttggtttgtggccaatgcaaacctcaccaaaaatctggcaatggtaagattttgagtgctgacagatttttggtaacgctgctcatttggtttattgcatttttttcctttgtaaaatgcatgttttgttgcgaaaatgttggtaataccacggtactatctttcttccagaatctaaaaaactgccgcaagttttttaaaggaaaaactttcaaatctagctatagtagtataattgtaatataattttattataactatactataacttgtatataatcattaaaataatatatgcaactttatatttaacttgtatagagattacaatgtatagttacaatgtaaatatagtctaattatattgtagttacactacgtctatactatactccctccgtcccagaatataataagttttagaattagacgcgattattaagaaaataggtagaaatgaatggtggagaatataagaagttttaaattagacgcggttattaagaaagtaggtagaagtgaatggtggagagttgtgattggatgagtatgggaaaagtgaatggttgagggttgcgattggttgggaagagaatattgatagataagttgttatattttaggacaaatcctgagagctaaaaattgttatattttgggacggagggagtagtacatttgaaagttttttttgccaaaaaaaacttgcgacagttttttagcagctctgttttatcagggtaaacacgattactgagataaagtaggtaaaaataaatggagtagtttgtgattggatgaggagtaggggtaggcaaaaaattgaatagtgaaaggctataatctgttggtgaagaaactatcactatattttaggtcaaattttacaggtcgaaagttcttatttttaagatggagtaagtaactcctttggcaacaaacaaacggaggcatcatctctatctccttgatttttttttgacatggctaaattaggcatggtttagtttccaaagtttttttctccaaaacatcacgtcgaatctttggacacatacattggagcattaaatatagattttaaaactaattgcacagttagagaggaaatcgtgagatgaatcttttaagcctaattagtctatgattagccataagtgttatattaacccacatatgctaatggcagattaattaggctaaaagagattcatctcaaggtttttaggcgagttataaaattttattcgtgtcccaaaaccattttcaacatcccatcaaacatctaatacgacttttaaaaagttctcttttagcgaactaaacaggcacatattatccgtgagtagtaatgcaaagaccctcactcaacaaacaatctctctgttaaaccaggacgtgccaacgtttaacatggcgctgtactcctaatccactggctcgcccgtcacgtcgatcagcacttcagctgagcgagcacgcacgcacgcgaccacgggcactcgcacacgatgacagagagcgcgagagtgcaggttgcaggagagtgatttctcttctgggcgcgcacccacccacgcgcgagagagagaggcagaggcggtcaggatcagggctggctggcacctgcgacgtcgctgcagactctgcactctgcactcctcctgcactgtctgcacgcacctggccctccccctgaacactggccgaagtgacccatcctctgcacctgcaccaccagctcattatcctgccatctgattccccctcctgacacctccacactgcctgcattcatcatctccccacccctgtactgtactcccttcaaaaaaaacaaaacctggttttcatatccaacgtttgaacttccgtcttatttaaaaaaattatgaaaaaaatataaagacaagttacacataaaatattactaatcatattttatcatctaacaataatgaaaatacgaattataaaaaaattttatataacatggacagttgaagttggacacgaaaaattaggttttgccttttttttttttttacggaccgagtatacgtagtgtaccactccgtataatattactactcctccacactggacagaacgaacaggttgtggttgtagtgtgcttgtgctgggtgaggagacagacgtcgacgatgatggccggcggcggatcggggaggtgcctgttcacggcgacgcagtggcaggagctcgagcaccaggcgctcatctacaagtacatggccgccggcgcgccggtgccacccgacctcctcctccacctccgccaccgcgccgccgccgccgccgccgccgacgtcgacaccgtcccctccctcgccttccctccccatcaccgtacgtacattgtcctctcgttccgatcgatgcgtacgtgtctttctttaatttacttatggcgttgcgcgcgtacgtgcagtggggtgggggtgctatggcgcggcggcggcgcagtacgggaggagggtggaggacccggagccggggcggtgccggcgtacggacggcaagaagtggcggtgctcgagggaggcgtacggcgagtccaagtactgcgagaagcacatgcaccgcggcaagaaccgttcaagaaagcctgtggaaatgccgccccccgccgccgccgccgtctaccgcccgtccgcgctctccatctcgccgccgccgcagacgccgacgcgcccagctacggcgccggcgccggcgctcctctccagctccacctcgactccttccacgcctcgacgtcgccgccgccgtcctaccacaggtacgcgcacaccagcagcgcgccgctcttcccgtcgtccgccgccggctacggcggcggctggtcgttgtccaaggagcactgcctcaccctcggcggcgccgccgccgacctgagcctcgacaagccggcggatcaccaccacgacgccacgtcggcgacgacggagaagcccctgcggcgattcttcgacgagtggccgcgcagcgacgacgggaggacgccgtgggacggcacgcagctctccatctccatccccaccgccgccgccgcgtcccccgacctcgccatcgccggcgccgcctcgcgctaccacagcaacggtacgtgcgttgcattgcacgaccgatgctttcactcaccactgaggcactgatcgatcgattcttgcgtgttttttttttgttttttgttgcatgatcgatcgatcgaccgaccaggcgaccatctgcggacgagcgagtgatgatccggcgagtttggttgctgcaatcctcagacgcaacggcacaagcagacgagtagcagcatcgatcaatgtcattggcttgataacaattgtattagcatgcatcatgtctttaatctaattaatcttgagtggtttgttcgtcagtgacatcttttgtttcactgctcgtttttacttgagtctgtgagcacatttctctcgtgttatactctatttgttcgtcagctctagtctacatcaggttgatgctaacgccgtacttctgctaggctccacagctcccatgatccatctgggacagcaggtcaagcgtgtcaggttaattaacacgcctgacctgatctgagctctcgcatgcacgggcgcaatgatgatgcaactttctctgcgactgacgttgtctttggacgatccatctgctgcaaaatcaaaatacggattatcaaaaccgggcgtaacaaattcttcgactgtttagattatactaagtgccctatcgtttcgtttttttataataagctaaaacggtttattagaagataaaaataaatttgtaggtaaaaatcaatgctgaaaaagaaactacgttgaaaatatcttaaaatcaatatcaaaattaagtttgaaaattttaaattttcaaacttaatgggccatccgatgggagcctaactttttttctttaaacttataactttttcgtcacattgaacttttctacacaaactttcaacttttccatcgtatcgttttaattttaacgtgtaactaaacacagccgaacttccttgcgaatatcacaaattcgtgttacaatagaaacaaactgcagatgaacagacgggggccgtagctgtgagcaaaagagaaaaaaaacggataaccaaatctcgccggcaaactgacgttcaaaacccgcacggaatctgacggaatgcacgtgaggagtatggtcaagccgcggtatgcttcgccgttgtcggggcgtggggtgcggcgtctccgttggtagacagagcttgagagatagtactgctactagtagactagtagtactatcttctgtaaaagaaattcaaatacttctttcatctatttttgatagtaatatttttaaatgtaaaaattttatttttgatagatatatttcaatccaacaacttatcatcttaatgactttcttggatttaatacatgactctttattcttctacacatgattggctacatgggcattgagaaatataaatattaataaatcgcttgtttacgaggaataactagtagcatatttaaatggatgataagtagaattacttatccttggtctgtgtgacaagatgaaatatgactatcaaaagtagatagagggagtactagttacaaaaatattttaaaatttttgataggttaatatactctctccattctaaattgatctatatattttataggtataataagacaaaaaaaataataactctctcagaggtatactctataatatatcacaagttaaaatttagtttttataagtgtaataaaatagaaaatataactatgaatgtacaacaattattttcagtttagtttattttttttttgacttatagaagttgaatttggttcaatatatttttggagtgttatattttaaattaattcattttaaacctgtgataactactactagatgggatgaaaatcatatccgagagagagagagagagagagagagatttgcttgctgggttgccgtgcacaggtgaggcattattctactgccactggcagtctgtctgcttgactgacacacccattaccctgcctgcttgcttgcctgttcggactcgttacgtcctcgctttttggcttggtaaaacagaaaatttttcaagttaaggggaaaaaaatctgagtactaggccctttcaactttcagtcacgttaaacctttcatacacacaacttttctactgcatcctatcaatttcaaccaaacttccaaactttagtgtgaactaaacacaacctagtatcatatttcctccattctaaaaatatactagtaagagattttactagtaggaaacttttagaaaacacgattatggatagattctttgtctggatttatagttttagaaattatctcatttatttaaaatctcgtatattttagatagagagaataataaacgaaacatgagtacttttaatatattgtgctattggacttcgtttttaccaggcatgtgaaaatgcggggcaggaatttgcccacttcaatcctaatcgttccttggagagttgcagtgaaactgaccacttcggtccattccttgcagcgaagctgttcaaatggagggtgtgtttagtgcacattaaaagttcaattgaaattagaatgatgtgacaaaaaattaaaagtttttatgtgtagaaaaattttgatgtgatgaaaaaattgaaagtttgaagaaaaaaattggaaactaaaccagtttggagtagtatgttacaatcgagttcgattatgttgagcattaggattgattgttaaatttttcaaaagtttgccctaagttttattgacagaaagcacatggtcgtgtattgacatgtgttttctccgtatcatattaaattcatttttatcttccactaaaaaaaagaagttcatttctagctcttttcgtttatccaaattaagcgtatttttaagtaattattgcatcgaagtttgtgaaagtaaaaaataattgtattcgtagaaaataaagtgaggaatagttacattgagatttgataaaataaaagtgtttttttatgtattggtatgtgctccctccgtccaaaaaaacttaatctagtactggaagtgagatagagagagtatgaaaaggataaaattaacttattttgggatagatgtaggggcctgtttagttggcaatttttttttgcctgtgtatatcacatcgaatatatgaacatacatttgaagtattaaacatagtttaataacaaaacaaattacagatttcaccagggaactgcgagatgaatttattaagcctaattaatccatcattactaaatatttactgtagcaccacattatcaaatcacggtgcaattaggcttaaaagattcgtctcgcaattgcctggcgaattatataattggttttttctctatatttttcatactttatacatgtgtctaaacatttgacgtgacagcgtaaaaaattttgtttgggaactaagcatgccctataagtgctagttaggtaaaaaagaaaagaagagctgcaatgcctaagactattccagccaacaaagaacattaattaattcacatgttttcagcttttactggctcgttttcatgctcacgttttcttgaactgctaatatttttacgatttttacaaaactttctataggaaagttatttttaaaaaaattcatattgatcttttccaaaagttctcttaaggctaatgttcaataaatcatgcgataatttgccatccattttgcgtgtgggggcctctccgaacgcagccttaaaaagtcttggaaaaagtacaccgaaggtccctcaacttgtcatcgggataaaaaacgtcctcgaaccgcaaaaccagatatgcggggtccttcaactatataaaactggtcaactgaggtccctcggaggttttcaacccggttttatccgacgtggctgctgagtccatgtggaacccacgtgggccccacatgtcagccggccacgtcataccctcttccttcctctccctttgtcctctctctctctcactcttctcgtttgggcagacactaggcagctggggaggatgtcggcggctactgccttcggcgggtgaggtgggagaggacgagggcgtcggcagccggtgacgggcgacacgatggcggcggctagcggctagcgacnggnnnngngnnncngcggccgctccgccaccgctctcgcctgccgttgcagaggccgtaggcgcggaggcgggccgccgtcgagggaggaggtagggcaagtaagggggcggggaggccggcggcgacctcctcaccgggcagagacaccgatggcgcggaggttggcggcggagaggacgagcaccacggcggagttgaccaccgcggcatcgggatcgcgcgcgaggaatcgatcgtagatggcggcagatcatagatggcggcggcggcggagggagcgagctgctggtggaggatggagtgcgcgagggagtggaaggcggggcgggaaagggaccagatgaaggccggggcgtcggtggaggcgatgacctcggagaggagcgggtcggcggtgtggaggctagctagcttgccatttcatgcgtgcatgcgccatgcaaatatagaaatgcacactgtgcccagtatatatatgcgcgcgtatacagattacagagaatcaagagcaagctatgttatttggccggtgaagcaactacgtgcatgcatgcatgcatactaatgcacaaacatatatggtgctcgattaggggtgaggtgattagcgggcttaattaagaaatggatgcgcctgccctggacttatcccatatccgtaaatgacgcgatcacggcgtattatgtatatccgcggttttgatttatcggctagataagcttgcttatcgatcaaattaaaaagataagatggggttttgatttatctgaatgacttctgttggcgcgagcgctagcgatgcgcttgtcctagcgctcgtcaccggaatatggcccagcagcagagaaacaaaacgaacaaacaaatcaagtttatctctatcgattgcttcttatctgcaggaaaatcggaggaggtcgctccggcaacgacgcgacgtcgttggtgagcgagaagacgtgcgtgcgcttcggcgctgccgcccaggttcgccatggctgtagatcgatagtgttttttcattcagaacggaagcaggagggaggaagagagggatgtctggggttaccttttggcgagccgagggagcgtcggctccttcggtgtcgtcgccgccaccgccgctctggagaagggggagaaggggggttggatttggaggaaaaggaaaaggcggcgatgggaggaagtcggaacgaatcgaggctgccgccgtgctccccttctcccgtgtcgccgtgtttcccagctgcagctgccgccgccgggcgccggccgccgtcgtgttgctggccaccgtcgcggcgccgccgctctcctctctcccgcctcgcctgccggcctcccgccgcttgcctcgcccagaaagagagacgaggagaaagaggagggtgatgacgtagattacgctgacatgtggggtctacgtgggtcccacgctaactcagctgccacgtaggctaaatccggatcaaaaccgccgagggaccttttgtgaccggttttgattagttaagggacgcgggatatctggttttacgatttgaggacgattttgtatctcgatgacaagttgagggaccttgggtatactttttccaaaagtcttcccttgcaaacagtgccacggcccactagcccatcagcccggatgtgcgtaggaataagttcaccggccatccctcaactttacaccgagattttttgaggtttcttaaccacaaaaccagaaatctccacccctaaactatacaaaaccgttcactcaaggtccctaggcagtatatacgagtggttttgctgacgtggcatcctagtcagcaaaaaaaaaattaaaattaatatgtgtggcccatatgtaagtgagacaatggtgtgggtcccatatttctctattttttttctttttctcttctcttctctccgaaatctctcgagtctcgagcaggcgtggcgaccgagggggagagaggtggccgacggcggagcggggacggcggcgacgtgagagggagagagaggcggtcgacgcgacggcggcagcgggaaaggaggagagctggcggctggcgcgacggcgagctcggcgtcggagatgttcgaacgtgccgggtgctcgacctcgggccccgccgccgcccgccgggcgagcggcgcgctctccccatcgaccctctctccctccccaaggcgatggggctgctccgctgccgaaagagctgctgcctccattggatgaactacctcagccccgacctcaagtgcagcaacttcaccgacaacgacgacgacgagctcaccatcaagctccacacccttctcggcaacaagtaagcaaaacaaatttcaacgtgttgtcatctgctccggttagctcttcttgtgttcatggtgctgattgattggttctgcaggtggaacacgcacatcaagcgcaagcccatgagccagggcatcgatccgcagacgcattagccggttagcgctgggaccagcgttgccgcggcaagcgagctgaccacgacggccagcactgtcggcttcccatccctgcaggcgccggcgccggcgtgagggagctcgaggaggaaggagggaaggctgggaggggtcttcctcgtagtcgtcgttggcggcggaggtgtctccggcggaggccgagtcagcggcggaggtgagcttgagctccgcgtcaaggagcaccgcgaagtcatcgctgccgctcgacgacgacggggaggacggcgacgacgacttggcggcggggcttatggccaagggcaaggggcgtgctttggtcggttggggtgggctggatgcgcctccgcgctcgcccacctccgctccgctgccacgctcgccctccgccactccacccgccgccacgctcgccctatgcttttctgcccgcgaccgtgctcgcgctccactgctcggcccgctgtgcttgcgccagccgccgctccgctgccgcgcttgccctctgctgcgccacccgcatccgcgcgcgctgctccgcctgccgccggcctccctcactgaagaagagaaatagagaagagagaaaagaggagagaacggagaaaggagggagaaagaaaaaaaattgtgcagctaacatgtgggccccacgtattttttaaattttttttggtgactaggatgccacgtcagcgaaaccacccatatatactgcctagggaccttgagtgaacggttttgtatagtttaggggtgaagatttctggttttgtgattaagggatctcaaaaaatctcgctgttaagttgagggacctccggtgaacttattccgatgtgcgtaccgatcgcatctgcgcaagtgagctgggccctatcctcgtccacctttcagcccggcccatttatatccagcaattgcccgtcacgcctcgtcttcctcgtcgtcttgcaagtctgcttccacctctcttccatctccgaattccttccccccgccgctcgccggagcggggaacgtggtgtttccgccggcggtttaccccaatcgggagtcctcccccaatccgggtggacttcgagtttcgagtcggaatctcgcaagaacagtccgtcccggactcctcccccccatcggatcggccagaaaaatccatcggagtcagttccttccccccgtgcgaatctgacgggggcgcaactcgtcgcggatttctccctgttccccccccacctccggcgatggccgcggtcgccgccgagcagaagaaaggttcgtcccttcctctttcctcgtccttcagcgttcgtttcttctgcttaaccccatctcgtggttgcgcaatcgcagtcgtggtgcacttccggtcgacgggcaacgcgccgcagctgaagcagtccaagttcaaggtgcggggcttctcttgtcctcttcttgttgaatctttgctccctgcttgcacgattcccacatgttgtatcgtctgatgccgattattgttactgtaatttcgcaatgatcttgcgttaaagcgaatgtgtagcgcgctagttcagcctaggccgattaaaccagcagattaaaaatgtagttaatcgagccacgaaatatcagtttgcttttgtgtagagatggaagaactcgtatttggggggactatgttgtaataccctagaaaaatgttgttaggtgaggcatcctgcagcaacgtggccttcattgtatccatcaggagacaggattttgaaaaagggggggggggggaaggtgattgattggctcgttgaatttttgatgatttttataatgtctatttcatagtattaatagtagtatgcacaagaaataaacgtgctgattcagtcaaagatttttttagaaaatagtatacctggagtaacttcacgatgtcgcctcatgatatattggatctagcgatggcaatggagccccgttgccaccccggatttgatcaggttattttcggtggtgtcatatggtgtttcatctttttttttttagtctagtatggaagatatgtacatggcttgtagagggtggcaccatgtagttttgatgccctagtcaagtatcagatgcattagtattttgtggttctacggacataattttctgttcaatttgtatgagactatgagttccttgtttaatgagcgagtaaataaattgccctggaactcatagtgaaatgatggtaacttgttatggttcatccgttcatgcaattggaagctggaattacacataggcttttgcttttgcattttcagattggtggaaacgagaaatttctgaagatcattgactttcttcgccgacaaattcaccaggatacagtggtacaaatatagcttgtaggttcatctgagttgaatcaacatgcttagaaatttgttgatttttttttgttttacctgcagtttctctatgtgaacagtgcattttcaccaaatccagatgagttgataatcgacctatacaatgtaagctttgatgtccgtgctatccgttcttacatatcaatgtactgccaaataaccttcagcagagtgcattatcatttttttaagagaacttcaaaaccattttgacatcaaggcttgaaagttaattgtaggtgtagcatactgacttggtttctaaactaattactgatgaatgatactacagtatgagtaattacataacctagtgatattattctggtatcgatgtcacatttggtgaatgattaaaggactaacactaaacatttatgttttgcatcaaagaactttggaatcgacgggcaactggtggttaactatgcatcatcgatggcatggggctgaaaggctgtacctgctggagagaggaaacttcaatcaacatggaaaaacctgtgtacaaaatttacttgccgaaacactcatcatgtaaattgctgagaatttaacttcaaagcgaagctctttcgaattattattcggtacacgttgatgtcagtagcagcagctgcaattttcacggggctttcagccccactgtaaaactgagacatccttcattaaacgccccagtgcttcagacatcgaagagcatctttcagttgtgttatgtactagagtactttctgtatgttcatcaactgctgctaatatactctccttctacagcgagatgcttgctttgaattcctcttggtaccatggcccccttcagattgtcattaagctcatgctattaagtgagccaacgatcagtgtcactgaaatgtttcgtgccacttgctaattagcttgtaaatcaaggagcacatgttgcggcagattagtcctccacgatgatgccgttgtgtccattaacacatgagcaagagcgacatgtattgtcagtgccacagtgccacttttggtattatggagcaacgtcatgctgtggaaaacggaatgcatgtcgctatgtaaagtggaaaacgaatacatgtcgctatgtaaacttaggggtatatacgtacacacgccactgcacctccacagtccacgccatactcttccactcacctttacgtgatagctgcactagtgatgaactgataatggttgtgattagtttcacgttaaaattaaaagtttgaagaaattggaacgatatgacggaaaagttggaagtttacgtgtgtagaaaattttgatgtgacggaaaagttgaaagttttttaaaagaagtttaaaactaaaaacggccaatatgcatgattttttcgttttgttttctctctctttctgtgttggatttgaacttgtcacatgagtatcgattgagtggcgcctagacctgatgcagctagctgcacgataaatagccatcactcaaacgaaaaaaagaagatgcagtactactacgagctaaccatatagtactacgtaggagtactactgacacagttccacacatgccaatacctttaaagcatttaagcacctgtctcagtgagtagctagctcgatcacgatggcaatatggtcacaattttgaatgtagaggctgtgtttagtgctcttcaaaccttcataaattccttcacctcaagtgtttggacatgcatgtagtattaaatgtagaaaaaaaaactaattggacagtttgtatgtaaattgcgagacgaatcttttgagcctaattataccatgatttgataatgtggtgctacagtaaacatttgctaacgacggattaattagacttaataaattcgtctcgcagtttacatgtggtatctataatttgttttgttattagtctatgtttaatactttaaatgtgtgtccgtatacgttaaattttttttttgacgaactaaacacggccttaattttgcactccagttcagggtttatgattccgacgaaatccggtcagaaatccgtctgagattttgaggagttttatccaaattcaaatttgaatcgataaaaaaagaaaaaaaatcaaaaaaaatcttataaatactatgatattaatagaacctattgggatataaattttcgaaaaaaataatgtattgtatgtatttactgaaacttacgccaggaaagaaaagaataaagaattaaaaaaggaaacaaattaccgatcgaaatttcgatgattttgatcggaatttcgccaaaaccgaccggttttcgagaacttatcagcaaactcagggatttgtattcaaattttggtttataaaatttattcaaaatttaccggttttccaccgaatttcgtgaaattccgaattccgccggtgcccgaaacggaagggctgtcggaatcggaaacctgctccagttagcatttcgcaattcaaagctgtagcagatgacgaaacggcggtgatgttgagtacttctcttctgtgtgtatatgcagagtaccacattggacaccacaagaatatataccggctgaacagtgtgtacatctaacatgtcggcatttgtactcctatttgctactatgtgctttaattatctcccctccctcgtgcaaaatggctcatttgtccctattagggactgcctttttatgaatgactgaatataaagctgaatcattttgtgatcactatttaggatacgtacatacgaataaactaactattataaatttgaaaaaaataatatttttaagaaattcgatcatatatagaaagtttttcttttaaaaaaaacaagtcataacgtttaggaattgtagaagcatgtctcattaaggcgctatttgattcaaaggcaattcataggagtattttatttctataggaaattttcctatatgaccctttgaatcaaaggaatgaatcctataaaatcctatgaaattcctatggaatacatcttctcatgtaagttttggagaaaatttaacatgaggtaaaaccttatataaaaaaaatcctttgagtctttatctcttctcaaattcatgtatttttcctgcggtccaatcgaacggtcattcatacgtttttcatgtgttttgaaatcatttctgtcagaatcctatattttttctattcatctgtttttttttcttccaatgattcaaagtggtcttaatccaattctcccatttctcaaaaaggaacaagcccaagtatgagagacagtatccaactatccatattaattcgtggctcaaaattaagggctcttttggaacatatgaatccacaaacacaggttatatgaaaaacgcaagattaaaatatcgtggcttgttgaatcctacagggaacaaaatcgcaggaaatgtttcaaagtggttatttggatgtctcatggataaagcataggaaagtccaatactacctcattttttaatagataacgccgttgactttttgtcacacgtttgatcattcgtcttattcaaaaaatatatataattagggatgaaaacggagcggatagtttccgtccgctccggataaaaacgaatacgaatacctctcggatcggataattctcggatagttcggatacggatacgaatacagatattttctctcggatacgaatacgaatatggtatcagggtttccgtcggatacggataataattcggatatccggtgaacagtgctattcgaatatccgcagaagccacaagacataccccatttctttataactctatgaccttcaatatacctttttagattttaatagtagttcatctcttaacactagtccacattattaatattatttaaaattttaaaaatatttataaattatactacattttatataaaatgagctaattatatatgttgatatttgtttctattagaagttgaattggttttcgtgttccgagaaaaaattgtttccgtatttgtgtccgatcatattcgattcttattcgtattcgagatagtccgtatttgtttccgtattcgagctatccgtattcgtttccgtatccggcaaaaaatataaaaacgaatatatataaaaacgaatatgatatgagcattatccgtccgtatccgctccgttttcatccctatatgtaattataatttattttgttatgagttattttatcactcaaagcacttgaaatttttgaataagacaaatgttcaaacatatgtttaaaagtcaacgatatcatctattaaaaaacggagggagtattaatatgttgatttgttggtgagagaatggagagagagtgcattgaaactttcaaaggagttgtaaacatgaggttatcctcttagtagaaatactccaaatatacatagaaattattatttcctatgaaattcctttgaaccaagactagcattcaaagactctcaaaggatttttccccctatggattctattactccatatatatttcatacaaatttcgtccaatctaaaaggactcctaagcactgattttttttctttaaaaaaaaagaacccaaagttaacatgcgaaaagacaggggcctataattaatactccctccgtcccaaaatataagcatttttagaatagtgtcaagtcaaactttttaaattttgagtattagtagcaaaaattttagaaagattaatcatgtaaatttgatcttactatatttatcattaaacgaactatcataacatgcaactctttttatttaaaacattctacttttatagatattgttggtcaaaatagtatctcgaaaaccgtgtcaagaccaaaaatacttatattttgggacggaggggtagtattcattgattctctccatccgtagcagccaagtcccatggatggttgcatgtgaccacatcgtacggggctacaaggtggtgtgtattcatgcccacaccgttgcatgtataagtacagcgcaaaagtggtagaacgagaggctctgatgcgcaccagatcgctcagtctcacaccgcacagagacagagaagagctctagagagaacgagagagagagacagagagagagagagagagggagaatggggaggagagcttgctgcgcaaaggaagggatgaagagaggggcatggacgagcaaggaggacgacgtgcttgcctcctacatcaagtcccatggcgaaggcaagtggcgcgaggtcccccaacgagctggtgagctagctattacctaatcgatcgatggtcatcgatcatgagatgatgatgatgagatttgtacttaattgtgatctgtatggatgctgttgttgatcaagttcttgcgatcgatcgatctgaattttcaggtttgaggcggtgcggcaagagctgcaggctccggtggctcaactatctccggcctaacatcaagcgcggcaacatcgacgacgacgaggagctcatcgtcaggctccacaccctcctcggcaacaggtaatctcatcacttcatgatcactccgagttccgtatcaatttcgttgagttcacagcttaaatttggagctatttggtactgtcggtgtgtggatagtgatatacttttttcttttcctggttacggctttttagggttgtaatataaacttcgcaacttcttatacgagtcattcgaaaaaaatttgaagctggctaacgctagacaataataagctgatttaacttctgttttatttttatttatttttatctttatcttttttaacaaatttgtaatttgagctgtgaaatcatagcttactgccgttttgatcgatcgtgtatatatgttgtcaggtggtctctcattgcaggcaggctgccgggccgaacagacaatgaaatcaagaactactggaacagcacgctcagccgcaagatcggcaccgccgccaccgccgccgccggcagccgcggtggcagcacgccggacaccgccagagcgacggacgcggcgtcgtccagctccgtcgtgccgccgggccagcagcagcagccagcctcccgcgccgacaccgacacagcaacggcagcggcggcggcggcggcgacgacgaccaccgtgtgggcgcccaaggccgtgcggtgcacgcgcgggttcttcttccacgaccgtgaaacggcgccgctcgccgcggcggcgccggcgccggcaggggaattaggagacggcgatgacgtcgactgcgactactactgcagcggcagcagctcggcggcgacgacgacgtcgtcgagctcattaccggcggtcgtcgagccgtgcttctccgccggcgacgactggatggacgacgtgagagccttggcgtcgtttcttgacaccgacgacgcctggaacttgtgtgcgtgacattagttcgtcgtccgtacgtacctacgtatatgcatgtgtgcgtctcatagaatgaatataaaataatattttctccatctattttaagtgcagttgcgggtttccgtatataaaattaacgattttgctatatatttgtcgacaaattttctcctaaaaatttgacagatgtaattacagtacaatcgtagtataattacactgtaactttcatg

SEQ ID NO: 41022 - DNA, 1494 bp, Oryza sativa
tttaggagaaaatttgtcgacaaatgtataggtggtccctaaaattaatcatctgtcttattttaaaaattatatttttttaaaaaaatgacacacataaaacactatttatattttattatctaataataataataatactaataaaaaagataagatgtacttacggtcaaatgttgggtaaggtaaaaaagggagcgagggagtatacaagtactcgatcgtacgatcgtagttatgcatcgacacttcttttgcaggacaaaaggttgcatgaacgtgtatcggtgtattttaatttcattcgtcacaagaaaaatgaggtgtatgctgctctgagtcccgtcggtgtatttttgatttacaaagttaactataagtcaagctatatacaaaacggaaatataaaattgtaataaatggattcatacatcaattaacatgctttcctgccaagttctttaattagtatgcacaatattattctcgagctatattacaaaaatcttttttttttaaaaaggagaatgctaaggggacgggacgatcttgtcccctgtccgcacggtatctcctccaattcttgtccgctgtttgccgttgcccataggccggccccatccgcccaccacatgtgtgccctccaacgtgtgcgacgccgctaggaacctcacatctccctcggttcgacaactaacttttagagcaagtttaatagtataggttgtgtctagatctaaagtttgaatccaaactttagttcttttccatcacatcaacctgtcatgcacaaaacttttcagtcacatcatctccaatttcaaccaaaatctaaactttgcgctgaactaaacacagtcatagtctactactagctccaaatcatctatagttaatgtaatagtcaattcatacaatagttgcttactatactattaatacatagtcccacctgtcatatacacattacgttggtcccacctgtcatacacacattacgtcttggagtccatgctacagctggctacagatttgtagcccgctgttcttctctctcttcctttatctctttaaaatatgtttatagctggcttatagcctgctattgtactactacacagatcattttcccgtgcggtcgaatcagattttcacgtgcggaggttcggcccgtctggggcaattcgtttgggaaaatcgctatttttgtgtgcgggtggcggaaccgcacgcgaaaatcggattttcgcgtgcgggtgcttatgttgcccgcacgcaaaaataaaaaatcgaaaaaaaacaaaattgaaaaaacgaaaccctaaccttagctgtcgccaccgtcgccgtggccggatccgctgcccgctgccgtcgctatcgccggattcatgcggcggagggccgtcgccgccgccagatccgcacagggaacggccgccgccgcagtcacgccgtcggatccgcgcggggcggggggggggggggggaggg

SEQ ID NO: 41023 - DNA, 5856 bp, Oryza sativa
ccgcctctggatcagcgcggggggtggccgcgcgccgcgcgccgcggatccgccgtggggtggccgccgctggatctgccgcagccatcacgcgccacctcgtcgtcgacgccgctgtcgtgccccaccacattttcgtcgccactgtcgccgtagaggaaggccggggagagcgccagccagatcggcccggggcctcctcgtcatcggcccgccgctcccgctcgtggtgaaagaaagagagggggagaggaagagagaaatgacagagagaggggagaaatcaaggagggggatgagaaagggaggagtgggcgcggctggattaaatggtagacgcgtattttcgtgtgcgaaccacttaacacgctattttcgcgtgcggacgtgttaagtggcccgcatagaaaaaattaatttttctgtgtgggtaactgcctgacaccggtcctatgattattctgtgcggttttccatatgatccgcggggaaacaaaagtgttccgcgtccaggaaaatgagttgcgtagtagtgttgtacctgctattagcagcgggcggaggagctcgtttaggatatctacttgacctaaatatggtactgggtatatcatgtcttgtacctcataggaactagctgatatctacgtggtatcatacgtggtatcacataaatatcgaacctggtatttgataattatatcgttccggaatcggattccgtgcattagctccctcttaataaaatcaatggtcaaggtcttttaaagtcctattaaaactaaaaggcaacttgaaaaggtgaataattaaattttcgaacattaaaaaagataaaatatatggagacaaacacgtgccgaatttgagttaactatattaggggatttcagttaaatctcacaaccacctaatttgttcgaagattcgtgtcttagcccaccttcaactctagcgaacatgtctctcctctaatccaacatatcaaggtctggagttgaaatccaacaactttactactacctccgtcatagaaaaggagtcattctacatctccaacaatatctcacaaaacgtgtcgttacagtggcgaacttgattagaaaagtgggctatctgtccatttctgtcaagtcatttgttaacgagtgttcaaagaattcattaattaattatatgtagggattcttagtaacatgttgagtgtatgataaattattgaaatgacaactcaattaaataaataggggtaatttagttattttaatacaaagataatttggttgacaaatcttagaacgtcaagaatttcttgacggaagaagtactttacttacatatcaaggtctgtagttgaaagccaacttatcaatgagtaatgattcttagctttgattataggaagccagggaggcagtgatatgacggcttgacaaaagggggtggcgcgggtttggtaccaccggagccacatgaggaggctgctaatacagagtgacagagctagaaaatcttcacgcatagagagaagctaatgggaccttaaatatttttagtaaatcatatatccaacatttttaagataataataaagattatggagctagtctagggctgaagccttagttgctcatgcgtattttcgcctatgctaatatagtgagagtgacaacaagccacggctgtttaggaggcaaaaggctattacactactatagaaatgtcaaaataggactatactatatgtgccagttcataaaaaaacagcacttatgatcttttctcacccctcagacgcgtctaaaataaaaaccgacacctttgatcccttgcaagtgccggtttattaaaaaaactaacagggttataggtactaattgtttttttagaaaaaaacgacacttacgaggagctgagccgacccggcctttcacgggcgttggtttttcacatacgccgagggacacatcctctcccttgtcctcttgtctctccacctctctcgaaccctctccacctctctccaactcctttctctcctgtgcaacaacgcaatgacctccctttactcgatgtgcattatttgatttgtttttggaataaacttgttgataaatggttggtttctatgacgaaaacttatcgatatctatgaacttgtttaatatttgatatgaacatttctctcttttttttagattttattatttatttttggtggctttgtggcatccgatataattgagctgagtcagaccgtgttttttttttcaaaccatatatatacctctcaaatgtgtcggttcttgattcatcctcatcaataccgcctgaggggtgttggttgggaaatatgttacctatgggagttcccaactgacaccaatgatatttttctatagtagtatcataatactccctttgtcccaaaaatataacaaactataaccgaattagatatattttagtactacaaatcttaacagagtgcatatctagattagtagttatgatatgttcaatccaattctacattactatgttttaaaatattttaaaaaagatgaagtagtaaacttggactcactaagaacatgcatgacgacccaaggcccggtgatcctaagtaggcgtagtctcaccgatgggttaacattttttagactacatgttagagacccggcttttaatcgaaagccatccgataggttaacataactatgtactaacatagtacactatcttatgattttcaccactacttacgcatactaggtagctcccatgtctagagtatagaaatatgtagccacacgacagccgacagaggatcagcctaggacggattaagaagatgacgtgaccgatcacacgttgaaagttaggtggccgcagtacgcggcggacggagggagatgaagcggtgtggaaaatcaacgtcgggggtttacctgaagcgcgctagctcgctcgtaccatgtgtgagatcgatcggtgacatgtgtgtgcgtggcgcgcggcgtctcataacgtcaaactggttctcggggtggttacgatcaagcatactctgttctcaaaaaaaaaaaaaagcatactacatcagttataaaataaactaatctcatatggtacatcctaatacaataaatctgtacataagtatatttattgtattaaaatgtatcacattcggtatgatgttgatttattttgtgacagagaaaataacatatattacttgcactggtggaaaaaccatctttcgtcggtcggccgaattccacgatagtcccggatgcaataaaaaccggggctaaagatgatctttagtcttggttaaaaagggtaacgggcatatttgatctttagtcccggttggtaacaccaaccaggactaaagatgatctttagtcccggttcaaatgctgtcagggcctgtcaggccccccggatctttaattccggttggtaaagatcgtaacttcagtcccggttggtaataccaaccgggactatagatctcggggatctttagccccggttggtaacaccaaccgagactaaagtcccacccctatatatatgtcttcttcctcctccagctgcccaagcaagcttcaaaatttcttcaaaaaagaggggaggtcatgccaaaatttctagtgaatttattttgatgattacgtacaaatcggaggtgcctaaaaggtttccaacttcatcctctaatgtttttttgtcatattacatttgcagctatgttttgcacacttttttgtctctaaaatttagttgtaagttgatgaaggagaaaatttgtatggggaagaaagaatatatagaaatttagttgatttgctaaagaagtttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtacgattttttttcgactcatgtagatggatcggcaatggatgtacgctgaccggcagtccaaagagtttattgacggcgtgcactattttttgagagtggccgaagctaacaggcaaaggggttttatttgttgtccatgcaataagtgtaagaatcagaaggagtattctgcatccagaactattcatttccacttgtttgagtcggggttcatgccaagctataactgttggacatcccacggagagtaaggtgttgaaatggaagaaaatgaagtggaagacgacaatattccggactttgctcagtacgttggatttgaaggaaatcaaacaggcgaggaggaaagggatgctgatggtaacgacgttgcggatgattttggtcagatgttgcaggacgccaaggaggactacgaaagtgaaaagggggaccataaattggacaagatgttagaggaccacagaacttcgttgtacccaggttgcgagcaggggcacaaaaagttggataccactctggagttcttgcaatggaagacaaaaatggggttagtgacaaggcatttggcgatttattaaaactcgtcaagaacattcttccggagggaaacaaattgcccgagacaacgtacgaggctaagaagatagtctgcccgctaggactggaagttcagaagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagataattcctgctaaggtgatgtggtatttccctataataccacagctaagtcgtttgttcaggaacaaggggaatgctagaatgatgcgatggcacgctgaagagtgtcaacaggattggatgctgagacaccccgccgatggttcgcagtggcgaaacatcgacataaaatttaaagaatttggaaaggacgcacgaaacatacggtttggtttgagtacggatggcatgaatccttttggagagatgagcagcggccatagcacttggcccgttacgatgtgtatctacaacctcccccctggctatgtatgaagaggaagtacataatgatgccgattattattcaaggccccaagcaacctggtaacgacatcgatgtgtacctaagaccactggtcgaagatcttaagctgttgtggaagaaggaaggtgtccccgtgtgggacgaggacaaacaggaggagtttaacatacgagcgctgctgttcgtaaccatcaacgattggcctgcacttagcaacctatccggacagtccaacaagggtacaaggcttgcactcactatatggatgaaacagaaagtacgtatcttaagcactgtaggaaggttgtatacatgggtcattgtcgattccttgcagcaaaccacccggtacggaagaaaggcaagcactttgaacataaggctgaccaccgtacgaagcctaaacatcgcaacgggaaaacagtgtttgctatggttaaagatcttaaagtagtgttcggaaaggggcctggaagccaacctatagagagcgaagatggtcacgcggcgatgtggaaaaagaactctatattttgggagttaccctattgggaattcttggacgtacgccacgcaatcgacgtgatgcacct

SEQ ID NO: 41024 - DNA, 2320 bp, Oryza sativa
aaaggagaaaggaatccattacgtgagtccaccagctacactcttagcaaggcagagaaggaaagtatgtttgaatgcttggagagcataaatgtaccgtctggatactccacgaatatcaagcgaataatagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagatggtcatcgatccggatagattagaagcccttcagaatgatgtggtgcaatgtctcgtcagttttgagttgatatttccaccttcatttttcaatataatgacgcatctgctttgtcaccttgtgaaagagatcagtatctcgggcctgtgtacctacacaacatgtttcctttcgagagtacatgggtgttctgaagaagtatgttcgtaaccgtgctcgtctagaggcaagcatcgccaagggttatggaacagaggaggtcatcgaattttgcgtggaatttatcgaagatcttcacccaatcggggtacctgaatcacgccatgaagggagactacggggaaagggaactctcggaaggaaagcaataatgacggtagacaacaatttattccgtaaagcccatttcatggttctgcaacaatcttcattggtagctccttacatcgaggagcacttggctctagttcgcgccaggaacattggtaagtccgatgcatggattacacggcatcacattgatactttccccgcgtggatacgacaacatctcatgggtaacgagtcgatcaaccaacaacttgccttcctggcgaggggaccgtctgggtcgatcgcgacattccagggatatgagatcaatggatacacattctacacgagagcccaagacatgaagagcacaaaccaaaacatcgctgttcgtgttgatgccatgggacacgatggaacaactggcacgtattacggtgccattgaggacatatgggaacttgactatggtcctctcaaggtccctctgttccggtgccaatgggttaggttgactggtggaggcgtaatgattcatgacagtgggatgacaacggttgaccttaacaaggttggatactcggacgaaccttttgttcttgccaatgatgtaacgcaagtctttttcgtgaaggacatgtctagcaaaggaaagaagggcagagggcctgacgagcctaagcgtcacgtggttctcccaggcaaaagaaaaatcatcggagttgaggacaagactgacgaggattacgatcagttggatgggcaaccccctttcacggtgacgattgaccctagcatcctcctatcaaatgaagacactccttactcacgtagcgatcacaaggagggaacaatagtgaggagaaagtacgtgcggtcaaccgtcaccgccgatgtattgccgtaattattgtgcacacgatgtaaactattttggatgtattgattatccatataaatcaattgatgtatggcataggttaattacgcatgattattagaggttttaacaagtttaaatcatgtatatgctagttatatgcgatacttacaatttttaaaagttttaaatcacgcaggtggcaatttcatatgtgaattagagtttttaacatttaatttactatcattcatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttaacaattaatttaatataattcctatgctaagtatatatgatgattacaatttttattaattttaaatcatgccgtatgtatatacatatgttaattagagtttttaccaatttaataatatcattcatatgttaagtatatatgattattatattttttttttattaattctaaatcatatatttgcttattacgtcgtatccacttaatttattacagacaacaataatttttcaaagtaattgtcattaatctttgtactttaaataattgcaatgcattatcttctattttaaaaacacatatgtaatggagaataatattcattgcgcttatcagtagtcctggttcttaaccctaaccaggtttttaaagaatttggaaatagcgggaaaaga

SEQ ID NO: 41025 - DNA, 1820 bp, Oryza sativa
gaaacgccgccaccgggcgtagcgccacgacggcaccgcgccgcacgccgccgcggcgccacgccgctgcgccacgcgccggcctgatgccgcgcgcggcgccacgctgccgccgcgccgccccaccaccgctccgctgccgccacaccgccgtccagctgccgccacaccgagaacgtgaacgagcgaacgaacgtgaacgagaacaaggtgaatgaacgtgaacgagaacgagcgaacgaacgtgaacgagccaacgaacgtgaatgagaacgagcgaacgaacgtgaacgagaacaaggtgaatgaacgtgaacgagaacgagcgaacgaacgtgaacgagccaacgaacgtgaacgtggaatgcaattataggctggttaatgaacgtgaacgaacaaatataggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagttgtccctcaagccggagtggtagagctagccctcgaaggaattcgcccaggtaagtgacgtaattatatatatatgattgttatatttgtaatgtaattaagattattagatttgtaattagacttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagacttagcatatatcactatttgagttttagtataagattattagatttgtaattagacttagcatgtaagattgtgtagggttctaatatacgacagttacacttagcatacatggctattttagtcttagcatataagattatttgagttttaatataagattattatatttgtaattagacttagtatataattattgactagctagggtcctataatatacgtcacctagacttagcatatatcatcactatttgagttttagtataagattattagatttgtaattagacttagcttctaagattgtgtagggttctaatatacgacagttacacttagcatatatgactgttcgtttagtcttagcatataagattattttagttttaatataagattgttaaaacataaatgtctcatgatttagcagatgtttcctgtatgaacagatggctgatcggatgagcgacagatattgtacgatacaatcgcggagggaagcagccagtactggaacgaagaagaggggaacgaggatccaaaccagtatttgaacgaggaagggaacgtggagagggatgcggaggagaaccaggaggggcacgtggaaagggatgtggaggggaaccaggaggaggaggctagtggaagtcaaccctccgttggacagaagagggcacgcgggcaacgaggtgccgcgaagaagctcgagggtcgacacatcataacggaagtggaagaagatggacctagtgccccggcagaagccgccaagaactatgtatgtcacagcggttggtttgtgcgggataacgtgtctgtcattacagtgtactggcgaagaacaagggcacgcggagatcataagagctttgtcccagactcggagaaagagatgttgtggaccacaatgctcgagacattcacccttcccgcgggtacagaggacaaagtgaaaaggtggact

SEQ ID NO: 41026 - DNA, 1117 bp, Oryza sativa
ccgaggcgaagattgcagatctagagttcagggtatcgagctacgagcgcagcatgcaagaggaggtggcaaggaaggctgatgaacgcatagccgcacatcggtcccatgatccccagccgaccattcctcctgcaatggtgagcccgtcaggaaaccgtagcagctgcgtctcaacggggcaggtaggatcacagagcatggacgccatgcaaacccaggacgaatccacctgccccgttgatgacatcactcagcggacaccatgtgagctgcatattcctttcaagaacttatcaataaaggtaagctcgtagttcatatattttagatttgcccattccgctagttgctgcttatatatgttgattactaataaataacctctcatcacatgaaggtggcgtcgagcatggccatcccaacggacccttcaggtacttaccactgcaggccgattccagcaggatactctgtcacgccctgatgttcccctttttagctttaaaatttgttaaataaatcgcctaaagaaattgttgaattaacctagagttgaatccttaattaataaatgcaaataataatcggaacggacatgtggaatttttcttgggttctacatgtcaaaatatgctaacaggatttttagtggaattttcagagtcttggaaataattttaaccaattaaaataagcaaagtgcaatattaaatccctgggaaaatcctttttcccttttctcttttctttttcctcccttttccttttcttgggccgtcggcccatccttcccgcgccggcccgcttctcctcccctccccaaagtcctccctccctccctctctccttcgggcgccgacaggtggggcccacctatcggtcgtcttcctcctctagccgttggagccggagctccaaccgccccaagccaccgccttccccgctccacgtcgcgcctccactacgcgcccgcacctcgcacccacatcgccggcctctcccccgccttttccggtctcgcgcgcgcgctcgccaagggcggattcaattttgaatcccctcccactctttttttctctcgacctcccacgtcccggcgaaatcgggagcaccc

SEQ ID NO: 41027 - DNA, 802 bp, Oryza sativa
tttttcacaacggaacctttaacaaggcttgttcgagaatgtgaggctaatcttgagctcctgtttcctatcgaagcagaagtacttgagtctgctagctcctctgctaagttgcaacctcagaatgatgatgcggctagccatgacccagcgtcatctgtcgatgttgaaacctcggacgtgtaccgaagcacactcgcggcaatgaaggcgattcagggcctccgcaaagccagctctacttacaatcccttgtcgctcgccaggttcttccatggagaggacggtgaagcctgctctggagccatcacctctgaaagtgattcctattctgattcccagattgaagatgctgaagatgatgataaagaggtgcaatcaagggagcagaatacggctcaaaatgctgcagaaggccagccacgtgatgaatgatccgtctttgcattgtgctgtttaatcctccgaggccctgataagtgtaaatgatacagctgcggcatacactaataatcttgatccttgaaatgtataaccattactgatcttcccaatggaactcttttcctttttcttttcgctcgtagatatcaaagttggatttatatttactgtgttctttggtttgacagcatattatcaggattttggagttctggatttctgatgttttaggcagagagcaaatgtgagttattagctgacttgggtgaactttatgcaaacccccagtagcattttgacatattctttgtacaaagaaagccacaaagctcccaattctgcagtgtacattcataaa

SEQ ID NO: 41028 - DNA, 11003 bp, Oryza sativa
  unsure (1)..(11003): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttagtgattatggatgcattgtaagtatgccagtgtttacatttgcagttaccgcttggtgaaaacaacattatgaataaaattgttatatgtgaaagaacttttttgctaccgaagatttcagtttattttgtgctcaaatgatttatactctactgatatgtcatcttttccctttcagttacttgttgccattctttccgttgttgatgacacaaagcttgttaccaaggttagctagctccagtcttctatgcacctgttctgagtattgtgctgtgataaatatcgtatggagcatttatataacacttttgtttgatttgatagatcgtaattcaagagctcgccaaacatttgaagcaacttatttttgacaaggtgaaaaggaaaactgagcttctgatatttttcaaaataaatccacaatgcactaatagtaatgaagcttcttgttggtacagaatggaagacgtccattgctgcaactacttcaccctaattgttcacgctatctgcctccagctgatctggcttgtctgaactatcgtgtgccttctcttatttcaaaggcaagctagctattctgtttagtattttaaggagaacatagtgaagtgctgtgttataaatattccacttttggttaggatgaagcttccgagagtgctgcagaagatatcccagagaataaggtggatgttgcaactaataaggagcaagatggttcagaaagcatgcagagtgcgtctgacagcaaaaaggacccatttcaacggcgacatgaattgttgatcaaaagtgaacttgccgaggtgacatttattcagtgctatgtttattcaaatacagtgttaaaaggatgcaccttttcacattgattactgcagtagggtacaatatgatttctttggtgctcgtttagtcgcatagcagtagccagtcacagtatgtatagctacatgcccaccatgtcctaaaccccataataccaacatgcacagcattttgtgtgctcacgaatattattatataaatgatggcaaaatggtccattagggattttcctatgcaaggtttcaagtatgtaactggaaaacaacacttacaataagggtctactgtattttcttgtgtgcccactattttgcccaattagtgctgacgtgacaactaacataagttaatcgtgatgaatttactagccttgctcataggcctttctttttgtgattattagatataatatctagatgccatcgtggcagcatagagttacttgtgactcaaagtattgaatatgctttatgtggatttaatataatgcagaccttcctgatcttttctcaggtgctcatccagactctcattgagaatgtcggggagttacttcgaacaaattttggcaaagatgtattgcatgaggtgaactacttttgtccttgcagatggtgaaacctgctttttattatatgctaacaatttttcatgtcataacctcattggcatggcatgatctttggctggtactcttctttccgtgaatatcggtcacttgtttactgaatcatgtatcagggaaatcatgatttgaataagttgcaccaagaataccctttcgtagtatatcaggcacaaacgagttagtgaaatacgatacacagtcataatctggaatattgaagcaacgtgtctttgccaatctgcggtgcttgattgttgtcattgtataaataatgtttcataagtgccactggtgtcactctgatatgttgacatttgcaaatctgaaggttgcggttggtggagaagataatattctggagggcatcactgacaggatccacagcttgcacaatgcaatagcttctgatgcagcacgtccaaaggcagaagatactgaacatgcctttgataactatcattccagccgtctaatcagaagacttatacttgaatctccagcatttgctgccatcctatggaaaaaagctcttgaaggcaaatgcaagacatgggctgatgggcacaggtacctcgatttttattgatatgaccctctcgcctcttctcatgttttccaggagtcacatatagatatgttctattcatcggatatttataaaattcaatcgttgattggaatttgacaccagtccctttaggtcatattccggtggcattgtctaatttatcatgcatactgtaaatttctgatattctctcagcttgcttgttctgcctgatgaacattttggttttgatttcttgatatttttattcagttccaaggtggtcgcagcattccttgaatcgcccgattccaaggtaagggatcttgcaaaagctgagctgcagccgctggttgatcgtggcattctgaaaatctcagaccataaagcagtcgaaaaatgagttttgcacctgacttccaagcatctacagcaatacgagaaatcgacagacgaacatccgtgcttctgtgttggatgttttttttgtaacatgagtatgttctgcggagcaattttgtcacctgttaaaagagtgtagctactgctgtcaccagtgagtgagtattaactctccgtaatgttatgtacctttacagtaaaattgcatttattttggtatgactgcaagatacgaattctccggccgtgtttgttctgcataggaatgcgattgataattttattgacaactgacctgaacaaatcttggagaaaacggatgccttaatcatagagttgtcatttttaatactagaaaacgatttttgcaaaacacttacaaatgcttcaaaacctgggcagtatttagagcagtatttagagcaggtacaatagtaaactattagccagctataaacatattttaatgagataaaaaagataagagataagagcagcggactgtagatatgtagctagctgcagcacgaactccaagacgcagtgtgtatatgataggtgggatcgtatattaatagtatagttagctattagattgactatagatgaattggagctagcagtggacagtggactatattattaaacttcttttagtgaatttcactgttttcctcttcttgttgccgtaaaatgaactaaagaaagctaagcaatctgaaaatgtaaacgattctttgagagagaatggaagctaataaatctgcaatgtcactagcaggagttcgtccgtcaccaatgacgctttgttcttgcggcgcgctccggcgcggttctgatctgatacaccggcgactcgccggcgccgctgccgcaccatctctggttccgatcggcggcgaggttctcctcgaaccggcagaactccgcggcgaacggcggcggcgggggcgggcgggtgtgcgggtagccggggaaccgcagccggtcggaggggtcgaagagcgggaacgactgccgccgccgcgcgccaccgccgccgttggccttgaggcagctgtcgatgacgcggcactcgtcccggagccggttctgcacctcccgcagcgcctgcgccgcgacgggcatcctcctccccccgccgccgccgccgcggtgcttcccgtgctgcgcgccgccggtggccgtcgccgccgccggcgtcctcctctccgcgcggtgcctgaacctgtcgtggcacgcggcgcagtagctcgccgcccgctcgtcgtcgaaggctcgccggcgagccccgtcagtgaggcacgcgtgcgcctgcacacgttacacgatttgatcgtcgcatcaaaagcagaaaccgcaacgaaacgaaacggtttttgcagaattagtactactaattacgaggcagtaaaaactgtagcaaatcaccacgtttaatcactgttacgttaaccacgaggattcaaagtttcaaatcgatttgaaaacgccgctctgtgggcgaccaccgctgcagtaaccgacgtggcggcgatcgaaaattgaccatatctccaagaagaggagcccaatgcaatgcaaccacccactaaattgaaagcaagaaaaaaggcaaagattccaagccatcattaggaagaagaagcatgcggaggcagagattaccaacctcggagacgatcttgaatgcgacctccgcctttgcgtgcgtgttcttgtccgggtgaagctgcagcgctgcatgcaaaccaaaccaaatcaaatcgaaccaaatcaaaatcaggtaatccgattcagggcattgcattgcgtcgcacgcaccgagctggcggtagcggcgcctgacggcgtcctcggtggcggcgtcggcgacggcgaggacgaggtaccagtcgacgaagggcggggatcgctgccggcgccggtgcgtgcacgcggagaacgccgccgacgccgcgcacacctccctcaccgcctgcgccttgctaccgccgccgccgtccgccattgccattgcccccaccgcgtcactcgatccgcttcacctccacggccatgcacattcgatcgatcgatcgatcggccgcagtgagagccgagccgagcagtgcaggcgtcgcggcgagatgctaccagttatagtaaccgtgtccacttcgtctctgcgtgtgaggagtggagtggcgagacggtaccgttcaaagcagcgatgagaggagatctcgaggggggaattcaacagcgcaaattgcggccaagcgacaaaaatcagaatagggaaataaaaaaaacaaaatgatttgatttaacacggatcaattaaattcatcacatactactagagaaatatttatcctgttttttaataatatatcttattatcatattactctctctaataataagtatttgataattatgataagatttggtgaaacttctacaattccgatcatcgataatttctttctcatattgttggttcaaagattaaataaattatgtacgtatatttgacttaaaaaagactatcgtaatttaataggtccatttatggatctatatgctttgattggaaccaaaagatctagaaattacagtcttaatagattttgaaaatttattctaataaaaacttcaccaaattttctactccttccgtttcatattataagttgtttgacttttttcttaacaattttttttagatttgactaagtttatagaaaaaaaatagcaatattaatgatatcaaattagctccattatatttaactttgaatatattttgataccatgtttgttttgtattgaaaatgttattatattttactacaaacttaatcaaacttttttaaaaaagatttaaaaaaaagtcaaacgacttataatatgaaacgaagggaatacttaacatctcatttatgggagtatcttttatggtaccacatgttagtctctctatattatcttccgatgctctccttgctcgaatgagtacatgttgtatggacagagggttgcagggatcaaacaagtgcagctcgccgacgagatttggtgtttgtcctgttgctgtaaacgtccaatgttttaggttggccatggcgatcaaagtcctgatgacaccgaatactgatctggaaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcatcggttgccgatgcaagaattttgtccagtatacttggatcaccacagaatgccaataaaagaataatattttcaatgagcaatgaaatactattttcattttgcaaagacctgaagaacgactgaacacactagctaaacacgaaccctatcttttcaacgttccaatttgcgacgccaaacacaagcaacaaagaatccaaagctgatcttggaacagtgtaaaaattttacacacccaaccaattgctaatatgagagagcctttggagtaattgtggctgttcacagctaaactcaaatctgatgctagaataataaagaagacatattgattattgaagcgtagctcgcctgcagcagcaatcagacagagctaaactgctataaacagtttggtggctgcagaatgcggctaagattttcgagcttcatgttgcgatgatactcgaaagatcatacggatatcctcccagcaccatctggccgtccgtagcttgatccaacggctcggagagaaggagatcttcttcttggaaaaaaaaaacattcacgtgccactgcatgtgggccccacagctcagggctccaaactctcggcatcttcccacgagggtgccagcatcatcactcaccagtcaccacggagtaaaacccacggcctcattgtccttggcgccctcttacatgtgggcccagtggtagaagcgggcccacatgtcggtgtgtgtggggagtaatgggtgagaaaaaacccgtggtttttttttcttcttggcagcaatcatttcggtggggccatgtcgagctgaccaattggcgcttccatgtgatccacgctgtcatcccgggcccaccagctctcccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtagtattaaatggaaaaaaaaccaatcacacagtctgcatatagattacgagacgaatcatttaagcctaatttgtgctatgatttgacaatgtggtgctacaaacctacagtaaacatttgctaatgacagattaattagacttaataaattcgtctcgcagtttcttagcagaatctgtaatttgttttgttattaggctaagtttaatatttcaaacgtttatccatgtatccaatgtgataactaaacctaaaatttttcccaaactaaaccgtgccttattttaaaaaccacctcacttcacttggggggcaagttgcaagtctcaagtttacaaatccacccctttcacaaacaaaccgaagcttcttctccacttcgtcccacacttcaacgcctcgcgatcgatcgccccaaatccccgccgccgccgccgccgccgcgaatcgccggatgcccgccgccgtcgccgccgcgggggcggcggcagcctcgggcaccgcgctgctcgcctacatactcctcgcatgctgccggccgcagccggcgccggaggccggcgaggaggaggaggaggagtcgcggctgttgtcgtccggggcggaggcgcgggggagggaggcgggggatggcggcgaggaggaggaggagtggccgtacaggccgccgtcaacgtgctgcgaggcggcggcggtggccgcgcgcacggcgcggcgcacgtgggacctcaccgtcgggcgctggggcctccacggcatcgccttcgggatcaagcgccacatgaagcgccaggtccgcgagatttttcgcatttcacctcgtgattcctcgctcttgtgcgcgattactgcgatgctgccagtattcagttcttctgttcgtttctgtgtctgcgctttgcgtttcttacttgcaaattgaggatcatttcgctcgatggctttaacgatagcgactgatcacgatgttctaactgcgctcaaatcgcactgagcggcggaacgtgtagttgctttgcttcgagtggactttttcttcgttttagttttactcttgctgaaaattttggtgtaaaaggcaggatttatgactatttcaaggtttgacttgatttgacttgcaagtaagactgcttttgcctttttatttgggaaataaaggctcaatgttgggtcagtggcttacaatagcttcacctctaccactaattcaatacattcctcgtacttgcaatgtcagatcatacttaaattatgtgcgggacttaagatcgttgatgtaaatatgggtaaatctcatggatccgtaaggtcggattcatggattttttcagagtcaagctggtcatggtggtcaaggtctcctctagatgttgatctgaagtgagaaacgtttccaactgttctgaacttctgataaccaatcgatatgcgttttatacagagctggttattttgttgcgcatgtgtgaatttgctagaagaacaactaataaaattggaccagaattctgttgtcttgctaaaactaaaatggttgctcaaagaagaggaaacaggacgcactcaacattcagttcaatataatgtactctgtttatctgcagatgttctttgcaaagctattcaatgcatcaaaactcaataagatgtacttcccgtgagtgaagagaagctggctatccgatgttctgatgaatcagcataactagcattttgttctttaagacgtaaattcggcggtagtagattgtttgctgaagcaattcagttatgcagattataatcagcttggttctgtatagctgtcttgaacatattacatagtcaatggtgtggaatcatattgtgactgtattttttcctgtttgtgtgctctagggtgatttgcagcatgagtatagtggaaatgattgccttcaactaaaaggtcacgacgcacacactgaagtagcttatctacttgagcacttgaagatttgcatgttctactcaaagaaaacattttcagcgtttcttcagtttggtgggtacaatcaagaagacattcttattcacaaggctagggcgagggtgagtaagtatcactgtattcctcttatctcatgcttaaggtactcacatttacaatttgtatttgttcctccacattttgactcactcttaactatcaacttgatgcagcttatgcaaccttctttcgcgcttgtgtgtgacaaaaaatccaagtgctttctgcttttcattcggggtgctatcagtactaaggagcgcctaacagccgcaactgctgctgaggttccttttcaccatatagttttaagtgaaggacaaatcagcaacgtggttttaggatatgcacattgtgggatgcttgctgcagctcgttggattgctaaccttgccaagcccctttttcacaggcagtacaagaattccttgattatcaaataaaggtatttttaatagcggtaaggaaggaatgaggtgattacatttataggaaaagccaaatgcagtgcgctgtgatctatatacatgaccttatttgaaataatttgtttttgataaatatcactgagacagttaagaagcgtaatcagtctctccttttgtcttttatgtcatgtttatttttgtgaagatttctgacccaaattatgtctccttatttgtcatttgtactag

SEQ ID NO: 41029 - DNA, 28284 bp, Oryza sativa
ccgctgcagtgcgctgtgatctatatacatgaccttatttgaaataatttgtttttgataaatatcactgagacagttaagaagcgtaatcagatctctccttttgtcttttatgtcatgtttatttttgtgaagatttctgacccaaattatgtctccttatttgtcatttgtactaggtcattgggcattcaatgggagcaggtatcggagcaattctgacatacattcttcatgagcatcatgagttctcatcgtgcacgtgtctggcatttgctcctcgtaagtgacttattcatgatttacatctttaaagccacactttgcttagtttttgcattgtgccttcgagatattatatggctttatgattatcaggtgttttcttatattattttcctgagttgtaactttgttctgtttcagtacttaatgggtgacaaaagttgttttggcactatgttctcatgatctcatccatgccaactgtttggttgaacgttcttgtgtacaatttgcattattggacagtgatggagaattagccattgttttatacagatatgatagaattgcattgacttgcaagatttattttattaggctacaagttaatccaggaactgagacagttatactattttctagatttaagagaggaaatgctttcagatttttaaagggttcctgttttgtatagctgcctgtatgtcatgggagctggcggagtcgggcaaagaatttgtcacttctctcatcaacagaaatgatgtggtcccggccttttcaaaagtttctgctgagaacctgcgagctgaggtactctgaatttctgatggccagtgtcttatgtgtcagcataataaaatcagaccttcactagtatgaacttcttttgtaattaacaaggaaacattttaagaacttagcaaagtgttaatacattaatttcttgtgatatttcaagaaatatgtgatgcaatggagatcttagcttcaaacttgaaatgttaacctcattggcatactggacagtggccatataaaatttctgataaattgtgaaaacgaccatatacctgattcccaacagtgttctatcatcactgatttttttgtctctactgcaggtaatggtatcatcaaagctagatgatgagcaggatcaagctcactttagcttatttacggcaataagtaagcgtgtagctttcataaagtctcatatgctgtcagtatctcatccaacagagaagaacacagatcctgattctagcatatctgaggtaatacctcttaggcactttaatttctactatttaaatgattgcttctgtcacttgtcactggatcctaaactagcacaatgataattttgcgtccttaagccacatgtgaacccagcacgagtattaatttgattacccagcggttttaatgactgttaacagctgatccagcgatcctttctagcatccaatcccaatcaacaccgataacactgtggcgggcatgctaatattatctgttagtatactaggtagtaggcatatctttggtacggatgattttccttccattggccatacaagcatcacatctattacaaaagggcaaaatgagaatttccatcatgcacagttcctgcttctccgtgcagtgtaccttccaaaaatttacagaagcaaagtaactcttgggtttactgattagtgccaacgtgagtacagaagcaaagcaacgagaggattgacgattttctgacaccctatttattctgtcaatgcagcccttgctcaaacatgtccccgaaatcacgcagcctgtaacaaatgggctaagcacagactgcaaccagcatcaaacggacctcgttgctaatacagagcaggacttttcagctgtatcagttgttacctctgaagaaaagattgtactatctagcaacgataatgttatcagtacaaagtctgttgctggatcaggctttgcagcacaaggggatgtgaacatcaatggatcactggacactgaacaagaacaatcatccttgacagggcaggaggaaccagaatcactgaagcagaactgtgatatcaaagacaagctgaaagaaccgctaccaacctgcagttcgcgccagtttttccctcctggaagaattattcacatggttgcaatggcctcacctgacccaaatcctggtgagggatccagcagcaatgagatcattagcatttatgaaacgccaagagatttgtatgggaaaataaggctagctccaaacatgataaaggagcattacatgcctagttacataagcacaatggaatcattattggaacagctgctcaaagacgataatgtagatacaataacaaatgatttgtaaattatgtaaaaactcaataaattattaatccaattctttgcaaattgcattgttctaaaacaatttccatatgcctgcatgttatttctgtcccaatgctactctgtatatataccactaaagctaaatttgcatggtcaaagttggaaccattccgttgaccggatgacgtggacatcctccgtacggttggtctctcatgcatgcagctgtaaatcctctcggcctcacgctctatatcatcactttcaagtgttttcatgaaaacgaaaatttagctcgccatcacgcagatcgacatggctgctgcttctctccgtctggtcgtcgtcgccgccgccgtcgcgatctccctccggggcgccgccgccacggcggtgaccgtggaggacgcgtgccggcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaaccagatacaacgggtccctcaactatcaaaactggtacagataaggtccttctgtggtttagatggcagttttggctgacaaggcgcctgcgtggctattttgactcggtcttcatcggacatggcactgacgtgacgcttatgtggcaattcgatatagaaaaataataaaacccgtgggacccacatgtcagttacacaaaaaataattaaaaaatagtggggcccacgtgagccccacatgtcatcctcaccctacccttcttcctcatctctccctatctcccctctcctctctttccacgcgccattggacggggaggttcggcggccggtggcggcggcagcgacgcaagagaaggggcggccggctgggttcctcaagggcgacgacaacctggacgacgacgacgacgactgcggtggcgggagcgttgggtgaagggggcggagcggggcggccggcgcacgcctattaacagtgaaatttggtaatcggcaaagacgtcatcggcttagaatcattatctgctgcagcatctcggaatcagccgatgggagttatcaagtcgccaatagtcggattcctgctatattcggttaaggaaatcaatctactaaaggatacttatccctaagtgaccgagtttaaagaggatgcggcatggcagtttatctattaattaggaatagtttgttagtttccttttatctttaggaaagtgtgtccgataaggactttatattttccttttatctttaggttagtttctttcttgtccgacaagggcttgtatcaacccatgggtataaatatgtacacccggggtctatgtaatctatctccacgatcgatacaattcggcgcatcgccaccccttttaccttttctactttattttatcgtctggcgggacttggcacccgacgcggggctgcatcggtgttcgatctccggcttcgatctccggcgaaggggtaagtccaatgtttcgccggtccaggcaattgtatcatttatgtcggcgtcgttcaaggctgcactagtacattcgacctcttggattgctctggtttggatgatatatttgcctacctatttatcatatgtctctgttaatctagtcttagcatatcaatttagctctatcggctgcttctcgttttagggtttttgccggtattagctaaatcgtgtttctagattagattagcttagacatctaccaccctgaaaactcagtcaacggcttgattgtctagatataatgtttcttttcatacttagtgctgcatcagttaagtttgatctactaagtcgtgcttagaaccataatctctagcctgcttcttgattgccaataagggtatcatcggggttttagccggtgagttatctggacgttgcatcggctcataaggattgtatatacatataagttggatttagcgatgacaacaaaggtttcactgtttaatctaatcttgtggatttcatgacatcggacctccagccgatgtgtgctttaaacctcggatcgatgcttatttatcatatcattgctagccgattggtttataccggattatattgcaatattatattatcatcagccgattgcctttatatcatcatctacattggacatatagccgatttatcaaaaccctatcgctatcggctggtatcggcatcggctattatcgactatcggctggaactactctatcggcttgtcagccgatcggttgttttgatctactatttgcatatcttgtcagttgcaggatcaaactgactggcacgcccgcatctcaccaacctttggacctgcacaggagttaagcagatctcctaggccggtgtgttcgattttttcgtcaacaacgccggattcctcaagggtggcgacgacctggacgacgacgacgacaactgcggcggcatggaagcccacgtgatcctcccatgaggaacccgcgcgtgcgccggccgccccttctcttgcgccctccccttctcttgtgccgccgccaccgctgtgccgccggccgccgaacctccccgttccgtggcacttggagagacaggagaggggagagagatgaagagcggggagatagggagagatgaggaagaaggatagggtgaggatgacacgtgggccccaccattttctaattatttttttgtgtaactaacatgtgggtcccacaggttttattatttttctggatcgaattgccacgtaagcgccacgtcagtgccacatccgatgaagatcgagtcaaaaatagctacgtaggcgccacgttagtcaaaaccgccatctaaaccgccgatggaccttatctgcaccggtttttatagtcgagggacccgttgtatctggttttggggttcaaggacgaaaattggattcgttgacaagttcagggacctcagatgaacttattcccccactttttcgatccccctggcatattcggcccaagataacccgatacaaaaaaagcccaagagtgtgtgtgtgtgtgagagagagagtgagtctgatttgcttcctccgcgaaccggtcgtcttctccagcgagacagccgccgcagaaatgggtgggagtcagctcagcctcaactcacttccgctaattcgctgcatgcaagctctcccacgtccatggcggatcccgcccgcgcatctctcgccatggcagcattagcacgcctcgctcacaaaacgctcccgaccacacgaacccaactcccgctccccaccaccatatatcgctcgccgcggtgcctccacccatgatcctccatcgacgacaatggcggcgacacgcggctccgtgcggctcctcctcctgatcctcctcctccgccccgccgcggcggggagcccactgatgatgacgtgcgccaagacgccgcacccggacgtgtgcatcaccgtgctgggcgccatcccggagtgcaggaacaccggcgacccgcgcgtcctcgccgagaacgccgtccgctccgccgccaccatcggcgcggcggcgggcacgttcgcgcgcgcggagctcgacatcgtgaaggacaccgacatgtggcagtgcctggacgagtgcgcgcaggacatcgaggaggccgtctcccacctcgacgacaccgagggcggcgtcgtcgacctcgacgccaagttcaaggacgtgcggctgttcatggacgtcgccgagagggacacgtggtcgtgcgaggagagctgccgggacgcgccggactccaccgtcaaggccaccctgctcgacaagaacgaggcgttcgagaagttcatgcgggtcaccggcgcgctcatcgagatggtcatcggaacggccggcgagccggcgccggagccgtcagctgatgaacactcggacgaactaataccggatgtccagttatgatcaattcataatgtactaatcgctcatgtgacttctcatctccatttttgatcgatcgtgttcaggtattttgattaggttaattaagggcccgttcaatttgacgtcattttcaaccataccattttttttaaagttgtcaaaaaaatgtctacgtttagtttgctactaaatttgataaatatataagaaatcctgccaaaatttggacaacattatcatcttgccaaaattttgatattgccaaaatttggtaagatttattttggctacaatctgaacaggcactaattaattaattagctcttctaattcgttgaatgttttgtttaaccatcaataaagtggttgattcgttcattagctaactaataaatcatcagattataatctttctttgtcatatatgcatctctctctctcccctctctaagcttactgagccagtgtgatcatgattttaaggtttaagattattgtaatctagattgttaagccagattactataagctgaattataataagcggacataaaataagctgttagctgtttgtatctctatattattagtcgtttgttagttgttagccacccaataattaaaaaaacatctttagagtggattattatattatagtaatctggtttatagattgtaataatctatcataataagctatatgtttgtttaagcttactcctaatagtttatattataataattctaaactgaatcattcttaattaaagggcattatggctcagttcaactcatatgttgactatagagtgctaatcagatattattttttaggtctaacttaaatatggctacggctgggaccttcttaattttctttcttttgtcaattaattgttatatataggagtagaaaaagaaaacttatctttgtgttcctttggggatactataaagtctttcacactgtgctgagctagaccggaacctcgttgcgccacatcggattttggtcgacgtgtcgcatgcgcccgcgaccaaactaggtgtctcgtgcccacaagaggggcgcaaaacttcgtcgaggcaaatccacgcgcggcgccgaaatcgtgaggcacccgcgctgtgagcagcgtttcttggccgcccgtgccctcgcgtcgattccgcccggcgaaaaccccgaatcaccctcgaaaaatcctctcctaccacagcaatttcctcctcccaccaccgattcttctcctcccacgccgtctgctcccgccacccccgctgctcccaccgtcaggaaaggcggacccgtccgccgctgcccgccgccggtgctcccgagtccgcatcgaccaccacatccgccgccctgccgctcccaccatcgagaaaggcagatccatccgccgccgcccaccgccggtgctcccgagtccgcatcgaccaccacatccgccgccgcggccaccacatctacctcgtacgccgaggggagaatgggccgccgcggcggaccgggaggtggagcggtgggcggcgacgaggccggtgatggtggttgacgcgacgggtggtggtgggctggtggccgacgcggcgggcggcggcgaggccggtggtggtggccgatgccgccacggcagccggagatgcctcccgccgacaagagccggcggccacgcgcgcaccggcgagctgccgccaagaacgagggagaggaggtggcagatgccgaggacgagcgtgccgaggagagagcgggccgtcgtgacggaccgggaggaggagcggtgggtggggcggagtggaaggaggcgagctcgcgatgggatggaggaaaacgggagcaagggtgggtgaaggaacgctcgcccgtgctagccggacccgggtcacgcttgttgtgggcttagttgccttgcacaatatctctatccaattaggccatgcaaaataggatcctttcactgtggaaatgagtgtctttgtgtgtgttttttttttttggctaagccacgaggtccggtgtttgtactgtgagtgccccaagagatactaagacttaggcactagtggacactagaccggccggctgaattctcccaccctttgcaagtttttccaaactcccatgattaaattctgcggaggaaggagatgtgcaggatgcagacaacgaaaggaaccaaagaagaagaaatcaggtaggacacggacaccaatgatggaagaggcagatacattggacgtgatggaacacgtgaatactacagcagcaattaacaaccaaatttgtcgaattattttcttgtatagatcaaatttcgaactaaaattatgtggaacggcgaacaccaccgggttgtatgttttttctttttctttttctttttttgcaaacaaaggtcaattatcttaatataataaaatattacaagttttccctgcaaaaaaaaaacaagtttgcaatcgtgtagtattaacaaattaacaaccaaatttgttaatattcacctcttggaatgagagagatacaagcaactacaagtcttgacttcttttttagctatttgtgtgaagattaagatctcactggatatggattgcaggggatgaatggtagactattctgattttacgataattattagggcataaacaaataaacaaaatattaataagttacaaataaatgtttaaatattactaagtggtataggaaattgcagagtataagaaatttttatatagtaaatttctagaaaatcagactatttatagcttaagaagcatgtccataagggcacccgcaatggttatctataggctctctataagagatctatgtcagcatattttcctatttggaagagattaaatgaagagagagagcaaagctatctactaacctgaagatagtctatagagaaaaacgaggcaatgcattagagagctatagatacccatatagacatactattaagatggtttacaattaatttagtctattgctgagatgtacatgttttataaatagcaccttactttaccattacaggtgctctaatactctagtactaagtggttgttgctgaaaataacgcatcaaaaggacatggagcccattggccctctaaggtctgcaatatcaagaacgacacaacacgcatttcagtcactttgaacacgattagctgacaaaaagaaaatcgcttacctcattttcaaaaactaggggtgtgtgatgttttgacatttcattattacgtttgagtatttgtcttattaaaaactattatttataactttcattataaaatatagttatttctagcataataccttgtcccataataaagctattttttcacctacctcgatcctcctctcaaccaatcacaaccattctctttcacctactttcttttttcaaccaatcacaccatttcttcaaccattctcatctactttaaaaatgcccgtgataacctaacaaatgtctacactttgagacagaggaagtattttgttatgatttattttatcattaaaggtattttgtgtgtaactaatatttttttatatttgtactaaatattttaacaagacaaatgatcactgttatgtaaaaaatcatgaacattatatatttaaaaatagagtgaataactctttttccaaatcaaagcgagtgttcagcgtcttttttttaacacattctacgtccttatttagtttgttcactactggacaaccaatcttttatcgtggtacccaaaacacaaatatctcggttagatttagaatcattactaaagatatttttaagtatcggtttgaaaaatccaagtcctaaaaacgtctttagttttggttggtgttaccaaccggtaataaaaatacatctttaccaaccgagactaaagacaatcgagactgaagatggagaatctttagttccggttggtgttacttaccgatattaaagatatctccaaggttagtttacaaataaagcatctccatccaagtcagatgtgtgtagtatgtgcgatggtaacatgcgtgagggctgaagtttaaatctcatatcccacatattatttttgatttagtatgtatctttagtactagttcttttaactggtactaaagatttcgatttttagtctcgctttactagctattcttagctgctacaaccgagaataaaggggattttaaactggtagtaaagatcatttctctagtggtggttatttgtcaaattaatatatatattactactataaaagataatattggtgatggaagtatggaactaccatcaatccaccacaattactcctgcacatttttacaaattagtccctaatttttttaatattaaacaagagtttaatatttgtttgaatcaaatgaacaacatatactaagggtgtgtttagttcacgccaaaaatagaagtttggttgaaattggaacgatgtgatggaaaagttagaagtttatgtgtgtgaaaagttttgatgtgatggaaaagttaaaagtttgaagaaaaagtttggaactaaacaaaacctaaataagtatggacattataaccgtagcaaaacatgtgctttttgctagtcgtacgaagaaaaatggaggtacaaacatgtgcaaaactgacccccacggaaacactgctagggaaactaagtcccacgcgcatttatattgggcacttgttccgaacacacggcttgttcaacgacagttagggctgctttagttcccaactttttctttaatttaaatttttaatttttttatcacattaaaatttttttacacacaaatttctaacttttttgtcacaacgttctaattttaatcaaatttctaattttggcgtaaactaaacacacccttacttgttaagttaactatacctgcttggtttcgcataaatttggtcctttttcgcaaactgatttgagtatttgaccggatatagctaattgcgtatccggcaccgcaatcacgtgcagtgcagcggcggcgcagtcgagagtgtccatgcgacaaacacacgttgttttggccggacacggagtggatcaagtgcggtggtggtggtggaaagtttggttgttggtatacgtaatttatccatcaattatcaagcggcacggcactttcagtatcagacggggtcctctcctctcctctcctctcgtgggatttgaagaaattaaaatccatggattattcatgccatacgttttgcaagaaacatcgcagaaattccatcagttccccaacgcagtacatttttgcatgcacatgggcaaattaatgggcgttacatatcattaatgtagtagtaagtacgtttgttttttaatttatgacaccgacgtttcaccatttgtattatttaaaatatatataaaaatataagttaaaattatatactctttgatgataaaataaatcacagaaaaataaataatacttatataatttttttaataaaataaatggttaaacaactcgttaaaagttggcgttgcacgttaattagaaaaatcgagggagtatataagatggtggtggcagctaacctaacccaacacaacacataatatattaatgtaaactctcgatcagctggtaaactaacgaaccaacgttcgcggtttgtaagacgaatcgctgtagcatatccttccgggaaatcgacttgctgcgtacgttgttggagtgtgtgacatttttcttttcaggggaaaggactttattaaatcacacgagacatattacaatcattttcgatcaaaaccatgagatagaattggactcaaattaatcaaaacatttagaaagtaataaataaataaattgcagtaataatcatgtttgatattttaatatcttaatgacaattagaggagaaatagcgggcgggccatagagaagtacaatggtgaagtcgttgatggtttggtgggacttttacaaagtaaaaaaaataaacccaacgataattatgtttcattctcaatggcagtaaaagaggagacaaacatatggatcgtagaggagtacagtaacgatgtttgacaggtgttctgaaaatcgtaaaaacgaaacccaataagacgatgaactctaaaaatgcaagatttagtgtttaaatgtcccaagtaggatgaatagaagccgtggtagattaagcaaatacgagtaacacaactggtagtgtgataaaggagtaactggtaaaaactatacgattagaaacacgggatgataatgttcggcctttcaaagatgacaacaagatacaagctatttaacaaattttaaataaaagtcatatataaaaagcagataaatttgtacatatgctagtcacgcaatttgagcgggtacccagctagttaccttaaaaaaagaaaataaaattgatcaaacaaatcctcaggttaaggattacgctcgaagtgtaggtaggctgtgtttagtttctgaaaaaagttggaagtttgtggaaagttggaagtttgaaaaaaaagttataagtttatatgtgtaggaaagttttggatatgatgtgatggaaagttggaagttgaagatagttggaggtgaagtaaacacgaccttaccaaggttatatttggctgctagctagtgctgcttctggcagcgagccgtcaactgtattgggtcaacgaaacggtggttggaccggccggtcaaacatgcgtgcatgattactgcattgatccgaccaatcaattcgaagcatacacacataccagagttcaactcgccgctcgcgcactatataaagcgtcccctcactcccagctcatgctcattcccaccacaagctaattaaggtaccagcaactccatcacatccttaatttgcagcagcaggtaattgtacaccggcgaaggaaattaaaggaaagtaggagatcgatggccaagccaagcgccgccgcctggtccaccggcctcttggactgcttcgacgactgcggcctatgtacgtcctcgtcctcgccgccggccgccgtgccatggctagatcatatgcaaatcctccgtagtactactaatgcagtagccgtagctgacacgtgggttcggatccccacgttaatgtctactactacatcagcagtagtgcagataatctctactgtgctagatcatatcatgaacactgattcgttagttctgatctgtaactaacttattagttcacattgatctgcaggctgcatgacgtgctggtgcccgtgcatcacgttcgggcgggtggcggagatggtggacagggggtcgacgtcgtgcggcaccagcggcgcgctgtacgcgctgctggcgacggtcaccggctgccagttcgtctactcctgcgtctaccggggcaagatgcgcgcccagtacggcctcggcgacgacgccgcctgcgccgactgctgcgtccacttctggtgcaacaagtgcgcgctgtgccaggagtaccgcgagctcgtcgcccgcggctacgaccccaagctcggatgggacctcaacgtccagcgcggcgccgccgccgccgcagcgcccgccgtgcagcacatgggccgttaaatggattagctagctatagcgtcacctcgtatctatcatatcatcgatcgatcgtactttgggcgtgtgaagtggtgtccagttaaaaaaaagttttttttttgggagctagttatagtatccagttttttaaaagaaatttataagtggtatattaattatatgcgtttttttacttgatactatctactatgcctctatatactcctgtaattaagtttgtgtaagtatggtgacgcatggtcaggttttgtttgtaattctctgcacttaatcaattgtttgttgtatttattaatttgctgcaaattagctgccggccccgtgtttggaaagactcctctcatttcaaattacttgttgctctattaaatcttgcacaaactaataagatttgacatattatttttccaaagcacatgatccaatataatgcactaaatttgtaggtgtttgatccaatataatgcactaaatttgtaggtgtttgatccaatataatgcactaaatttgtaggtgttatgactgtactaatttgtaggttgctctttacactaaattattgtaacggataattttcataacactaaatagaggtaaaatgatctttttataacacttaacggatagttgctaacggaaacctaatgatgatgatatttctgaaacaaagacgcttataccatgataattattttcaataaggtagggttatcgataacatttcttatgttttctcatattaattgtaacctgtgtccatcctccttgttgaccgacaacatgcagatcaagctagctaatcttgtgtttcgttggcagcatgtggttatgatggtgatgggtcaacgagattgtgtatacttcgtacttaaataattggccaaacaaagcgtcgttggctgtgaaacttatagtacgcagatttgtagggtaaaaaaaatgcactgttaggttcatttcgcatatatcacgagttctaataatttagaccattttcaaccaaatgattaggatgatatccataacattaaataagctaccaactaagatgaaaaatgatgtggcaagtgaataaatgagaaaagagaaggaaaccatatcttgcatgagatatggtttctacgcaacattcaagacatcatgtgagataaatagtattaaatttaagtataaaataatggtgtatgtattgaaagagtagtgtctagtactagagtttatgaaaactacgtctagctatatgttttgctgaaaattcggaaggaacgacacttcatctttttgacgatgtgtggtagacgacacaagcaattaaacaacgcgcatctaacctcattcagtaagatttaattagtacgcgtatagccgtatccacgcttatacaatagtgcattgtcaactactggtactatcaacgacctagaattttttaataatataaattaaactcggtctttacttcagtggccaagctagcctggaaatatatatcaacaacatttgtattactcgttctccacgacttcaaaattacgacctgcattactaaagatcccctaattattaacctcgccattgataatcttgtaaatctccaaattaagatgtgtgtgatgatggttaattaggttaatctgcatgatgtatatgccccaaatttattagccaccgtcggtttcgtttgatctgacggttgtaaacaccttatacctgtagtaaggaaaggctgggccagaccccatactgtactcacttccttcgcttctcctgcaaagcaaagttgggccttcgggccttctggttcggttggcgatgtcagccggcccacttaagggactcagcgtgccgctaaatgggccagcagatcggccaattgaaataagttcaaataaggtctcttaacttgtcaacgaatccgattttcattagaaaaatgaaacgagccgagccgagtttgttataagccaaacgagctacgagcttttcgtccacccctgaaggacactagatcgccgcctgaattctcccaccctttccaagtttttccaaactcccatgattaaattctgcagaggaaggagatgtgccggatcgagacaacgaacaagaaacaagaaatcaggttggcgtacgtacggcaccaattaatgatggatgaggcagatacattggacgtcatgcatgcatggaacacgtgaatatttacatatcaccaattcataaccaaatttaccaaaaaatattttctcgatgtgtttgatcaaattttgaactaaaattttatggaatgccaaacatcaccgtacgtgttgtatatttaccaggtttttttttcgcaaaacaaggttgattatacttaaatactgagtagccgcgggcatatattggtaagcttgcaaaatcaaaagacactcatttttcctttttgttttgttttgttttgcaagttttccatggattggggtttgagtatttgacgggcatatatatagccggtgtatatgcatgtatcatcactgacacggcacgccaatcacgtgcagcggcagcgcagttgacgcgacaacaacgcgtcgttgtttcggtcggacccggaccggaccggagtggatcaattcagttcggtggtggaaagtttggttggtgtacgtaaaggttatccatgatcatgaagatgcatgcactttcagatgggctcctctcctctcatgggatttgaatagatgtgcagaaacatcgaagaaatttcatcggttcccagtccatgcgtgcctagaggttgcatgcaaatgtgcaaatacacgatactggtcgtgtttagttctttggtcattttttttaagcatacgaatacacatttaaagtattaaatatagactaataacaaaataaattacatattccgactgtaaattatgagatgaatttattaaaattaattcatggtacaattagacaacatttaatgctccatgcatgtgtccaaacatttgatgtgatatttttggccaaaattttttttatctaaacacacccataattaagcactacatattatattctgtcctttcttttacgtatagcgccggatagtctaaatttgaacttaatcaacatcatataataaaatcagagggagtattagtataagatggtgggagctaacctaacccaataacccaacctaaataataacgtactatgctggtaaacgaaccaatgcctgctgtttgtaacacgaatcatgtcgctgtaggcctgtagcatatctcgatcgcctagcttgttgcgtacgttgtgcgagtgtgtgatactgacgcgttgtttcatatttcctactccctccatctaaaaaaatcaaatctaatgctagaatataacatatcctaatataacgaatctgtatatagagcatgtttcacataatattttagtactaggttaacgtttttttacggagggagtaggtcctaatatataataatctgaaatatatttaatatattttaagactacgaatctagacaaatatatgttaaaattcataatcataaaatgtatcaaattcggttctaggttactacggagtatatattaagacaggttagtacttcacttttccacacaacttgtgaccacagctatgatttgatattttcttcgaaaacgatatatctttaatttgattgacatttatacaaaaaattaatagaaaatcgtactatgcgtacatgagatatatcattttagctggaaaataaaaaagatattactggcctggattagaaaaaaaatacaagtgaactggcaatcgatcgagaaaatagtggcgatactcccggttggctaggtaattagcatcaacgccagagggattattactgtggctaagagcaagtataatattgagctataagtctactataagcttatgtgaaggagaaagataacaagaaatcaaaagtgttggctcttatatgcaagagctagcttaacacaagctccaagatagagatagagagaggagaagaaaattaaagccaaccttataactaatataatatatgttggctttaaaatagactaatagtagaaaatgagctctaattaaatcccaactggcacgcgcattgattagtctcatgtcgatcacggcatcacgctctaattaaaacgatttgatgccgtcgcaaaaaataacatacagtactatgctggtaaacgtgtatgaatacatcctcagattgaggattaatctgaagctaaacctggatataaacacagcctaaaccttttacccatgcctagaagactggcgtatataaacacagcctaaaccttttacccatgcctagaagactggcgttgtgaaacaataataccacaccactctagtgcgttgtggaacaataataccacactaatctgggcggtgttccaacgtaatttcacatgacattaaaactgtcatgccaactattggtgacgtgacaatgtaactattagtgacgtggcaatattttgtcacgtcagacggggtggcgtgataaaaaaaagggattttgaaattggtattaaaacagtttattttaaaaattaaaaaaataaaaagtttcaaaaaaataaaaaaaatctagctagtgctgcttctggccgccgtcaactgtattgggtcaacgaagaccgacggagcaaacatgattatagcatcgaccaatcaaattgaagcagacacgctttcttaccagatcaactcgccgttggcgcactacataaagcgtcctcccattcccagcactagcagcaactcgattgatcacatccttgcagcagcagcaggtaactgtgtacaccggcgaagaaggaggaggaggaggagatcaatggccaagccaagcgccgctccggtgaccggcgtccccgtcggctccgccgcctggtcctccggcctcttcgactgcttcgacgactgcggcctatgtacgttcccgttctcgccgccggccaccgtgccatggctagatcatatcatgaacactgattcattctgatctgtaattaattaactaactaattgacattaatctgcaggctgcatgacgtgctggtgcccgtgcatcacgttcgggagggtggcggagatcgtggacaggggctcgacgtcgtgcggcgccagcggcgcgctgtacgcgctgctggccatggtcaccggctgccagtgcatctactcctgcccctaccggggcaagatgcgcgcacagtacggcctcgccgacgccgcctgcggcgactgctgcgtccactgctggtgcgagtcctgcgcgctgtgccaggagtaccgggagctcgtcgcccgcggctacgaccccaagctcggctggcacctcaacgtcgagcgcggcgccgccgccgcgcccgccgtgcagcacatgggccgttaaatagcgtcatctctcctcgtacatcatcgatcgtacttggacgtgtgaagtggtgtccagttaaaaaaaaatgttttttttggagcgtacgatcgatcgatcttactagatccatctttttcaaaattaattatgagtttttttaacttgatatctatacctgtatgtactcctgtaagtttgtgtaagtatatggtatgcatggtcaggttttgtttgtaatttctctgcacttaatcggttgtttgttgtattaatctatatgtctattatattattaaaacagctttgaaaaaaggcaacacgttcgctgtggaggctagaaattcccacgttaatcgaagaaaaaggaaaatatatgtgtcgttggatcgtatttgtctagattttgatggtctagatcaagcagggaaatacgtgagtccaaacaaaaaaacatctagagagattgactaggaatcggacatgtatgtatttggactaatttgactaggagtcggacatgcatgtatttgcatgcatgcgtatggccatttgagcctgtaaatttgtaattagagtcatgcacgttcatccacgaaagaataagcaaatattatgttaattattaagcgctcaaaggtagattaaaatatattccaataggttatggtaggactaaattacaatgctataattttatctatagaaacagaagataagtgttgtacactaaatctaattatacatgcatgtataataaaatatttatgtgcttaaattgtacgctatatttgctctaaagaaattatcacgttaattaaacaaaataaagaaaataccaaccatggatagaattgtggtatacttgaatattaacggttaagatttaattaaaatttaaaaagttaaagagatgaaacggatacgagtgtgaaaccgtatagcaattgaaccaattgcacacactgaccttgcatccaaatcagaataggaaattaatttttgaagtgatataaacgcgaaagtttgttcatgttaataagagggaaaaggaaaaaaaggaccaaatatatttttatttagaaaaggttttataggaaatacaactatactactataatactaacagtatataaacagaatagaaatctaattttccctgtgattaagctaaatcgtaagtcggtagctgagtagtaatgtaatgacatgtaaaactagcacccgtgtctgtctcatgcaccatacccatgacaatatgatgcgtgcacacatgaaaaacaaacgacgataacgcatgcatgcgaggtgttggacgcatccatcttattgactaaacccaattagcacatcaatgagatgctagcagcttagcatgtcatattactctctaaacctacattaaacaaacagtgaggttagcacatcttagtatattaccatgggaagttcaattattggaattatgatttttttaatctttagagtaatctagaacatatgacgagattaattaattaacatgtctataaagaagtaaagtggtggcggttgatgggatatctaaaaactattaataaaacaccaaatgaaatcctaatgacgattaaaataaaggatgatagagaggtcgtgaagcaatcggtcaagacggttatcgggatttctagaaaaaaaaaacccaataataatcatatttgatttttaaaatctcaatgacaataaaaatgagaggcagcgggcgaatcgtacaggagtacaatggcagagctgccgatggttggtgggagttctagaaagtaaaaaaaaaatttcaatgatagttatgttcaatttttaaaatcccaatgataataaaaaatggtcggcagacgggtcatagagaaatatagtggcaacatttgatgagatttctaaaaaattaaaaaataaaaccaaacgagacaataaactctaaaaactataaggtccaatttttaaaggtctgaacttctaaaaagtacataaataaaccctaatgataatcatgtttgattttaaaatctcaatgataataaagaaggtaggcagcgggcgagtcgtagaggaatatagtgacaaagtcgttgacattttggcggaacttctagaaagtaaaaaaatgaacttaaacgataattatgttcaatttttaattaaaatatcaatgacaataaagagaagaggcagtggatggctgtagaggagtataatggcagtgtttgataggacttctataaattataaaaatgaacccaacgggataataaactctgaaaactataagatctaatttttaaaggttcgaataagaatgaatagaaattgtggtagatcgagcaagtaaataaacaaggatatgacagaagtaagtggtagcaactaatgtgatttttaaaaactataaaaattagaaacacgaggataataaggttttgtcttgcaaagtgatcttaagacaatgagataactatttaataaattttaagtaaaaccatattaaaaaatatataattttgtatggtgctagccgcgcaattgcgcgggccatctagctagtttgatgcaaattagttgtgccggccttgtgtttggaaagagtcccctcgttttaaattacttgttgctctgttaaatcttgcacaaactaagaagatttgacagattacatggttacccatattttactgccacgtagtcgtcacgtcagcgaaaccgtcattcaaaaccatccagggagtcaaattgcgctggttttaacagtttaggggtcaagatttctggtttacggttcagagtcacggattagattcgggtcacttttaacatagtcaaagtgaacttattccgatgagctaccttcttttcccgtgagtgtaattaaattgctaaacataattttttttaaaaaaattacgtatactccctccattataaagtatagaaagctagtactatattagacacaatatagtactacgagatagacaacctagtaatataaacttagtcaagcctcacaacgaaaccaaaaaagttgtatttggaagtggccaaaaagaattaagctaccgggttcgtttggtagtgctctaactcctaaatttagtttcaagaaatggggttggtagtaaagttgtggggtaccctaaattccccttaccctctctagttcatttcctctcattttatcctgttcacctcaacgactaattttattgtgcttatacctaattaatcaagtaagtcataggtcatggattttatttttgactggattgtggatttttctttcgcgaacgcgtaaacagcttacatgtcaataaatggatctattggtatagcatcacgaaagactttagcgtggcaaatcttctcttacatgactttttggttacattacggacacttttcaagttatcaggtgtgatcctatcctgctcaattgtttcaagtttcaactcaaataagggagagagtgagtgggtgtgtaggagataaggtcgagagaagggagggaggggggtgtagtggctgggagacatatggtcgagaaaaaaaaatcatccctttggctggttctactatttactacaccatctgttttaaaattctactatttactacaccatctgttttaaaatataaaaatatttgaatgaatgagacatttcctattatccgatttattaaaaaacccggcatggataagacggcactgaggaacattttttaagtagtgagcagcagcagcagcaggtaactgtataccggcgaatttcctttaaaaaaaactgtataccggcgaaggagaggattggaggagatggccaagccaagcgccggtgcggtgaccggcgtccccatcggctccgccgcctggtccaccggcctctgcgactgcttcgacgactgtggcctatgtacgtacatctacgtcctcgccaccggccatggctagctactagtagcttgcatccatggtgatcgatcgatcgatcaacatgaactgattcattcaatctgtaataacaatctgtgcaatattgataggctgcacgacgtgctggtgcccgtgcatcacgttcgggagggtggcggagatcgtggacagggggtcgacgtcgttcggcaccggcggcgcgctctacgcgctgctgtgcgcgttcaccgggttccagtggatgtacctgcacctaccgcggcaagatgcgcgcccagcacggcctcggcgacgccgcctgcggcgactgctgcgtccactgctgctgcgagtcctgcgcgctgtgccaggagtaccgcgagctcgtcgcccgcggctacgaccccaagctcggatggcacctcaacgtcgagcgcggcgccgctgccgccgccgccgccgccgcggcaccggccgtgcagcacatgggccgttagaaaaagcttcacttcatgcactctccatcccaaaataagtttatttgtaggtttctatatctagcgtttaacaattcattttatttaatttttttatgattagtatttttattgttattagatgataaaatatgaatagtactttacgcgtgacttattttacttttttttttcaaataagacggacggtcaaatgttgaacataaaaactcacaaataagcttattttgagacggaggtagtgagtgtgaagagctgtccagataaattattatacttgatatatctagggactatgcctgtactcctgtaagtttgtaagtatggtgatgcatggtcaagttttgtttgtaattctctgcgcttaatcgattgtttgttgtattagtttgctgtaaattagttggcgtccggcccattggatatagtctttctgtttcaaattatttatcgttctattaaatcttacacaaaccaaaaaaaatgacagattatgtggtttccctaattaaatacatatcctttttttctaaaacatatgagcccatataataagagttgtgactacactaatttatatattgctctttacactaaattaatgctaacgaaaaaacaataattttattgagcattcaacaatatataacaataaaataatcttttatagcactaacggaagactactaacaaaaatctaacaatgatgatatttctgatataaagatgcttgtatcataacattttcataaagttaggttcgtcaatgatatcttagaatagagcgtttgttgattacatttcttgggttttctcgtattaatttgtaagctttgtctatcctccttcattgactgacacttgcagatcaagccggatatcatgcatgtttgtgtttcgttggcagatatcatgttgtgtttcgttggcaggagtggcacacatgttttctgatggtgatagtcaacggagctagtgtatatactccgtacttcaataattggaactttggaagcgtcgtcggctctgaaacttatattacgcagtcttttagggtgagaacaaagatgcattgttaggttcatttcgcatcacgagttctaattaataattcatgaagctgtatatattgctgaaaattcggaaggaaacacttcatttttttgacgatgtgtggtagacgacacaagcaattaaacaacacgcatctaatctagttcagtaagatttagtacgcgtatagccttatccaggcttatacaatagtgcattgtcaactcctggtactaccaacgacttagaattttttaaatattatatattaaatccgacctatgcttcaaattaacggcctaactactagcttgggaatatcaagaacatttgtatatatattactcgttcgctacacgacttcaaaattaattacgatctgcattgctaaagaccccttaattaatctcgcatcgctaatcttgtaaatctccaaattaatgtgtgtatggtgatggtcaagttaatctgcatgatatatatgccccaaaattattagccgccgtcggtttcgtttgatctgacggttgtaaacacctgcaaatcaaatttgggccttctagttcgcttggcgatgacgtccggcccatttaagggactcagcgtgtcgctaaatgggctaattgggctgatcggccaatttgcgaatgcactaaggccctgttggatcaagctcatcggatcaactacctcctttttccgtgagtccaatttctaaattactaatccttttttctaaaaaaaaagaagcatactccctctattataaaatgtagattagtacaatattagacacaacatagtactaccagatagataacctactaatataaatctagtgaagcctagatcggtacaaaaaaccgatatagaatttcctctgatcctctcccttatcccacttctattcgacggctaattattgtgctcagccttaattaattaatcgagcgagtcataagcagtggagctatataccaatggtatcacgaaagactttggcatggcatggcatgccttctcttgcatgcatgaattttggggccctctcggaagtctcgtttgaacacataatgcaagttagaatagcctaccaggcttgaatcgtgatcatttccagttcggtggtttcaagttcgaagcacacagtttgctcaacaaaaagcccccttttttctggatttatttatttaacctgtgtatcagtatagtagcagcagcacattatacatatgtgaatgtgatgggctgattgggctcaatgtttgcgagatctcgatcaagatcgatctcgtgggggttgaagactaaatcaacggttcgtttcgtaagcaacagcacagaaatgtcgcgagttcgtagtaaattaacatgggtgcttagctgtgttgttcgcttgcattgcataccagatcaactcgccgctcgcgcgctatataaagcgtcctcccactcccggctcatgctcattctcagcacaagcagtagctagctagcaactctgatcacatcgccggggaagaaaagtaggaggagatcgatggccaagccaagcgccgctccggtgaccggcgtccccgtcggctccgccgcctggtccaccggcctctgcgactgcttcgacgactgcggcctatgtacgttctcgctcttttttataagcttcagctctttattttgctttttctcccttcttctgacataagttggtctggctgattccattgtggtatattgatatgtaatcattttacgtgttcacgaaaaaaacgttctcgctctcgccgccggccaccgtgccatggctagatcatatcatgaacatgatctgtaatttactaattaattcacattaatctgcaggctgcttgacgtgctggtgcccgtgcatcacgttcgggagggtggcggagatggtggacaggggctcgacgtcgtgcggcaccggcggcgcgctgtacgggctgctgtgcgcgttcaccgggtgccagtggatctactcctgcacctaccggggcaagatgcgcactcagtacgggctcgccgaagccggctgcgccgactgctgcgtccacttctgctgcgagccatgcgcgctgtgccaggagtaccgcgagctcgtcgcccgcggctacgaccccaagctcggctggcacctcaacgccgaccgcgccgccgccgccggcgccgctcccgccgtgcagtacatgggccgctaaatagcgtacttggactgtgaaataagagttgttcagttaaacaaaagtgatttgttccggtcaaaaaaaatctcaagatattggtatctcacagtatcaaatcgtttctgattggtgaatttagctggacaggacgatgagcattgttaagattcatcgatcggaaactatt

SEQ ID NO: 41030 - DNA, 6790 bp, Oryza sativa
gtaccatgtgatactttttatttggaccgggacaaatctctaaacgaaaagtatccggaacaaatttcttttagagtatccagttaaaaattttaattacccgtggtaaattacgtgtgttttatttgatatctacgactatagtcatgggattaagtttgtaaatgcgtgtttggtgatgcgtggtctcagcttttgtttgtaattttctccagtttaatggatttctgattgtactctccaaattagccggcctgccccttgtttcggggcaaaataataaatgaataatttcgttgaaaattaagcttctctggttcaaagtcaaaagtataggtgcatttatatttatgagtgtgattattcgtcaacgagagtactatacgtatcctacggtctacggcgccgaagtatgaaaatgtttaggtgtacaagctagtggacacacgcaatattcaagtataattaattcaactgtctatttcgaacttttgtaattcttttttaaaaaaacacagtgcaaatgtaacgcccatataatgactgggccaatatatcctaaaattcaaaaagtcattccaaacccctctatcatatacccattagtcgtcgtattatgagattcaagaagtcactgcagacgtatcctgtcatcgatgagtatgtcgtctatcactgaaacaataattaaccgtaaatgtaaatactcaggacaagttgacttgaacttgtgtgggtatattcctccaacagaaacctaaccagttgagttacactcgtatcaagagtggtaagaatattctagtggtaaaaactacccaatgtttactttttaatttttgcgggaaagggtggatattacaatcgtttcagtacaagacagagattctacactcgtactgcctaaatttgctaactcaagagtagctttagtacacatagaatcgcatattaattagaaactaaaaattcagccttttcaaattcttagtttacggagtcaagcacagggtttgctaaaatactaattctgccttctaactttccatttcaattcctaacccctttgcaacaaacagacgcaatatgtatagcatatgacaatatgaacacgtattacggttgaatgtgtgtactctagccacatgctgtgtttgtatatcctccttattgactgataacacgcagttcaagccggatatcatgttgtgtttcgttggcacacatgttacaaacttacaatggtgatggtcaacacggagctagttcatactccgtatatacttcaataattggaactgttggccctgaagtttatatatatttttgggagaatagccactatgatccctgaagtttcgctccgagatcgttttagtccctgacctttcaaattgtccaagcaagccattaaactttatcatgtggacatatatagtcattggcccatcgaaaattgtcacgtgaacatgccatgtcatcttccaatgcaaatatatgatgaaatacccaatttgcccttgcacatatcgtcatagggaaaaaagagaaagaaaacgagaaaaatacaaaatataagtaggtgatcttgcatattaaatatccgttagagttttaacattaaaatgcaactacttacatgaaatttatttggcatggtaattatatatttagtggttatagctaatttaattttgtattagcataatccagtgaaaaaagtttgccatatatccatagtcacattgaacaaagtttgtaaactcatttcattgtttttctatggtatatagaagggcaaattggacatttcaccacatattatgcatgagagcataacatggtatgctaacgtggcgatttaagttggcccaaggactatattagcccacttgacaaattataaggactcgtttggacaatataaaaagttagggaccaaattgatccccgagcaaaactttaaggatgatgttggctattctccctatattttactacatatataaccccgttttatagggtgaaaattatatgcattattgttaattcattaggttcatttcgcatccatcacgagttctataatttatgaagctgcatatgtattgctgaaaattcggagggaatacttcatatatcttctgacaatgtagaatgtttggtagatgacacaggcaaatagacaaatgcccaactgaattaatctcgttaggtaagatttagtgcgcgtatacacacattatacaagcagtgcgatgccaactactgatactatcaacgacgacgacttatcaacaatcgtttgtaatatatactcgttctgcacgactgccaaattacgacctgagttgctaatgatccctaattaacctcgcattgctaatcttgtaaacctgcaaattaatgtgtgtatgatgatggtcatgttaatttgtccgatgtatatgcccccaacaaattattaattagccgacggccagcccaatgttaattttggattaaaattatgaagctatatactcaaatcttagtaaaacataatcaaatcgtagtactgtccgttcaaaaaaaaatcgtagtactgtgtatcgtagacattctttaacagtacacagcttttgagtcggttttcgtttaacagtacacagattttgagtcggtttcgttttgatctgacggctgtaaacaccagccataccccatactgcacgtctgcacccactcacccttagaattttttttatttttaattttttttattaaaagttttacaaaaataattttttattttgaaaattgacagaagtggtcgcctaccgccctctgggagggcgatttttaaaaatcgccatcccagagggcggtgaaagtgacgtggcagacggccgttcgctctcgggcgacggccgtcaacgaaatttgcaggcggcccccttgccgccctctgctagggcgattttgtactgtgcggggggccgcctgcaaatgggcggcggggggcctggaattttgcaggcggcccccttgccgccctgggggagggcgaatttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattcccgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatgattagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcttaggggatttacgtgccattctaaagcctcagcagcaattcgacgttcatgctcatccttccaccttaggtagtccgatcttgtttcactacgtgggtaagcacgggttccgtcgttttgtgggttctccatgtctacccactcgatgaagttgcacattggacgatatgtctgcgtaagatgttacaattatgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcattttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacatcatctcaataatcttttgtttggctctctaggcctttgcatagcttatggtgtacttgaatttgttctcgatgtgcctaataattgattttggtttaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgttgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgggcctgatgaaaacaataactgcgtaacctcgcatttctgtactacaccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaatataacatattagtacaaatgcaaaagatgtatgggagcaaacctgtgatgaagtgagcgaagcagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccggacgccccagaggcgggcgagcggagggcggcaagggggccgc

SEQ ID NO: 41031 - DNA, 48243 bp, Oryza sativa
ggcccaatatccggatacactggagtcctgtccggttatctcattggatgagctacttgtagtgagcaacattttgctcccttgtacttttttttaaaaaaatattatatcgaagtttaatacataattaattactgctaattatgtatcacattttgcacgccacctgaagcgaacggggcctaaaactctcattactactcgtagtaatattcagttccaaaacaatatgcccaagtcccaaatagaatttcctctcccttgctccatttcttctcaacaattaattattgtgcttaactaatcgagtgagtcataagcagtgaagctactataccaatatataacgaaaggctttcgcatggcaagtattctcttgcatgaattttgacctgcagtacagaccctcggaagtcttgtttgtacagtacttacaagttagagtttgttcagattagtgccaaaataaatattaccaaaacttggcaatataccaaaattttaacaaattgataacattgtcaaaattttgataggattggctttaaaatgttgccaaaattccatatacattgccaatatttaataacaaactaaatgtagccacataattatcaattttaacaaataatgatattatggttgaaaacgtcatcagtctgagtatgcccttataatggcctatcagatcaggcgtgatcctgcctatgtttggctgtttcaagcacacagttttctcaacaaagccctttcagtagcagtagcacatatgtaatgagctgattgggctcatgttttcgagctcaagatcgatctcgtggggtaggtttctaagaccaaatcaacggatcatttttcaggcaacgacagcacagaaatgtcatgagttcctagaatcctagtacatttgtgcctagcttagctgttgccagcaatcaatgcacaaatatgttactaatggtactatcttaacctaactctggtactaattaagttagtaactagctagttataatgttctaatgttgtagtaccgatccaagaagtaggtaagtgtaaacaagccgaacagaacctgtctcttttactcattttcctgacaacttgcaactgatatattgatcttgatcgattgacattttcctcgttgaaagaaattcttaatcatttgagattaaaaaaatattaggagacaccatttaataaaaaaatagagtatgaaaagattggtcaggaaatagccattgggaaggagtcgaaattccggcggccggttggctaattaactgaccggaacttcaatatacgcgaaaaagaagtgaacgtacatagttattgtgaaatcccccaagctcccaactgtcaagcacatagttggtatgccacacgctaattaagatgataatcaaaataaacatggtttctaaggcatgaatatataatagttggtactacttactacatccataaaaaaaaaacccaaacacgaatatagacattgatttgttgtattaggatatgtcccatcctatattattattatattattattatgttagttttttttgtttttttaacggaggaggaagtactactgccactgccagcgacattgtatgactcgtgagacctgatctaggtcatgtccgaggtattcactgcctcattgactagtgttgccggtcggttctggtggagtcaactaagttaattgggtcaaccaaacgctagttagatcgggctaatatatataattaaaaatcatcgttttaaagtttcagtaaacatgcatgcataccgatcgtgctactgctatataagagccacgctcctagctaagctcatgctcatcgctcctagctagcaagcctgccgatcacaacagcagcagctggtcagtggtcgcactagcgaaggagaggatcggaggagatggcgaggccgcaacacaatgactggtcatccggactcttcgcctgcttcaatgactgcgaagtttgtgcgtatatattacttccatattgtcgatcagtactatactacttgcgatgattctatcgatcgtccttcaccagattatatatattgcatttattgtatagaccatctattaattctaagctaatttaagcttatttcccggaatatatatattgattgagtaattttaccatataacatttggtaccatattagatcattccttaatattcacgtctttatgtgacacaaactaattatatatatgcaggttgcttgacgacggtgtgcccgtgcatcacgttcgggcggagcgcggagatcgtgtcgaggggggagaggacgtgctgcgcggcgggcgtgatgtgcgtgctgctcggcttcttcgcccactgccactgcctctactcctgctgctaccgcggcaagatgcgcgacagcttccacctccccgaggacccatgctgcgactgctgcgtccacgccctctgcctgcagtgcgcgctgtgccaggagtacaggcacctcaagagcctcggctacaaaccctcgcttggctggctcggaaacaaccagcacgtcccgcccaagcacaacccgccgatgcgacgctaatagtacgggtggtctacttaagatgagtgcctcgtcgagtctgttcttcagcccatttcttatatatctgttgtatttgcttcaaattagctgccggccggccacatatgtttaataaacttggttttgaatgactgttttgaagtaagtgaacttaaaatatgccggccccatcgacttcctgagctcctgcctcctgatgagctcccgtcctcgccgtcgccttcctgagccctcgccgcggtcgccaaattgggcttctagtctccgctctattcgtatatacacatgtatatactttgtattgggtacaatacaaagtttatatgtatgaattctaagtatatgcatacgtatacaaattttatacacatggctgaatatgagggactaagtacaaactttatatgcatgtgtgtaaaagagaaaaagcccaattcggtctgaatggatgaattaggccggcctgttaaatactccctctgttacatatctattattatattattaaaggaatagaaaaggagcctccacgttcgctctcatggcctagaaactctcacattaatcggagaaaaagaaaaggtagagtccatatagaaatacaatttagaaatagctgaaattcggaattaaaaaataaggaatattagaagaggagactagagtccatatagaaatacaatttagaaatagttgaaatttgaaactaaaaataaggaatattagaagaggagactagagtccatatagaaatacaattagaaaataactaaaattcggaattaaaaataaggaatattagaagtagagtatagagtccatatagaaatacgaataggaaataatagaaattcggaattaaaaataagaaatattagaagtagagcatagagtccatatagaaatacaattaagaaaaaaaagaaattcagagttaaaaaataaggaatattagaagtagagtatagagtccatataggaatttaaaattaactaaaattcagaataaacataataaaattaaaagtagagttttgagtctgtataaaaatacaatttacaaataactaaaattcaaaattaagaaaaacatgggaagaagagtttaaagtcaatataggaatataatttagaagtaactgaaattcaaaattaaagaatattgagagatgagtttagagtccacatataaatataattagaaataataaaaaatcaaaaataaaaaataaataatattgaaagaagagcctagagtctatatagaaatacaatttacaaaaaattcggaattaaaaaaatatattaaaagacgagtctagagtacatataggaatatatataatttacaaataactaaaatttgatattaaaaataattaataactaacacgtatataaaatacaatatgaatattacacatttgtagtttcgtatagttattgcaaaatttaaaattataatgtcattttaatatatttgaataatataatgagaaaacatatatgctattatataagagaaaatataatgatgctagccgcgcaatctgcgtgggccaccatgctagttataagtcatttaacttttttcctaattaaaatttgttaagtttgatcaaatctatagaaaaatttaggaacatctaaaatatcaatttagtttcattaaatctagcattgaatatatttttataatatatttttttgttaaaaatactagtactatatttttctataaacttagaaaaaaaaagtcaaacgacttatagtatgaaacggagggagtaataaagaccacaggaaaattacaaaaaaaagaaagtctgaaaacgtgtggccaaatttggtaatgggccggattgatcgtgtgtggttgggccgaaaaaggatatatcaaaaatagcaaatggccgaaaacggaaagtcatttgcttcttaggtcgaatacgttctcttttcctttttttttaagaaaaaaatgcatgtgcgttacaacgggtgagactattttaatcgtattgttgttaattttttttctaaaaagtatatatgggatttttattttgatagtattgatatctaatccagaaacctcattgggatgatgatcatatcttgcacgttgctttcttacggtctggtgagaattgtaaagcaattagaagtccgactttagttctaaattagcatgcgagatttttaaaagggtttcttatacgacttcttatgtacttttaaaaatgaacgaacttaaaaacaaactcaaatacggacgacatattaaagcatcggaaacatgttcagtttttatttttatttatttttattttataaacatacgtatgacatactgtattcgatatgcatctaaatactcttgaattgaactggatatgcatctaaatactctttaattgcactggatctgccgttatcgacaaacacactacttctcccggatgccaatgaaacagctgccaccatttgcctagtcaataataatccgtgcaacggacaggatggtgactaatcaatgtaatcttgatgcatatatcatgtcatatcatatcgtctaaaaggcgatatgcctaaacgtcgtcctctgcatgtcaaaatcgtaacagggacgactacagaggacgaggtttaggccccgtcccatggaatttccttcgtcttctcctcaatgactaattggtttaaccgaaccagatatgtccagatcacaccggggccaatgcaacttgtcgcgtgctatatatgagcatcgtcccgcccgctagctagcttgtgctcagtttcccagcgcaaacaacaagtcgatcacaagaacttgcagctagcaggggcaaccgaattaaggaggagatgcagccagacaagccaacggccgggccagcgcccggcgtccccgtcggctccgctccctggtcgtctggcctctgcgactgcttcgacgactacggcctatgtacgtacgttctcgccgccgcggcgcgcgcctccggccacaccataccatggcaagcatgcataggccgggacgaaagatcccagcccctgaaaggccctgttagaaggtgaatcagaactaaatatgatatttagaactaaagatcatttatttctgttggagttataaaccgggaaaaaaaacattttcagtgttgggactattgtggttttcggtcgaccaagcagtaaagatcagttctcaagtagtgtatggattacagagaattaatcaattaatcctaaacaaacatgtattttgatctgcaggttgcatgacatggtggtgtccgtgcatcacgttcgggagggtggcggagatcgtggacagggggtcgacgtcgtgcggccacagcggcgcgctctacgtgtttctggccgtgatcaccgggttccagtggatgtacctgcacctaccgcggcaagatgcgcgcccagtacggcctctccggcgagccctgcggcgactgctgcatccactgctggtgcgagccatgcgcgctcatccaggagtacagggagctcgccgcgcgcggctacgaccccaagcttgggtggcacctcaacatggagcgccgcgccgccgccgccgccgcgcccgccgtgcaacacatgggacgctagctagcttcgaatcgtcgatcgatcacctctcgtattcggccggccttgtgaagaactatgtactgagcagtttttatgtgattagaacaattctacggtccttgagaaggtatcataaggtaccaaattttacattaaatttttggtacctcctagtatttagataccaagagatatcaaatctacgatagaaaaaaatgatacctcatgataccttctcaagaactataaaattactcatgtgattatatgcatgcatggtgcatattatgtgtgtacacgcatgcttatatgtggtagtagaaccgtaaaggagatcgcgcgagggtgtgtacagttgattgttttgatgtttttcttacaaaatatatattgccggccggcccatatatttccaataagaaggaatactccagaaattcgacagtgtgtgctgaaatgcgctgacacgccaaccctttaatcatgcgccgttgaacggtcattccatgccacagaccggaatttctactcttttgttaagttgcaggaaaaaaaattaaagctaggttactatacatgataatcaaaataaccgtacggtttttttaaactctgactgtctcacgacggaccggaccaccttttcgtattttctgtgcatctgtgaaactccgcctgttggcctgtggatcacagacacaagtggttaatttggcaggatgctagtctaatctagcaacacgattgtagtaaagtgtagtttttagcgttgtaacttgtaagcgccgagaatacgactttcatcagcaaaactggtttaacgagcttttatgtagtaaactcctttaaactctagtgaaattcggaccgccttctttcatgtattgtcccgacgaaaaaaagatgatgctagaaattctcatattgaaaacaagaattttacaagaaacgttaatttcctctcaaaattctcctgaaatattcattcattcaaaaggaggcatggaactgaagcaatataccttcaaatttttaataactttttaataaccttagaaaccgattttaagagcatagtagtatcaccgcgcataatatcttactacttctcagatgtatggtaacattgcataccaagagctagttggaagacataaaaataaactggatgacggttattagacaattctaactttccctctcaattcattcataaatctttgcattgcatcaaatagatgcagtatatatgtttgaatgtgtctattgtacgcacatgccgtcggtgatttgtaagtaatgtcttatctttcttgctgcctgacaacacacacagccgggtttcaagtcgggtttcagcggcacaactggtataatagttgtcagagaccttttacggtgtttgcgaggtacttgaaggtattgagaggtagaacaatgtgaaccattgattaaaagaggggcaagtatggaataaaattttcataactagtagcaatggagtaattaactactaaaaaatgagcattttgagtgaatcgaatacctggagcattttgagtgaatcgaatacctgggtgcaatcaccagaattgttaggtagaaaacaaagtaaatctttcgaacaatttaatgcatcgatcgatctgcagttctgcaccgggaaaaaaaaagatcaacgcctcatttctttgaccccggcttcgttcttgttctagggtttgaattggtccagagaaatatcggcacagttgagggttcaagatgggccgatcgacggctaggtgcaagcgcatcgggaaagatctcctctgctcctatacttatttgcacgattgattcgttatttacatagttaacaaattccttcatataagggactaaaatgagatattctcatatgttcttcttctagggtttgaataggtgaacctgtaagaagatagggtcaagagagaagctctgatattgttggttaacctaacatagcatgttcagatggacgcaatcattaggaatattttatctacaattttcttttttccacaaataaaatgtaaaacttaaaacgtaaaccttgagtgatattttaatgttcttgggaacaaaatataaatatcaaaataactatgcaaataacgtaatggagaattaatgggaagagttctaccatgtccttggaaacaaaaatgtaaatctagagaaaaccacgtaaatgagaactttaatgctagtaccatgcaacttaactggtaccgacgcggtaccgatctgaatttacggacaactctttcctttcctctctactagcaaatttatctttttacccttggtacctaagtgcctatgccaatactcaaataccttttacagggtacctttcattatggagcgttggatttctactttttttggaatacagaccctgtaaaaggtctctagttgtcaacggtagatatactatgcataacatccaatgagaacgcgtgataaacacaaagttaaccatacttctaatctcgttacacgagtaaacgcgcaactcaataaacaagtgcaatatatgatcaactgctgctactgtccatcaacctaagcccgatagacaaaatatcagatatcaatgtgctgcaatgttagggcgttcatagtgcgtcgacatgtcgttcgcccctcgaccttccacgtagtagattagactccacgttcgctcctatagtgaccaaacaaactatgcgtagccaaaatgagccaaaggttctttgatccgatcgagggcgtgcggcatgaggatagatgggcgcgacccgcattgtggagattacaactgtagcctcgccttaagtggcttccgtgatcgccataaatcgccagcgagctggggaggagatgaggactggagaaaggaagaacctggtggcggcagactggccgacggcgagccgttgcggaacctcatcgctacggccagatctgcagcccccgccaaggccactccaccgcaccacggagccgtcagcctgcattggagtcctctgccgtcgaggtccaccgccaaggcccacctcggggtcctccgctgtagagggccactccacggagccgtcagccattaacttgccttggagtcctctgctatcaaggcccaccgccacatccgtgttgtctcactccacgccgttgagggtcgccagattcatgccgtcacctctgccgccacctaccggagaagaaagagaggacggaaggcggagctcgacgagacggcattggcggccgccttgacccattcgtggcttccttgacgcgccgtcggagttgccttcggcctttttgctgtttcaatatactcgacggccgtccggatagaggtggcaccgggaagagagaggggagaaatggcgccactgaggagctcatcaccgacgatgtgagtggtaaagccggtgaagcgaggggaacatgaaagtgacgggtgggtggcggggaagaggttagggagtagatttttttttctctgatttttagggtgttctatgcaaattgctagactactctctaaattttaaaaagtatatgagtattaaagtaaaaaattacaagggagcacatgataaattaagtcatcctagagccacttttcactgtgagatagagatttctaacttgtgacctagtccaggctcctcatacctgtggcttgcactgtgagtacccttagggctttcacagtgtgcctagttgttgtttagccccagctttacacatcagagatttcatgccacatccgcctttcccatatttagtgaatactgctgagcccaattaaaacatgtgttcatcgttaggatttatcagggcggaccgaggcacagctcgagcagcacgttaggagatggcatggccccatacaaggcggatggggatggaagctagcatcatcagtgttttggggggagtgtcatcggcagaaggggtggggggagagcggcgctggcagagaggggcttcagtagaggaagttgccggtggagaggagggaatgtgattttataaatgttcatgatttttgaggtgttcattgtaaaatattgaagttttcccctaaatcaacaaaatataaagagtaaaatagaaaataaaagggacttacatgcgaaattatttgagctactttgcactgtatataaaagggatgtgatcaaagtctacgagacacggcttagccgacctcttctcgcaacaatcagctgacagagtacaagcgctgcagaaacatactccacacaactagaaaagtcaatgtgacaccgtgacagcggtgacgtacgggggcgcgggtacgcgacgcgagacggcgagagggaagagcgcggcaaactcgcacaagctggcccgcttcctctgctagttcactcccgcgcgaccactcatggcgcgcatgcacgcaccatccagagaaaacccctcccagcctcagcgactacggcgacgagctgagagcacaaagaagaaccactcactgatcaaaccaacagatctgtctcttcagcttatatatattattgcgtttgatcgaattttactgtaattcagatcttgaataacaactagaaaagcttcattagcagagtgatcgacaaggaaattaaatggcgtcgtcgttgttgtccatggcgatgttcgtcgtggtcctgatgtgcgcctcagcaatggccgcccaggcgcgcctcccgccggggtctagcccgctggtggcggcgtgcacggcggggccgttctccaagctgtgcgtcaaggacctgggccaccgcctgctggacatccagacggtgctgacgtcggtgtcgaaccacggcgccgccatcgccggcgcgccggggcaggtggacttcaggtccctggtcgccgtcgccatggaggccgccacggagtccggcgcggtggcggcgacggtgttcgaggggaagctccccgggttcaacaagtccgtgccggacttcaaggcctgcctcgacaactgcagcgtgacggtgtcgagcgccatgaaggagatccacggcgccgccgccgcgctcaaggccggcgacgacgaggtcgccaagacgctcgtgcttcgcgccatcaacgacgtcaccatgtgcacgtacagctgcagggagctcaacggcgacatggcggtcatcctggagcacagcctcgtccagttccagaagatgatgaggatcgccgtcaacttcatcagcaagatgaagaagtcaccgcttcctcctcctcctcgttctactcctcctgctcctcctactcctcatcggctgcactgaatatgcttgcttcttcacttcagttcgctggactggattatccagcgattatcccttaattaagagagccccctagttaaccctcttcagtacgtacgttctctggttgcgatcatagttagctagccttcgttttgatttttcagagttgagtaccctaatttcttccccagctgtatcccgtcttcgtttttttccctctctctttttgttggtttagctcacgtgaataaactgcaagtaaagtaaatattgttattacagatccaaatatactcactctggccaatgctttgaactaacatctgagtcaactgtcggtttattgacggaaatgtggatcggcggtgataacagtgggcctgaatgaggcccactaacggaaagtccagcccacgccgttcgcctccccgacgtcgcagaagcggccgggcgcgccagttcgagaagctcgtcaccgtcgccgccttgctctgaaactggcatgattcgatcgtggtcagatgctacactatcatttaatcacgagaaattttacaatccttcggagatacaccaaaaatttttaatgtaaatttgatatcttctactgttattgaaggtattaatcttctattattattattattgaagatatcgcgaggtattaaattttacataaaaaacacggtatctttcagtatcgtatcaagaactgtaaaatcactttttaattagttaattcttcggcgccttaagtagagtttttgttagatcgatcatggtaacgtactctgtaaatgctaatgaggaataaaattaaaacgtatagtagggcattgtacgtatcgaaaaggagcggtggcacacactatgttgtcggtatggatggttagtccgtcagtttcataattattgtctaacacatacattttcttgttactagatgcaatctcataataataacataatgaaatcgcggtacacgccgtgttccctcgtgttcatctccacatctagttgagaaaattccaacgtgcaggtactcacaatatggcttttaaacttcatttcgtggagtgatggtatcattatactctagattattattaaactagtactatagtggagagaaatgggtgcatcaagggacatcccctcaagatttctgatgatatgtgtcggagatatggacccgggggtatgtgaagtagaggggaattactttccctctggccacgtgactttgcaagttagccccattcgcgcgtcacgcgagtcgtggaagcggcgggggggcgggggggaggggggggggctcggggcatggcgtcaccccctcgggctatcccgcggattcgccccgaggccctcacccggctgccacgcagcggagggagagagcgagagcacaggctgaacagccataaaagtgcgacgccccaactgtccctcaccgcatttaatgcggtaagggcagacgtgcggcgcgcctagctaacctctgtccaacggatgtgaccggcctgacaccgtcacatccgatggatagggcaaccatgtcctcacgtcgcccttgtacccggcggagtgggggtgggtatgacccgtcatgtccgagcgtcactcgaggaagggctgtcacaggtcatcgttcatttatgagggaatgatagggctgtcccccgtgtcaggcggggggcagcgcctggttccactcgagaaccggttgttgcttagcttccgggagaaggcacggtttaaagcccaggaaaagtggagtgggatccccctccgatagagggtaggtagaggcggcgcatgtggtatccccttgagctataaaaggaggaccctgcccactgagatagaggaggacgcccagaaaacctgaactccagaagagaggaagcgagtgcgctttctagagtgaagaaatctttgtaaaactcatccataatcccaaatacaggagtagggtgttacgctccatagcggcccgaacctgtataatccgactgcgtgcaagcttgccggtaatcctagggacgagcgagtgatttccaagagatgagcctccgcccccggccgaactcacaaatggggggtctcacgattccccgctattgaggatctctcctcgacagctggcgcgccaagtaggggcggttgcgcattccgagaggaagtcgctttctttcgtcccaattttctccaggccttagccgaccatggtcgaggtcctgaaagtagaggaggaggcggtggcatttactcccaccctgtccgggagtggggattccggcgagagccgaggtcctcgtcaccgtcgccatggttctccaactcctccccgccgcgaaccttcgcggagggaggatcccactcgttcaggtgattcggctctctctccgccccctggcggagggaggccgcgacgcgccggggcacgctgccgtctcgactatggagacggcggtttgccccaaggcacgcttcaggtagcaggcgcccttctgcggcatcccccggtaaacccggagctggagactcctgttcagcgctggttggacgacgtggccaacttggtcactactacccagtggcagttagccacgagtggccgatccgctgccgctggtacgtcgcgtacctcggtcaccctctcctcgtcggcaaggagaagggctcgtcgatcggccacgatctcgaggcggtccacggttccaacatcgtcaggggcctcggaaagccggaggtgccatgacggcctctacgggacgcaggacgctcgaatcaacatcgagcgacgccgagacgagcgccgagctacccgtatgggggaaggcgcctcctcatctggagcgccacgctcctcttcacgaggcggccctccccccacactcacccctggggggacgggttgtagggcctttgtggcgagtctccggaatgtccggtggcccccgaagtttcgccccaaccttacggagaagtatgatggtagcatcaatccctccgagttcctccagatctacaccacggttatcgtggcggcagggagtgacgaccgggtcatggcgaattactttcccatggccctcaagggtcaggcgcgtggctggttgatgacccagccccccggctccattcactcctgggaggatctgtgccagcagttcattacgaacttccagggcacatatccccgcccgggggaagaggtggacctacatgctgtacggcggaaggatgatgagtccctccgttcgtacatacaacacttctgtcaggtccgcaacaccattccgtgcatcccagcccacgcggttgtgtatgcattccggaacagcgtgcggcataatcgcatgctggagaagatcgcctccaaggagctcaagaccactgccgagctcttcgagctggcggacaaggtggcccagaagaaggaggcatgggcctggaactctcccagcaccggtgcggcggctgcggctacccccgaatctgcctcccgctctaagcagtgagataggagaggcaaaaggaaaccagcccgctccgatgacgagggccatgtccttgcagcagacgggcccacgcgggccccgcgcaaagaaaatgccaccgtcgataggccgagccctaccattccctccggcgagggccggtcggcggacaagtggtgctcggtacacaacacttaccgccacagtctcgccgactgccgctcggtcaagaatttagccgagcggttccgaaaggctgatgaggaaaagcggcagggtcgacgggagggcaaagcccccgcgacctcaaccggtgaccagcgaggggaggccaaggacaaggcccccgccgatgatggcggagacggtgaggatctggatttccagatacctcaggggaccgtcgccacgctcgaccggggggggggggcttgcgctcacacctctcgccgaagcttcaaggctatgaagtgggagcttctggccattgttcccacgcatgaggtggtccggaaggtgcgctggtcggaggtgaagctcacattcgaccagagcgaccatccgacggtgctcgctcggggggggggggaaagttggccctggtggtctccccgaccatccacaacgtcaagatgaagcatgtgctggtggatgggggggccagtcgatgtggcggacctcaatctgccctacaatgcggttttgggtagacccgcgttggtgaagttcatggtcgccacccactacgcctacctctagatgaagatgccgggtcctgctggtcccatcaccgtccttggtgatgtcaaggtcgccctcgcctgcgcggagcagcgcgcagacaacctggcggtggccacggagccgcaggccccagaagcctctgcgtcccacgcttccaagaagcgcctcccctcggctgacgaggtgcccgtcaaggaaatcccccttggcgacgatccatctaagaccgccaagattggcagaaccttggacgccaaataagaaggcgcgctcgtctccttcctgctggcgaattctgacgttttcgcatggaagccgtcagatatgcccggggtcctcagggaggtgatcgagcaccgccttgccgtgcggccggatgcgcgacctgtccggcagaaagtgcggcgtcaagccccggagcggcaggccttcatcagggaggaagtggcgcggctcctggaggctgatttcattcgcgaggtgatccatccggagtggctggcaaacccggtggtcgtcccgaaggccaatggcaagctacggatgtgcatcgactacaccgacctcaacaaggcatgccccaaagatcccttccctctaccacacatagatcaaatagtcgactccactgcggggtgcgaccttttgtgttttctagatgcatactctggataccatcaaattcgtatggctaggaaagatgaggaaaaaaccgcctttattactcctgtgggcaccttttgttatacaactatgccttttggattgaagaatgcaggccctacttttcagcgcatgactcgtattaccttaagtaatcagatagggcacaatgtagaggcgtatgtcgatgatctggtggtaaagacgcaccaccaagacacgttgctacaggacctggccgaaactttcgatagtcttaggtccacgcgcgtaaagctgaaccccgataagtgtgtgttcggcgtgccggcgggcaaacttctcggttttctagtctcttcccgaggcatagaagcaaatcctgagaaaatatgcgcgatagagaggatgcgcccccctagcaagcttagggatgtgcagtgcgtcactggatgcatggccgccctgagtcgatttatatcgaggctgggtgagagggcgctgcccctattcaagctcctcaagcgctccgggccatttgtatggacggaggaagctgagcaagctctcaatcagctgaaagcttacctaacttccctcccgtcttggtggccccgggaccggaggaaccattgctactctacttggccgcgaccccccatgtggtgagtgccgccctagtagttgagcgtgaggaaggcgaacgggaggccccttcggcttgcgatggcccctcgtcccccgaaggcctagcgcccaaagcttccagcccccgggaggaccccgaggcccccaagggaggagcggaggctttggcaggtggccccgagccttatgatcccgaggcagtctgggatccccccgggacctccgaacaggcgcgctccgagtcatcagcccctgacaacacgaactggccccgtcgaaaggtgcagcggcccgtctactttgttagcgaggcacttcgagatgcgaaaacccggtatccgcaggcccagaaaatgctttatgacgtcttaatggcctcaaggaagttgcgtcattacttccaagcgcatcgggtttccgtagtgacgacataccctcttggccaaattttgcacaaccgagagggtactggacgagtggtaaaatgggccatcgagctggctgagttcaatctgcacttcgaaccgcggcacgcgatcaaaagtcaaatcctggctgacttcatcgcggaatgaaccccggtggacgaacctgtttcgtctaatgtcccctttcccctccctggagaagaagaggatccaaacgccgacattcgcgacgggcactgggttatgcattttgacggctccctcaaccttcaaggtgcaagtgccggagtcacgctgacctcgccaaacggggatgtcctcaaatacgtcgttcgtctcgacttccgagccacgaacaacatggcagaatatgaagggctcctcgcgggattgagggcggcagccggaatgggcatccaccgtctcctggtcttgggtgactcccagctgatcgtaaatcaagtatccaaagagtatcagtgcaacgacccgcaaatggaagcgtacgtccgcgaggtacggcgcatggaacgccacttcgacggacttaagctccagcacgtgccccgacgcgacaacacaattgctgacgagttgtcgcatgttgcgtcggcacgagccccactcccccagggaccttcgaggaaaggctcgcgcaaccatcggcacgaccgagccctttgagggaccccaatgacacgccctccgacccgactccgggcgacctgtgcccctcggggcccgagggggtcaaccctgacccccctcgtcaggtcgtgtggatgaccgacatccgggcatatctcgaaggcaatactcatcctgaggatcgcgcagaagctgaaaagctcgcgcgcatctccaaacggtacgtccttgtagaagggaccctataccggcgtaccgccaacgagatactcttgaagtgtatttctcgagagcagggcatcgagctcatagccgacgcccatcagggtgagttccgagcccattcgaccttacgaactttggtcggaaaagccttccggcaaggtttttattggccgactgcattacaagatgcccaagaatgggtccagcggtgcaaggcatgccggttccacgccaagtggacccaccagccggcccaagccttacagatcatcccactatcttggcctttcgcagtttgggggctggacatccttgggccattcaaggcggctcgaggcgggtatcagcacttgtacgtcgccatcgacaaattcaccaagtggcccgaggcctacccagttgtcaaaatcgacaagcattctgctcttaagttcatcaggggcatcacgtctcgattcggagtgcccaaccgtatcattacagacaacggcacccagttccccagtgagctgtttggcgattactgtgacgacatgggtatcaaattgtgctttgcctcacccgcccaccccaagagcaacagccaagtcgagcgagccaacgccgaaatccttaaaggactcaagaccaagacgtacaacgtcctgaagaagcacggggattcatggctcgaggagttgcccgccgtgttgtgggcaaatcggaccactccaagccgcgccacaggggaaacaccatttttcttggtgtacggcgccgaagcggtcctacccttcgagctttccctcgggtcgcctcgtgtcgcgttgtacaacgaggccaaccaagatgcccttcgccgcgaagatctcgattatcttgaagaacggagaaggcgagcggccttgcgtgccgcgcgctatcaacaaagcctgcgacgctaccatcagcgccacgtccgggcccgatcactacaagctagcgacctcgtcctacgccgcgttcagtcgcgcctggggctgaggaagctctcgccaatgtgggaagggccatacaaagtgatcgaagtgccctggctaggctccgttcggttaaccatggaggacggcacagagctgcccaacccctggaatatcgagcacctttgtcgtttctatccatgacatcgagattttttgctttcctggagcacgggccagcccccgcacaaccccttggttttcgtggagaccgttttctcccctttctctggcttgtcccggttcaagggataatccgcgtttactctaaaccctaagtgccgtaagacggcctgaaaaccgccgaaagggagcacgagcgcgggccgcgccccgggttgtgccgaaccccgggggatcggaagggcctacacacggtcgtccccgacccccggtcgtcgcagcctcggtctggccagtcctgctgggcggctccctcggggcgatggtcttgcctttcaccacttagattccatggaccgagcgcggatttatcttctcgctagaacaagcccgagagggggggtcaaaacgacatatcaatcgcaggcagtctaataatccccttttgtcctggttttttcttctctttatatcacaggcatccaatggaaaaagcaaaagagtaagaggggttaaagaagtttcagttgcagaacaagataggatggcacaatggcctaaatacaagaagtgcctgctacgggcacacagcaaaaaggaattaaaggcgcgagtggtcacggagtgcccggccccccgaggccagcgccactgacgatgtcgtcctagtcgtcatcgccgtcgtcacccccgcttccgttttcctcgtccgcggtaagcccggaggtgaaccggggggccgacccctcgaagcttgagacaatcgcgttagccgcctcccggacttgctcccgggcccttgcctcggtacccgggggaaaatcctcgagcgcatgccacggcatgaattcggggtcgcgcgcttggtggctcgcgaggaccagctccaccgcagcccgtgccaaagaaactgacgaagactttatggtctcgccgacctcctcctccagcctttccaggtccaccgccagcccgtccagccgaagcgcgagtgctggctgtgtgggcgggagtttgctgtcccgacgcacagagatgccgactcggcgccccgcgtgctccagccagtcgacggtgtcggagagttgcccgggcccgagctcgttggtgaggcggagggccgcaatttccccagcctgatcctgcaccaggcgttccaagtcggcgagggtactctgagccatggcgagctggctcgccaaacccgcgccgccgggcggcccgcctgctaccaagtccttctcccgggcctccagctcggagaccttcgctgatattgccgcacgctcagcgcgggcgctctccagatgacgagcctcgcgcccggcaacggcctcctctcgtttcgcgagttgctcgcctagccggcgcaaggctacctcgcggcgattcacctcggcttcgcgctcggcgagtgcggcatcccgttcccggcatgcctcttcccgcagccgtagctcttccgcgcggcggtccgcggaagctttcgcggcgagggtgatccggtcacgctcggccgcggcttcttcacggaggcgaagggaagcctccacctctgccgccgttctttcatgggcggccaaggtagactccagctgatctagcaggcgtgctcactcctccagctcccgggcccgccgtgcctgttcttcaccgcacgcgttttgctcgcgctggtttcgatcgaggacctcgatccgccgacggattgtggcttcaaactcctgtgcagagcgggcacgatcatccaaggccctgcgttcagcctcgagtgccatcgtccgcgcccgcagcgaggcgtcggcctccgatgcccgccgctcgtgggcagcggctgcgtcgaggatgccgcgcgcgtccctaatcctcttcgccaagtcctcggcgtgagcctcgtactgaaggcggatatcgccccgcgcttcatccaggacgctcgaggcgatcagcgccgcctgccgctcctcctccgcctcccgcatgacggagtccagtgcctcctcgcgcgcctggattttggctagttgggtttgatgcattttgcgcccccacccttaccatgtcgtccacggcgcgacgcccctcgtcgactcgcgcgcggtccgcggcgagctgttcccactctgcatccagggccgcccgctcttccgctagggcttgaacttgggtgttcaacccctctcgtacagtgtagtcggcggcggcgagcacctgcagaagtggctccatactcgccggagttggggaggaaaaggccgcggtccgcccccgggacgacggggtactgctggatcccccgcgagactgggggctgctctcggccccccttctgcgagaccagcctcgagggcgccccaagcgcaagggggaacggctgtccctctcaccccccgcttcgggtcctcgggtggattcagcctcggcctcgggctcgggctcgggaccgcccccggcctcagcctcggcctcagcctcgggaccgcccccagcctcaacctcaagctcgggaccacctccggcttcggctcccaggccgcgacctccctcatcccccgatccttggtggtgctccgcgtggaccctggtcccggagccgcccccgggaggagcgtcgccacccctgccacccacagtaggacgggtcccgcctgagggtcgctcgggatcgggcccagtgcgtgtcctctgggtcccgccacgaggctgcgaaaaccccggccttggtttggccgggctcggactgccccaaccgttcagatttcgtcccttgcggggggtctgaccctgagattccctgagaaggaatctcgctacaagagaacctagatcatgttaacaaaagaaaaagaaggaacaagaaaatgggttgggtaagagcaccaaagtgagcgccaataatcgtacctacggggagggcggttgaaggtccactttgggggctcgatgaaaccccccccccccccggcatggctccgtttgtgctatcttccggagccgcttctttttccgaccagcctcgggcccggcaggtcgcttgtggcccattggcgaacgatccgttgcacgctcggcacctcctccatgtgggggagagggcggccgggaataggccaccttccgtttcccctttgggtcaccggcggaatcatctccaggtccgcggctcgatccaggcgcccttgagccaccgccgcctggaccgccggcccggctcccgcccgcggtcgcaccaccgccacccgtgccgacggcgctaccgctggcgccgcatcgactggaccggctcctaccggcgccgatgtgtcacaccctaaaaattcaaaatatataaattgttgtttaattggaatttttagaatttattttaaaagcctagaagagacgatctaattttaattaataaattccaatataaaatggggccagataaaatttcattaaatactttgcttaattctataattcctagatttttctgggatttatttgagctaagaaagtatttttaataaatggaattgcatttcataaataatttaaattgaaaaaggttttaaaaagtcttcttttggctttgggccgaaagtcggcccaaaacccttctctctctcctcggcccagtccggcccagtccgccgccgcgcgcgcgcgtccgcccgctgacaggtggggcccacctgtcagggtcgtcgtcaacctccggccgccgccgcccgaaaccctagtttcgcgccgccgccgtttccttccaaaatccggccgctcctttccgtttccggtgaaattgattgaggggaaacaatctttgggatctcctctaccttttcccctttggaaacgtcggctaattcgttttggaagttcgtggaatcaagttcgattcggatcggtctctttccttcaaaccccgatctttccttcccgtcgccagccgccgtgggccttcgccgtcgcctcctagcccctttaaaaggttccccgagctctcctctacccgtcgccaccttcgccttcgcctctcgtcgtccgtagtgccctagcgccgtgtagcttcgagccgccgtcgtcgccgccgctccagccgtgcgccgccgtcgtttcagccgtcgccgttgctcgggaaggtcgccgtcgtgatcgtcaagtcgccgccgtcctcgtccgccgcttcgccgccgccgaagaccgccggagcaccgccgtcaccgtcgacccgatctccgccgccgtttcaacctcgtcgccgtcgccgtccgttgctcttccgccgcctttttggtcgccggtgagttcgccgcgtcgccctctacccgttggtgccctccgttcgtgccgtagtgcagccgttcgccggcgagcatgcgcgcccgagccgccgagccgccgtcgccggtggtgacatcatcgccgacgtcatcgtcgcccttccccgtgagccggtcgtggaccgttcaatctcggccatccgttttggatcaagtcgatctcggccgtccgttcgtgtgaaccgccgccgtgcgcccggtccaccgaaaccctagcccgctgacgcaataaatctctttttccttttcaaaaataattcattattgcgtcataattcaattaaaatcaatacaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttgggttattataacttgactagttgagctttatatattggttcagctagatattagatgtgattgcttatccatgcttagaaacattagcacactattgggataacttatgactcactattattttaatgatggcttaatgattgttcatgatggtcaatcgtgactggttaattaattacttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggagcaccagactgagaagtggcggagataagcccacgggggtcgctggggagtccatgccttgtttataagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacttctgatcagagtaaaactattcgaatagccgtgcccacggttatgggcgggtctaacaatgtctttcgtgattagtctcacacttctcaccatagtaaatgatgctataattggtaataatttgattagctcctggtttggaatggtatattcctggtttggagatagaactgtgcagccgggatggttgttcagaatggttgggcctatgcaacagggtatgttgtatagcgttgggttaatattgtttaatacttaactgttttattaaattctcaaatgtttgctgaatgctgcttttgcaaaaagatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttggatagaaattccgggcgtgacacgatggctgacatcacggccagaatgctctcccggtcacggtagcagcagaggggaagaatcccatctgggattagtgttggctcagcggagtctaggcccagcacccgccgaatcaccctcttcgcgtcctcctcaccctagtcccagcgctcgcccacatgcgtccgcatggggtcgttgggaccagtgtattcccacgctccacgggatcgttcctgaagaggtgcgatgcagcggcgaaagtaatcgccaaagaccatcgcccccgtgaggcccaggctccgcaggcccctaaggcgatcccacaccgcgtcgtattcctcgcccagctccgaagtcgccagccatgcggcagacctttcaggagggccagcgggaactcgaagtcgcggatggtccggcaacgcggtgtagaaccagtccttattccagtcctcccatttcttgcggagattgctctcgatgtactgacccgctgtgcctggccggggctggaagtagcatccccccaccaccgcgccttgcagaagctacggaatgaagaaggcctggaacaaccgcatcgtcggtcgcaccccaatgaacatctcacacaaatgcacgaagatggccagcgtcatcacggcattgggtgcgagatgcaaggcatgaatttcgtagaaatccagaacctcatggaagaatctggagaacggcggaatcaagcccgtcatggcgaaggacaagaggtgcatggatcgctccggatatcgtggccgtggccgcgactctcccgcccgcacgacggcaccgtccggcatgatcttgcggggaaggctaaggtgcctgtctgctgtgatgcgggaggaagggagcactgcgtcgccggtgtcttgggccatggcaaccggcggagagcgtggagcgtgagacagtatgaggtggcgagaatgttagggtttgagaagcgaaaggacgagtgggcggttggtgaaaggaagggggcagagtctctgcctccgcccccttttatcctcgcttcatccgcacttgcctcctcgtttcgcgctcccatacttgcccccacgatcctcgcgcccgcatttgtctcttcgcatcctgcgcccactcatcacgtcgcccgttgtatccgctcccgcctttagtgcgtctgtcagtggcacactcgaggtggagtgcacaacggctatgagcgcaagttgagcaaaccgtcaccactaccgccgcaggagtagcgagcgggagaatcgaggcgtggtctgactgaccccccgggttatcgcgcctcaagcatcttcatcatgagcgcggtcagtggcggtcaaaccgctattatggttggcacgccaacctggccacgcggcgatatccttttggattccctgccgggcccacaaccccagctcgaggagtcgtgaggcaccatgtcagaacgatctcaggaaatcgatacctgatatagcgtcgggggctactgtcggagatatggacccgggggtatgtgaagtagagggttactttccctccggcgacgtgactttgcaagttagccccattcgcgcgtcacgcgagtcgtggaagcggccggggggggctcggggcatggcgtcaccccctcgggctatcccgcgggttcgccccgaggccctcacccggctgccatgcggaggagggagtgtcacgcccggaaattcactagtaatttccaaacttatttgtgcataaaatcctcgtccaggaatcagccgaggtacacaaactgacaatttaatatacagattcatcaaattaactaaaacgataagtacttacttaagaggcacttagtcctcaccatgaagaaaactgcagcggaaaataaaatctaccgaagctccggctccactcccacaggcagctcaactggggtataagccaaacgtcttctccttctggattctttttcttcaactgaggttgattgattattgcaagaatgagcatatgacatactcagcaagccacaaagcaaatatgcaagtgcacaaggataccaaaggatggcataatataggctcatttgcaaaagcagcacttagcaaaacatttaagagatgtaaaacagtggagtaattaatcagaaattttaatcaacactgaacaacacacccatgctgcacaggcccaaccattctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactgaaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgatccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatattaagtcataagttatcccaatagtgtgctaatgtttctaagcatggctaagcaatcatatctaatatctagctgaaccaatatataaagctcaactagtcaagttataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcacaagctaacacgcaaaacgaggaaaaagactaataaaaaccaaataaacaatacataaaaagtaaacaaacatgtagatcataattttagatgaattatgagacttgaacggcctcattctgacttaatatgaatttaatatgaattttacaagattaaatctaattaaagcccatttaaaaagaattaaataaatttaattcaatttatggacaattttaatatgtagatctttattttatataatttttgcaacttgaaccacattaaactgagttacaatgaaatgaattagttatgaattttcaaagattaaatcggattaaaacacttatatggattttaattgaattatgacgcaataatgaattatttttgaaaaggaaaagaggattattgcgtcagcggctaaggtttgcggtgaaccgggtgcacggcagcggttcacgggaacggacggtcgagatagaacctatccaaaacggacggccgagatcgaacggtccacgaccggctcacggggaagggcgacgatgacgtcggcgatgacgtcaccaccggcgacggctcgggagcgcaagctcgccggcgaacgacggcgcgaggacgcaaacggagggcaccaacgggtagagcgcgacgcggcgaactcaccggtgaccaaagcaacagcggaggagcaacggatggcgccggcgacgaggaagaaacggcggcggttttcgggtcgacggtgacggcggtgctccggcggtctccggcggcgacgaagaggcagacgaggacggcggtgacttgacgatcacgacggcgaccttcccgagcgacgacgacggctgaaacgacggcggcgcacggctggagcggcggcgacgacggcggctcgaagctacacggcgctagggcactacggacgacgagaggcgaaggcaaaggtggcggcgggtagagaagagctcggggaaccttttaaaggggctaggaggcgacgacgaaggcccacggcggccggcgacgggaaggaaagatcggggtttgaaggaaagagaccgatccgattcgacctcgaatccacgagtttccaaaccgaattaggcgatgattccataagagaaaaggaagaggagatcgagaagatcatttcccctctattgatttcaccggatcgggaaaggatcgaccggatttggaaggagacgacggcggcgcggcgctagggttcgagcggcggccggcgcgaggaggaagacaggcctgacaggtgggccccacctgtcagcggcaccgagagagagaagagagcagcggctcgagctgggccgactgggccggggagagagagagagaggaggttttgggccggctttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacagattaaaattagatcttctcttctaggcttttaaaatcatttctaataattccttttaaacaacaatttataatttaaggattttaaacaagaaaagctcttaacaaatataattagatcattaaaatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaacttcacttgtaaattaaagatcatttaacataaattctattattaatttattaaataatttataaatcctgaaacaaaaatcaggatgtgataaatctaccccccttacaaagaatctcgtcccgagattcggaacggctagaaagaaaagggcataggtaaactgtagtctatcttattattccataactcagataattattctaaggctttaaagaaaactactgctgctttgaaactagtggctgagctgtaacacttgaagacgcaactcttgaagacgcaactggcactgcattggctcctgtgacgacaatgttgttgacctgaccttgcggctgctgacgcttcggcttcggacactctcttgcaaagtggcctggcttgtaacagttgaaacatacctgctgctcccttccactagtgttattctcctgagactggtcctgctgaactggcaccggctgattagcttgctcgatgttaacatcattgctttcattagtctctgatttgatctcaccagcgatgttcaattgttgcgactgtccttgaccagcggaagaagattcaccaatttggagtggcctgatatgctgcctctggctactaccttgtgcctcctggaatacagtcattctccgtttacggttatccatcctgttcttcttgtcttcaagtcgaattgctttgtcaaccagctgctgaaaatcaacatagtcatgggagatcaatgtaactgacagttcatccttcaggccttccaggaacttctcctgcctttcttcgtcagtacgcacatcttctggagcataacgtgccagacgattgaactcatgaagatactctgccacggtatgatccttttgcttcaatgtcctgaactcacgcttcttcaaagaaacaactcctacaggtatgtgtgtcttcttgaatgcttccgtgaactccacccaagtgattggttgtccttctgctctgttcatccgaaaatgatcccaccattatgatgcaggtccttgcaactgatgtgaagcgaaaacaactttctcctgatccgtgcactggagcagttccaacttcttctcaatagtgtgcaaccaatcacctgcttccactgggttagtagtgctagaaaaggtaggtggcctcacacgaagaaaatcagctaacttgttctgcggcggtggagcattgttgttcccttggttgagctggttctgcatctgctgtatcatcatgttcattaactgagtctgttgagccagaacttgagcaagaattgggttcccttcattgttattgtttccacttccactggcgcgagtgttcaccatctgttgcatattagagaagatagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaggacactttggcggcataggttctaaggtaggatccaaacttcattccatcttgaccacttggcacttcggtccttcctcgatccacttgactgacctccataagttgaccacataaatgtcttcaagtttcaatgtcttagaactactcaagttgaaagagagaggggagtagacaatgaaacaatttgcaaagaattctagataaggaagaaaggagaaattttcacaaatcatgttttcggaaaattagtccttaaggtttgaccatttggcttatcctacagtcgagatggctctgataccaacttgtcacgcccggaaattcactagtgaatttccgggcgtgacagggagagagcgagagcacaggctgaacagccataaaagtgcgacgccccaactgtccctcaccgcatttaatgcggtaagggcagacgtgcggcgcgcctagctaacctctgtccaacggatgtgaccggcctgacaccgtcacatccgatggatagggcaaccatgtcctcacgtcgcccttgtacccggcggagtgggggtgggtatgacccgtcacgtccaagcgtcactcgaggaagggctgtcacaggtcatcgttcatttatgagggaatgacagggctgtcccccgtgtcaggcgggggcggcgcctggttccactcgagaaccggttgttgcttagcttccgggagaaggcacggtttaaagcccaggaaaagtggagtgggatccccctccgatagagggtaggtagaggcggcgcatatggtatccccttgagctataaaaggaggaccctgcccactgagacagaggaggacgcctagaaaacctgaactccagaagagaggaagcgagtgcgctttctagagtgaagaaatctttgtaaaactcatccataatcccaaacacaggagtagggtgttacgctccatagcggcccgaacctgtataatccgactgcgtgcaagcttgccggtaatcctagggacgagcgagtgattttcaagagatgagcctccgcccccggccgaaatcacaaatggggggtctcacaattccccgctattgaggatctctcctcaacaatatgatttatagcacttatataaatgtattattgaacatgttgatggggtatcgcttttttcaagcacatcgtggatgcacctactctactgctactgaaattgatgcaggccatgaccaagtcaatataaccttcctatttcatccaaaagtaaaggactaaatttcaaaaactataatatattaaacgaattatcacaaaattatagatttatcatgttatacacttacaaatttaactatttttttataacaaaactatagatttataataaagtattacaaaactacatatttaaaattgaagttatcgctctcaaaataaatttggagttatcatagaactataaattctaaagcttaaattccctagaattaccattacgttggagttataaacgtggtaattttatgattaaattgacactaacaaacttatagttatgagattttgctacttgatatttatttatcttacaccttattttaaatctacagtttaataagaaattcaccttaaatctgtatagttacatgatatgccaccttaaagaaatagcttgatcgaagtatattaaattttataaaattaatttgagaaaatagttcagccgctatgatcacactcttccggtcgccgttttcctgggggccagttcccacgcgccacgtgcgttagcgtccacgtcacacgcttgcacagccacacttcgccaccgtttcttttttttcaaacgtgaccctctctctctctctcggtttatccactttcacacgagagttcggatgtgtttagttcacagcaaaattaaaagtttggttgaaattgaaatgatacgataaaaaaattaaaagtttatatgtgtagaaaagtgagtagaaagtttaaagaaaaaagttgaaactaaacaataccttcttcattgtcaacacgacagggggcaccacacgtacgataaatacgagctcacacctcgcacgcgaagtgtgcaaacacacgctgatcgatcagctcgccggtgaggagaggagagaagaaagcgaaggagctagagagcatggagggcgcggcggcggcggcggcggtcattaggcaccggacggtggaggcgaacggcatctcgatccacgtcgcggaggccggcggcgagggcggcgatggcgcggcggtgctgttcctgcacggattcccggagctctggtactcgtggcggcaccagatggagcacctcgccggccggggattccgctgcctcgcccccgacctccgcgggtacggcgacaccgacgcgccgcccgagatcgagtcctactccgccttccacgtcgtcggcgacctcgtcgcgctcctcgacgccctcggcctcgccaaggtacgtacgagcttagcagatgcaaaccacgctttgatttactgttaattgattaatcacatgcgcttaaattgtttgattccgctattaattaaaatatgcgaatatgtgatcattatctaaataaaataaaatacgtgatccctagaagcgtcgaacatggatagcgaatgaaaaggctgccatttttaaaattgcttttggttgatttggctttgtgatgtgagcgcaaagaagttgactgttttgttcgatagtgcttcgatacggttcaaagttcaaactgaaggcggcatcaacaatgggtagacggaatgaaaaaaaaatatgggcatatcccaacccaacgtgacgccgtggcttgcctgtcaatttgattggcatcatccaacgactccacgactaatctgtcaatgctatgtacttaagcagatcagtactgaaaatcttggaacttattaatcaaatcaagcagaactagagtactactaataattaaatgccaattcgtcactactagtgaatttttttttatttacaagattttctactagctgttgcaaataaaacttagaggctgatctgatctgatctggttttggattgaagcaggtgttcgtggtggggcacgactggggcgcgataatcgcgtggtacatgtgcctgttccggccggatcgcgtgacggcgctcgtcaacaccagcgtcgccttcatgcgccacgtcttcatccgctccggcgccgacgccatcaagaccaccgatcacttccacaaggcctacggccccacctactacatctgccgcttccaggttcaatacacagaacctcatcctctgccatttcctctacgtacttatcgtttcctccgtttcatattatatacttataagctattcgactgtttatttttttaattaaagttcgttagatttaatcaaatttatagaaaaaacggtaatatttataacaccaaattaattttattaaatttaatatagtttgataatatgtttgttttgtattaaaaatattgctatatttttttatattttaattaaattttaagaagtttgactaagaaaaaaattaaacgacttataataagtaacgaatgatatgcatatatatttcttctactttgaagctactacaacatgcagcatgggagaaaattaggtagaactcgtgagcagatagacgcaaacgaaccttttttatatatgctactagtagtagaataatactatcgtaaatattgttcaaagtcccaaacggatcagaaccagcggtccagccggagtagcgaaattttctcctgcacggactcgatagcctgaccggtacagtgcgtggtcgcagtacaagaaaaaaaaaatgcatactgctactactgttggtgtctccgatggaacagtagatgaaatactacgtgttggcttattccgttattcgtctacgactggtagtagcacgatcggtcactgcatggagcagcatccgtcgtcgtaggtgtcgtcgccgacgaagcgcgccggcatgcctccttgaacgtactggtggtacgggttctggcaggggtagttgccgccgtacaggtagctccccggcggcggcggcggaggcggcgcgggcaatgggtagtagggcggcgacggcgccaggtgcatcatcccgacaaaggggacgtcgtcgggcggcggcggcggcgtgccgtcgctgacgatggtgactgacttgccggtcttccgcctgagtcgctctctgagcttcgtcgcgtcgacctttcggccggcgatcaccacccgccgcccatacatgtccacccaaaccctctttacccctgcacccccacgcacgcacgcacgcacgcagcccaaaatgtcaaatcgatcgccatgacaaaaatgcactggcactgcacacatcatctagcttcttaccgaacattttctcgacggccttgcggatgtcgatcgcgcagccctcgcagtggttgttcaggatgatctccgccattgacgcaacagaaagctctatctgcttctgatcgattgatcaactgagcactacgtgcgtgccattttatagaggtgcagggagggagcaaatcaagccgaaatagggaattgagagattaagccctaattacttgccctgaggttacttggccattccgtttctcatcgaaagatatcgattctctaggtaatcttttactactacattcttgtacgtgatcacctctggtcggttcagccactgccatacatgagaccacttacctttcatcctctctgggccggcggcccatttatgaggcccaattgcacaggataatctggcccaataccggccgctaattgttgctgtttgcaggagcctggcgttgcggaggaggagttcgcgccggcgcacgcgaggcacatcataaggcggacactgtgcaaccgcttcaccgtccacaaggccggcaagccggagagcgaggagtcgccgccgccgccgccgctgccgctgccggcctggctaacggaggaggacatcgactacttcgccgccgcgttcgagaggacgggcttcaccggcggcatcaactactaccgcaacatggacaggaactgggagatggcggcgccatgggcggacgccaaggtgcaggtgccgaccaagttcatcgtcggggacggcgacctgacgtaccactacgccggcatccaggactacctgcacaagggcgggctcaaggccgaggtgccgctgctcgaggacgtcgtcgtcatccccggcgccggccacttcatccagcaggagagggctgaggaggtcagcgaccttatctacaacttcatcaccaagttcataccccaacccaactgaagcgctcaactcaactcaactgtcagatgcaattcatcgccgtaaaaaaaaaacaaaaaaaaaaactcttcaaacaagcgtgtgtgccaatcagtgtcaacgtatatgtgaccaaatgttgttgtaatttggaccgtattcctatgaaatttcaatgtttgggaagaaaatttcataagacttcagtcttttactcatcggtaggactttgtttatttgtttgacacctgtccagtccaaatctcaaagcatgattcctcctcttctccaattcctcattgtcttttcttcatgagttctcttcctccttctgcaggagaccaacatcttatccgaccatgggtctattgaaattataagcacataataatttaatttattccataaataaatcatgacattgcagatataaactagattgaatgcatcattagatctacacatgtaaactaagcagtaaaacatgaacagatcaaatatgcgcaacatgtcgaacatgtaccgaggtgacggaaagaccggttgctcgacaggaactactcgcggttgcgagcgtcgacaaaggcgcgaagcacgcgagcggagaggaaggcgagccgtcgcggactaacagggagcagtcgcgcgaagcgcttcccaaaaaccttattgccgccttctcccggtgtaggacgtcgaaggcagaggttccggagacctgctctcccgatcgccggtgcacgccggcgagcgggatggagtaatctacaagcgacggcgcagtacagagtaggaggcaaaccctagattgatttcgcatgtgttgcgtgaaggcggcggctcggtttatatagagatagatcgcctgatcagggcgcccgcgtaaaccgaaccggataagtcgcgcgtaacctatccggactccatgccgttttcacgcaccggatttttcggaatgtttccaaaacaaaacaaatccggataagtccgaaatgtttccaaaacaaaacaaatccggataagtcgcgcgtaacctatccggactccatgccgttttcacaaggaggctacatctgcacaagggtgaggagccaatttttcgaaccgtccggaatgtttccaaaacaaaacaaattcggataagtcgcgcgtaacctatccgcaagggtgaggagccaatttttcgaaccattcgacgcgtagtaacgtcgtgcacgcgcgccgcttgccctgccaggcgagcgagcgcgcgcgtgtttcccctcttctctctaccacacatgcttcaagtggctaggagggcatcctcgcttttaaggaggtccccctctcctagaataagcaaggtggtactaaactccacatgcatgccatctcatgaggtgggcttttatgattttccaaagaattaatctttgaatgtgccttagcccatctattaattccaacagggtccatggcaaggacctaactcctgaaggcatgcctacccattgtctgccagagaaaagccatcacgagatcatagaagcacatcaccaagaccatggtgaagtcttataggcatgcctagtccattgtcttttagctgttgaacttcttttcaattgacaacgtaagtgctggcgagaactaagtgataatccccactacctgcaaagttagtctaacaaagagtcggctggtcaacacgtgcaaaccacttagctgccgctagcaccgctggccgccacgacgagaggcgcggagggccacagcccacaaggacgcaaggaagggccgaagcgagggggcaccgccaaggatactggcgtgcggcggcggcaggagaacgcgtttactcgtcaagtcaagtctctggggaaatcagggatgaagacatgttgctttgagattcgtattatacagctgtcacgcaaagaagcaaagtcctactgataagtaaaagactgaattcctgtgtaattttcttcccaatgtttggatgatgcattgatttggtataattgaccatgctttgcgatgcaaatgctctatccgtcctgggccactttgcatttggaaactaaaggaactaggcccagtatcacatcggcccatccaggaaactggacccacatgtcagtcaactatctccaactacctcgggtaatcagcaggttcacagccagtagcagagcaccgcacgtcgtcgccgcgtcgcgcgacggagtggagaggagaccatggcggcggcggcggcggtaaggcaccggacggtggaggcgaacgggatctcgatgcacgtcgcggaggcggggccgggcagcggcactgctcccgcggtgctgttcgtgcacgggttcccggagctgtggtactcgtggcgccaccagatggggcacctggccgcgcgcggataccgctgcgtcgcgcccgacctccgcggctacggcggcaccaccgcgccgccggagcacacctcctacaccatcttccacctcgtcggggacctcgtcgccctcctcgacgccctcgagctcccccaggtaaaaaaaaagcacgcgccccctctcccctttccgcccccaaatcgctgagatgacgcgtcgcgcgttgttgcggtgaaggtgttcgtggtggggcatgactggggcgccatcgtgtcgtggaacctgtgcctgctgcggcctgaccgggtgcgcgcgcttgtcaacctcagcgtcgcgttcatgccgaggcgccccgccgagaagcccctcgactacttccgcggcgcgtatggcgatgattactatgtctgccgattccaggtgcgcaatttgttcccgtaggccacagaaatggccaatcgactgctatctgtttaataatcgaagaattaaagctaaatccccgtcccaaatgtctatcatccactaattatcaactaatttgagaatgattgtgcttattttgtttattagtgaatagttcacttcattgcaatggataagtgagttgtgtctatgaatacttattttcaaaaagaagtcttttagtatcttaccagtggtatggtgctcacatctgctcttcatcttaacacactagtcatatagatgaacacataacatagacatactcaggaaatttcatttttgtgcatgtgctaggctggggtgttaaattttcctgtcaattgatctttggggaatgtaatatagtcgtgccgcaagccctttttcctctttgtgagcagctccaattgtagtttgcgtacacattgaaatgaaatatcaatcatacatagtttgctaaatggattggcatgggctaatgagtaaatactaaataatgcttagaaaaacaacaacaattttgcacaactatgtggaataatttcatttctgaacaagttttgtcctcatgaagtcagtgcttcacaactgtttctgaaccatgttcggactctcagtcatgtaatttttataatttgccttcacaagtgtcatcttggctgccaggaacctggagttgaaaaagaattggccagtcttgacttgaagagattcttcaaattggccttgattgttcaaacaacaggatcttctgctatgtccattaaaaaaatgcgggcaaacaacagggaagtaacattgcctccttggctctctgaggaagatatcagttatgtagcaagtgtgtatgcaaaaactggcttcgctggtggtattaattactaccgatgttttgacctgtaagtatgccatttttaaggtaccaaatcattgtgtgcagaattcatacatgtcaaatcactcgaattatttttctccagatacctaaattctatccaaaagaagacacacatacaacctgtttaacgttgcaatacagtttttgaactccctgacaggttactagagagagaaacatgaagcacaatatcacattttttcctttagatttacctgttgtcactgattgctgtgtatcctgtttgtcttactgcatacgttgcttggaattaacttttttttttagataatggtgttgcttggaattaactgttgtccaattcaatacctctatactactatgagatatcatagcatctgttgtgtgtttttaaccaggagctcacaacctatatgaactgcagttaacagatctcggagagatgaaattcttgtttgcataacactttgtgagggtggatatgtatgggtgggtgactgggtgtgccgtgtgctgtgcgtctttttggtttctcagtcttgtagtttgtcgggaccttttccttttccttcttcttaatataatgatgattcgcaattctcctgcgtattcaagaaaaaaaacacttatggtaaatatagaaatctgttctgaactacacagattatttattcagtaatttccatattgaatattttgtcaccagtcatgatcacaagcatgcactcccatggacttgagaactgcatcaacatacgcagttgtgggttgcatgatatgatcatataatcctatgtagcaggaactcataacctctgacctgcatgcacaggaattgggagctgatggcaccatggacaggtgcaaaagttctagtgccaacaaaggttattgtcggggatggtgacctggcttaccatctcccaggagtcaaaagctacatacacaagggtaggttgaagaaagatgttcctatgcttgaggaagtagtggtaatcaaaggtgctgggcacttcatccagcaggagagagcacaggaaatcagtgatcacatctataactacatcaagaagttcaatacgggtgtttcttctccaaaatcatcgaggttgtgagataatttactgctgtaaagaataatttcaagagaataaaggatgtaatgctttaggctgatggtgtggttcttttgtcatgctgtgtttggctaatgctgcagagcttttgtaatgccaagtttggctatcttggcaaacaatgaaatttcaagggtctgaatgaatttaaaagagcttctaggatgcctataaactaattcctatgctccctccgttttatactaccacttttgattttctttttctttttttaagtcaatttttttaggtttaatcaaatttatataaaaatatagtaaaattttcaacaccaaacaaatgtactatcaacatatacattcaatgttaggtttgatgaaactaatttggtgttacaagagttgctacaaaactttgtcaaaattataaaagtttgacacaggaaggcaggtgtctgtcttgtgggccatgatatgccggtttttgtcttatgggccgtatattttgtcacttgaccatgcgctggagtccatttcttccccgtcaccaccacctccacctcctcgatcgacgcatccctccgccgctcgcagctctcctccggcggccatggcggcggcggcgcagaggctcctggcggccagcacgaagatcgtaggggtgggccgcaacttcgtcgcccacgccaaggagctcgggaaccccgtccccaaggtacagtactctccaatcccgaaccaccactggcggcggtgggttctccggtcgccttcttcccgcggggtgccctgatccggcgtcggtggtgcccgtgccgcgtctggttgcaggagccggtgctgttcctgaagcccacctcgtcgttcctccacgcgggcgtggccggcgccgccatcgaggtgccggagccggtcgagtcgctgcaccacgaggtcgagcttgccgttgtcatctcccagcgcgcgcgcgacgtccccgaagcatccgccatggacttcgtaggaggtaattgataatctaggatgtgctgtgataaaatggatctaatctaaactggtggcatcctttcagctgattagttgtgtgatgagttgtatacttctatatccctgatcatggaagaaaatcacaagtttggtaaataaatcaaaatatgatttccaccgaaaaatccgaataggagatgccgatatgctttgttctgtgaaaactacgtactagaaccttggaattgccattcagaactatttgagcaggccttagagacttagactgaaagtggacaactataggacatataaatttcactctttcagcaattccggtaaactttgtccatatacatttgacaggcttggtagaaaaattcagacatggaattttaagctcttagccatctgcttgttcaatgcctgttttgccatgaccaggctcatgaaagtctcattagtgaggagtattcgttaacatagtcacattttcttttatcgttggttgcttcatgttctctaaataatcatggtagtgaaattgatcttattgtttggttcaataccaaattatgctacagtaagtagcagattgttcactattactctttcttttatgctagtatttgttaatgtgggttctacgagtcaacaaaaagctatactggttttcagttttcccctttcagtgacaaagtacaattataactaatggtatatctttggatttcccaggttatgcacttgctttggacatgacagcaagagaacttcagtctgcggctaaggtgtgcactagctgccctagttttctttggtcttgtcaccttattgccatctatcatccttggtagtttcagaggatagataagagcataacattcaaattgataaaagaaattcagcaacaagctgcacactataatctcagtagctgcttctttattatgttcatgcaatcatatcaactaataattgtataagctactagaacaagaactatttgtttcttttgaatttggttaccactatcttgtttgatcatatacacacaatgttttttataactatttttgtgcaaaatcatggtaactaattggcagttgtatccttggtacttgtatgaatcaatcacatagtttcttaatgtaagataacttttcagtcttgtactatgttttatacttagaaaccaatgtactctgtagtctgcaggtcttccttggactttgggtaaagcacaggacaccttcactccaattagtgcagtggtaagcaatgtgttctcttgcttaaagaaactggttcaggtggtgactcgacacgttatttttcatttccatgtatttgcttgtaataaatagttccaagtaccatattcaaagtagtggataactgaagagacggaatatacaccagtaatctttatgattattaatggatagaaataaatcatagaatgctggaaaaggtgagtcaatatcatatgaaaagaaccacaggatactagttacagattggcatctccttttgttggtcgtggatcgtattctctgaatgctgccgatgtcattctactgaatatgaactacataattccattgctgcatccaatgcatttgactttccttgatgattcttgctctattgaacagattccaaaatcagatgtagctaatcctgatgatctagagctctggctaaaggtaactatacaaatatgtaggcatgtagtgaatctattcatttgccccctaagaagtagaaagtacaacaaattattaacaagcatagagaaatcttgtccaggttgatgatgaacttaggcagaagggatctacaagtgatatgatattcaagataccatctctaataagttatatcagttccatcatgacattaatggagggtgatgttatactgaccggtaaatcacatttttggagaacagtttgttgtgcattagagttgtgattgtgggggttattaatgaattcctctgcaggtactcctgagggtgtaggcccagtacgaccaggacagaagatcaaagctggtataaccggcctcattgatgttgagtttgatgttcagaagcgcaagcggtcattttctacttgatgtgataggcaagagattaatactatgcaatctgttgtgtggacatatcagtatattgttatgctcatcttgatttgcgcaataaaacaagatattaaggttgcatgcatttatttattggcgcaactaaaaaaaatattttggtccattaatttcatgaaaccggagtgtacttgcacaatattcttggcttgcccgtactgaaactaatgtacattgtaaacataggcttcccatatgacatagtgcatgaaaaagtagatattcttttagcatatgcctgtctaatatatgcttatggatcacttgtgatgcttttcatgtagagcttcgagagcatttgtatcaagaaaatcctggatctgttcttgggaaatccagaccgtactttacccccacattgttatcccggatctgtttatagcaaacagacctttcatgaactataccggtgctgtatttttgtccatgttgatggagctctaagctctctgcaataatagcaaatctcttgtcgccaagcacacttgatttgtctacctgtggcaaaatacgcagcggtagtaatacccatgtaaatattatgctgccgattccatctaacagctaaactgttaatgttgtgaatgtcttgttgaaattataagcacataatgatttaatttattacatttcagatgcaaactagattgaacgcatcattagatctacacatgtaaactaagtagtaaaacatgaacagatcaaatatgcgcaacatgtcgaacacgtatcgaggtggcggaaagaccggttgctcggcaggaactactcgtggttgcgggcgtcgatgaagacgtgcagcacgtgagcggagaggaaggcgagccgtcacggacgaacagggagcagtcgcgcgaagcgcttcccaaaaatcttattgccgccttctcccggtgcaagacgtcgaaggcagaggttccggagacctgctctcccgatcgccggtgcacgccggcgagcgggatgtagtagtctacgagcgacggcgcagtacagaggaggcaaaccctagattgatttcgtgtgtgttgcgtgaaggcagcgactcggtttatatagagataggtcgcttgatcagggcgcccgcatgatcttcactccgcgtaaccgaaccggataagtcgcgcgtaacttattcggactccacgccgttttcacacaccggatttttcgtaatgtttccaaaacaaaacaaatccgaatttcccgcagcaaaccggataagtcgcgcataacttattcggactccatgccgttttcacgcaacggatttttcagaatgtttccaaaacaaaacaaatccgaattttccgcagcggaatgtttccaaaacaaaacaaatccgaatttcccgcagcaaaccggataagtcgcgcaactccatgccgttttcacgcaccagattttttggaatgtttccaaaacaaaacaaatccgaatttcccgcagcaaaacaaccctgccctgcgagacagggcgagcgcgtgtatttcccccctcttctctccaccacacatgcttcaagtggctaggagggcatcctcccttttaaggaggttccctctcctataataagcaaagtggtattaaactcacatacataccatcttatgagatgggcttttgtgattttctaaagaattaatctttgaattggccttagcccatctattaattccaacatgtctgaatgtctcgtgaatttgattctatcgatcgatttcttcaccatgtgtggccatacatgcatgataaggacaagagagccatgggcggctgaattgaaggagacattttgcatccatgttggggccggaaaaaagaggtcaaaataggggtcggagctttaatctccgaacctggcggcgtcacgacttgagctactctccagctccggctgcagaaaatgaatgtttgcctcatgcaacgcatggtatgtacgcttcatcagaagaaaaatggtaacatttcagagaagggaccaaagttgtactgcatgatcaatcagtagcagacgctgaatggccagagcatgcatgaacatggttttggcaagatcgataataaacgcgtgttagaagattagtagttcaatggtggtgcatgataacttgattgagcttcattagcagagaaattcagagaaggaaccagagaaacaaaggcattcatgtggtggagagaaaaagaggtcaaaggggttcggaggatggaaactccgaaccccctttgaacctgatgatgtcacgaccccggccacgctgtccaaatttgggcctagccgcatcacgacgtttcagtgatgggcctcacccgtcacggaattgggtcccaggcctagcccatcagaaaaagcataaattcgatgggctaattaccattttgcaacaaactagtaaatcatactcgtcttacgcgtacaaataccgcattcccgccaaaaaaaaaaaaaaaaccatttggttcgcctgagtccgagtcggtctcgaactctcgatcgattgcattgtctgtactgcgatttgatcgcgcgtacgtgcgccacgtccacgataaataccctcgatcggctaccatctgctacctctagctctcctcgatcaattcagattctcccctgatcgaggtgaagctagggcaac

SEQ ID NO: 41032 - DNA, 17005 bp, Oryza sativa
caggtttagttagacatgtactatgtactacgtatcaatcaattagttaggtgtttgtttgatcaactgagatgcatgaagatatgcattgctcgattgatcatctcgatcgatcgatctgtaataactaatgagaagagttgaatcgattctttctgtaaagtctgatgtaatgcccttttgtgggctaatgaaattcatcttcatcgtagattcggacttcggagtgatacttttgtggactaatgaaattcatcttcatcgtggattcggatttcggagtgatactttttttttgtcgactattcatcagagtgattcgttctggcgtttgggcaatttggttcgatggtgctgtgccgatcactctaccattggtagcgatcatggtctcggcccatcacgaactcgagtcacgaatagtagctgagagcctgagatccagtaaccattggtgggccgggacttctcatcgtttcattttgttgccaaatcatttacttcaaatagttgatttgcttgacatcaaaatcatttacttcaaactacctccgtaacaaaatataataattttgactataaatctgaacaagtacatattcaaatctatagttaaaagttcatatatattctaggacagagccatggaggtagtacatagtttcaaatcatttgatacgatagaatgcagcaatgtatttacaacgattcagagaacaatccaacatgcattgcgcgatcagaaaagcgaacacggcagttaactaaaaatcaaggctccatcgcagacgaaaatggatttccgttcctgtactttttttttagaactcataaactttattccatatcagaaacagagtacatgattcatcatatattttcctgcactgaaatgatctattagacttctagcataacagcatctgctaggaccgttcctgtacttatgccatccatagcattctaccgatcaaaatgtaaaacttatagctgcataatgtaaaagacttggttgtcaattttcagggtgttccatgatgcaagctcatgtatttgaactggtgatagacggacgacccttgctgtactttgcagcgcttcaagcaaacttcatcatttttctgcaaattaaacaaggatttctatcagcaaacgacctgacatttcaactaaaaaaagtctgaaatattataattgttaaaattacaaaaaattagctaggttcttttgtgcctgttgacaaagagttgttctgtaatgggtatctgctatcaaatgtttttttccctttacacaatcaatgaggtttcttctgatcacaccttttgctaagtgccacttctcatatactctggatctattcagtagattcagattgcactctgcttatcaacagttttttttttaaaaaaaaatgttacaggtagacctcttttttttttgccttttacttactcagaattatgcttgcagctcatgttagtgactgcgaatatgatgcagggggtgggggctggtgaacttcgatggcaccttcaatcataagagcaacactcttcatcgctggtcgcatcacaggttcactctgtgtgcaccaaatgccgacgttcaccattctcaccagctcagcttcgtcgacaccatctgccaccttgccagcatcaccaaacatcacacactcatatgcccactcggaaatgttgtactcctccccagcccgcttcagatccatgcttttcttacagcttatgacctccagaagcatgatcccgtagctgtacacgtctgccttcacggtgattgctctgttcttgctccactccggtgctagatagccccgggttcctcggatgccggtgaatgtctttgtttggttcccaatcagtagctttgctagcccaaagtcagcaatcttagctatccccaaactgtcaatgagtatgttctctggcttgatatcgcagtggattattgggccctctatctctgaatgcaggtattgcaaccctctggcaacatctagtgcaattgcaaccctcttgctccaggcaggggaggcatctgagtgaaagaggaggtttgccagggatccatttggcatgtactcatacacaagcaggtgatgaatgccctcattgcagaaaccaagcaatcgcagcaggttccggtggtgtgttcttgcaatcacacgcacttccctgttaaattcacgctgcccatcctcagccatcttttcgagcctcttcacagcgatgtcctggttggtgtcggccacgacacctttgaatactgtcccgtatgcccccttgccaagctcttcgccgaaaccatttgttgccaaatctagttcctggaaagaataggatctgaggccaacaatgttcccatcaatcctggagtcctcttgccgtggtgccgtcatcgtcatgtgcgccaatgatcgccgatgcctgcagataagtaatagagatgccactaatagcacaaacagagaaaagatggccaaggaaacccctgatatcaatgcagaatttgcatggatactcatagccctttggcgagtaccggatatggtctggtaagtgtagatcttcacaaagagtgtggtgttaccaggcatcctgccatatctaatgggaagcatctgttttgagcagtaggaatcactaaacatggcgatatcgcaagcacaatcggagaggcaaagtagtttgcaggcttcaatactagttgtggctggtagaacagcatacgggttctctaaccaagtagtgttcttcacttcgaccatcgtggttgtcactctcgtctcatcgttagagctgttcctcacgcagccaccggttggcaatgctctccaacaaccaagtgtgctctggttagtgctcaagaattcaaaaccaggaaggcaagagcagcttgtctctccagtcacggtgagatggcagaagctattcggaccacaaacacctttcacaaggcagcgatcactgccaggctcaagccactcaacctctgttgtaggtgccctgccaagcttaaagaaaacatgtgagtagagtcgtaggatgccgtcgggatcaaatgtcagacgatagtaaatttccatatcaggggaggcattggaaggctggttggcatggaacagtatctttgtataggagtttttcctgtcgaacatccatatggtaccattaggatctaaggaaagcgtgaggaggaggcccatgttgaaagtccaggtagaccagtacgcactaccagagtcaatggtgcctgttgggtacatcacaagattgccatcttgttggttctcaagcctatacttgccactggcatgattactctgagagacacctgaaagaagaaatctgcctggacgcaagttctgacctgccaacaatgtgtctgtcggaaaactgaaagtagaccatatgacctgtctgttcatatcatacagtacaaagttgccggtgttcaacatggcagcagaggcagcaggtgtagaactgtcagatatggggttcagttggctacctggagttgatggagttcgtgaccattggagcgcaccaccatgcccaaatatgatagaaccaccaccaattgggggctcatcacggttggcagtccacacaattgtccttgacacaccaatcacaagccacaccccaatagaaaagccttcgccgttgggatagaagccgaacgcaaagcggcctaaagaagaggaccagtactgggtgctgcttgtgttgatagaggatcccaaagtaatgaatgactcattggctgaagctccagcggcaaaattggggtcttcaggaaccaagagcagcagggataggaagagaatatgtgggaacattgtccaggtggaagagtctactgcagttccttgagatgagatagtaattgtatgctgaagaaacctactggcaattctaagcagggaatggcttttgttagaccctgtgaagtgtaaactactgaatactactcccaccgtccttaaatatttgacaccgttaactcctttaaacatgtttgaccgttcgtcttattaaaaaacttttgtgaatattattaaaaaacttgagtagtagtagtatatttaacaatgaatcaaatgataggaaaagaattaataattacttaaattttttgaataagacgaacggtccaacatgtttaaaaaagtcaacggcgtcaaatatttagggacagagggagtagtattttgacagtcaaggaaactgacagaaagaaattgtggatggacttattagtcaagtctttagtggacttgggagacttggacctgagtttagtctaaaaaattgatcatcatacagaaagaacgggaatgcacaacaccaagtgatctacagtaaggaaaatggtgaaaacaacaacctgagcagagattaagggaagtgataaccaccttttcataaattggttccagttaaccgagattgaacaagttgatacagatacatcatacatgttgtacaactcaatgttttctgtataaagttagttatgatctagactcagcactgatgaggtaattttcagtcagtttgttagcttgattcaatgaatcacactatgagtctgcaggaatggggatcgttccaattaccagatcctggttagtttgcacatgagagtgagtatgaattggaaaacaaagcataggcgtaatggataaaactgaaattctataccttaatttacctccctttgccctctagattggccatactccagctccgcccgcgctcccgctgcacgtatccggactacatctacacatcataccactgaagaatcaaacagggtaagcaatctcaactaaacgaggagagaggaggtagggggtggggggaggagcgggattggtgagggcgaggaggggtcgagaagttcgccgatgctgggcatagagggagtacttgggcgggcggtggaagtccggcggtgggcggtggcgccgccggagccgcgggtgaggaagtccggcggtgggcggtgccggtagcgtggaaaatggaggcggcagcgcgtgccgctggaacgattacaaattcgtgtgagaatacgcttgtgtgatgtacaatattttcgccatttatgttaatttacagtattttatatatttatttgtagcgatttacaagccaaaaataagaagaaattactcagaaaatatcgaatcaagttaaaaattcaaattttaacttttgctttgacgctaactggtggggtacaagtttacaacacttttttcttacaaaattacagctgcactgcattttgtactaattaaccactaacttagttagcccatcactttccctaagagtaccttcaacagtctctctaaattagattctccaaacatctatatggccaattctccatctaatttggctagtcaaactagatgatcactccaacagactctctattaatcctctccaaaataacaacgaacccacatgtcagtctccactcctcttcttcccctctctctctcctccttcctttttttctttttctctttcgttccttctcatcgtcgatgcttgcagaggggcggcgccggcaaaggacgacggtggcggaggggcggccccggcggcggtcaacggcagcgtcggcaaagcagggggcggcgtcgtggaggggcggcgcggacgggcggcggtgtgaaggggcggcgcggaggggcaccgccggcggaggggcgacgcggagaggcggtgcggaggggcggtggggcggagccagtggagggcgtcgcctaagcggacgggcggcggcgcgaagtagcaaaggtgcggcgccaacgttcatcggacgagagggggggaagaggtgggacccacgatttggctaggctattttggctggccaaatttggccaacgagaggagtagtttggccagccggatggctattggagcacgattttgcttcaaaattgctaaaatttaaatatggaacctgttcgagatgctctaagagcaggtacaatagcaaactataagtcagctacaaacatattttaaaaatataaaagagaagagataagagcagcggactacatatttgtagccagctacaacacagactctaagattcatgtgtgtatgacaggtgagaccagacattattaattatatagtatatatttataggtaactattgtatacattggctattatataggcgatttggagccatagttggctatactattaaactttctctaaataaacctgtgaaccctaatttaacaactaattagctaataattaacaaccaaatatgatctaatcaccgacaggagggacacactaatgttgctatatacgtgctatcatgcagcagagaggcagtgcgactatggctccgccggctgcctcgacgtagcggccgtctcctccggcgactatggccggcggattggcacgccggattcctccacggtcgcctctcctccggcttggctcgacgacgatgtgccagtgtcacctctcgagtcgtacttctgcaccacgagcacggaggacgtcgtcgagaactccggcgtcgccaggtagctcccgacgtggccgagctccgggcagtccgtcttgtccaccagcggcgtcgccaccgccgccgaccgcccggccaccaccaggttcttgcctctacccagtgtcttgatggcgaacgccacttcttgccggccatgggccgacacctcgtcgtacttgaacgctccgtcgtttccggccttgcgcacgttggagatgtgcttttgtatggcgtcgtcgtcttcggcggcgtcgtcggcggcggccgtgaaacgggccacggtgagcgcgatgccagggtgctcgcccatgcgtgaggcgtacgcgagcgcctcgcggtcgtcggcgccgccgaagaagaggaggaggaccgagtaggagacgtccggcgccgagacctgcgccgcgccaccgagcgcgcggtcgacgaggacggcgacggagcatggcgcgtcgcggagcacccggacgttcacctggtggaacgcccggtccacgggctcgagcgtgccgtcatggcagagcatcttgtggaacgggagcaggatgatggcggatcgcttgtccagcgccgacgcgacgatgtcgtcgtggatggtgtcgaggtcggagatggccgtcatcggcttcaccgtcacggcggtgagccgctggaacgcctcgaacgccaccaccacctccccgccgccgccgccgccttcgtggccgcgccggctcgcgaacgggagcccgttgcggcgcgcgcgctgcaccatggagatggccgacgagcgctccgacagctcgacgaggtgcatggcgtacatggtgagcttgctcctcctcgtgccgcgcgacgcctccacgaggttgatcagcgtcgggatgccgcggctggcgtggaagcacgcgagcacgcgcagctcgctgtcggcgtcggcgcgctccaccgtgcggtgcttgtacgacgcctgccgccgcgccggcttgtacacggcggtgacggccggcgtggtcatgaaggtggtgacgagcgccatgagcacgaggatggcgaaggcctcctcgttgagcaccttccggtcgcgtccgatgttgagcacgatgagctccacgagccccttggtgttcatcagcatccccagcgcgagcgcctcacgcagcggcacacgcatcagcagcgacgccgccaccgtgccgccgatcttgccggcgcaggccgtcgtcatgacgagcacgaggagcccccacgacttggcgccggagatggtggtgacgtccgtcttcagaccgctcgacacgaagtagaggggaaggaacagcgacgacaccaggtcctcgaccttctccgtcagcgcgccggcgcaggcgccttccttggggacgagcacgccgatgacgaacgcgccgaacagcgcgtggatgccgatggcgtccgtggcgaagccggcggcgagaacgatgactagaatggcgcagacgaacgattctttcaccggctcgccctccggcgaccgccgtgccatgaagacgagcacgggccgcacggcgaccgtggcgaagccgacgaacgcgacgccgcagagcaggacgtagatggacacgagcggcgacccggatcccgagagcgcgatggcgagggcaagcagcacccacgcggtgatgtcgttgacagccgcggccgacatggccatgcgtccgatgtcggtggtgaggagcttgagctcggcgaggatgcgcgcgaggacggggaacgcggtgatcgacagcgcgacgcccatgaacacgatgagcgggccacggggggcgtcgggggcgatggcggcgcggagcacgagcgaggcgccgacgccgagagcaaacgggagcgagatcccggcggcggcgacggcgagggcggtgcggccggtgcggcggagcgaggccgggtcgagctcgaggccgacgaggaagaggaagaagagcaagccgacgttggcgagcgtgtcgagcacggtgaggctgtccttggggaagacattgtcgaggaatcgcttgttccgcccaagcgccgacgggcccaggaggatgccgccctgtatcacgccgccattgcagtcagttcatcatcacacaaagatgcttcctccctccgtctcataataagtttatttttacctactcttactacttgtcctaaaataaaataaatctatttttaagtaatcattgtaccagaatttgtaaaaagtaaaaaataattatactgagagcagataaaattggaactagttgcattgagaattgataagttttgaattggcacgtgttgtgggttggatgaaaaatgaacttattttggacggatgcaacatacccattttgctcaaacgggtaataaagaaataaataaatgaagaattaaatacaaaactgtaagggaaagaacccaaagagtatagtatgattgatgctatgggcctgaaattgatacagcacatatactacttatattttatatttaatattcttcaggaatcaactgatgatctgtagtaattggttgtttggcagcgtattgctgctgtgctttggtggtcaatggtgatgcaactgttggcctaatattaatccagatgtttcttcagaatctaagaaaattatgttttttaaagtgtaaaggaaccatacttctccagttttttttagagctctactttcttcttcttggaaactgtatctgtttgctaaaatatatgttagtccagagaaagctacacaagaaaaatactccctccgtatttgtaaatgaagtcgtttaggacaatgtttaagtcaaaccttgggaatataattcataaataactctcaagttgttaagtttgaacatgtaaaaattatatgaatagatttgtcttgaaaaatactttcataaaagtatacatatatcatttttcaataaatattttttatataaacaaaaagtcaaagttgtattttggagaccatgtcgttgtccaaagcgatctcctttacgagtatggagggaatatttgcatagaaaatagctgcatcagtaattgccacagaataatccaaacagtcagctggctcgaaatggttcatactagtcctactagtttaactgtactagctagccggtagcttatcagagtcagagccatcctcacgaagtcaactcctgtattttctatagaagggcaatgcttgatttatattttcaaaatcgaagaaagaaaactctggttagtatgtgttgttcctacgattgcacgtggtacgtatcgtggactggtacgagttacacacgtgtgatgaggaagaactcgatcagaaacagttttcttacgtttttatctgtaaggttcagcttcttgcattgtgttcttcattgtatgcatggtgcatttgtcaatggcagcagaagctactgatcttgtcaagaacatcatcttagtgcttactaagtacaggttgctctaaaagtaggaaagataaaactagcaggtgacccaaaaatagccagcaatcttctgcaactaccacctctggttcccttacctacaaagccggattaattttcctgaggtccaaagcttaacttttttttttggttgtgctagtataaaagcacgcattttttttttaaaaaaatatcggttggtctttggtatggtgatcttgtgattattggtactagaattatcctcaagtaactgcggtttatatcactctaggtaagaatgagtgaccatatggctctgtttgctatccccttttcccaaacattcttcctcgttttccgtgcgtatacttttcaaacggctaaacggtgcgtttttttaaaaaaagtttctgtacgaaagttgctttaaaaaattaaattaatctatttttttaaaaaaaatagctaatacttaattaatcacgtgctaatggaccgctccgtttttcgtaattactgtttgggatgggaagaaggatgtgcgaatggaggaaactttgccaggatgaggtggtgtcgttgatcaacagcgtgtcaggattcaagaacaaaatgataaaccatacagttcatgcaacgacaaagtactccgtactacgtcgtttactttttaatcaacgtttgatcactcgtcttatttaaaaattttatgtaaatataaaaatacttatgtcatatttaaagaacatttgatgataaatcaagtcacaataaaataaattataattatataaattttttgaataagatgaaaggtcaaacgttcgtcaaaaagtcaacggcgtcatacattaaaattaaaatgtggagggagtaattaaggttgtatatagtatggttgcataataccaggacaagaaaggattgcgaaatttaactgatgaaggcatgatgagaacaacttacgatgatctcggcgatgacgcgaggctggcggagagggcggagggcgtaggcgaggccgcgggtgaagacgacgacgaggcagatctgcacgatcagcagcggcagcgagaaccgcagcgggttgtccccctgccacgccccctccgacgtcgccttcatccccttcgccgccgccgccgccgcctcgccctcgcaaccaaccaatctatctctccgaccaccaccaattcacaagatcgactcagggcaagaacgcatgcatggcgaattggcgatggatggatcaagaacaagcacagccaagctagattcctgccatatatatgtataactagctagctgcaaatatgcgaggggattatgcaaactgatgctaactagtagtgcttacacgtgtgaccactagtgattattaattaagctcagcctcttaagctgatcgatcggtgtcgaattggacaaatataggcagcaggccactgcaggtgttagaggtttggagtgggtgaagctttgtgatccattcatggccacttcaccaccttatttatagccaagtaattaagcggttgcagtgggcttttgagagctgggtttttgtgaaatattggatcactcattcacttccatgcttatgcattggacgaattttgagagcatttgttgatgagatgagatcgatttggggaactcaattcgatcgagtattcaccgcctgcgtttttctgtgacttcttttcgtgatcacgcaaagcttgcgcgcctcaaatatattagacgaaagcaaagttctttttgttttttgtttttgttttttttgactgcgtatggaccatgcatgtgtcatgtgatcgagttgcacggcggagactcgattagagaagcaattagttagtagtaactagaaaattcaactgtaatgtgatcgtccgttaaggcatatgatgtttctcagaccatcatatcgtagtttcagttgcttctgtcgtaatttatcgtcagcagatacgtacgcacaaatcaaatgttatcatcagcaaccgtttttggcataacagggttgattaattcagatttttttaaaaaagtatgcaggccaaatttgtggacgccacaaaaataatttagaactgatggtgtggctgacaaattaaatcggtcactgatgacctcttaggctcttataatttagtcccaaacttggctaactgattttcaatcttgcaaatccactaaacatgcaaatcgtgcaaattctgaaggagatgcaggtcaatagtgctagcttggatgcgaagtaccctgagaagcttgtacacttgtttgaaaattaccgcgaaatcgagatgagaatcatgagatgcaacacaatcctagcaaacaaagcaaccgggaaatgtcagcgctaactttttatctaatcacatgcatgcattattactatctaaatttgaaattctagaggttgttgaaactagtcgaattaaatgaaaacagcataagtataaaactgcagggttgttgaaactgaaactaactgaatgcacctgcaagtcctttcctagagacaatgtaaagaaatttggaaggccaacgttcttccagatcattgtggcttgaattgctgcaaaaaaaaaatgcagcgagagagcgtgagttcaggtttcatgacattaaacccatcaggtgttcatgacggcccattaggggtgaagtaatgcgcttggcgccggcccattgttgcagcgctcaatgtgtagtgctcttttttttaaaaaaaaagaaaaagaaagaaaaacagatggagaaggatgcatatggcaaacaaaaatgttttccctgttgtaactcaaacatttccacgggacttttgtcagcgacactccactgttaacctccaaaatagtaagaaagtgtactgattaatattgtgttaggttcaaatgacgatttccattggcaaatactccctccgttttaggttataagacattttgattttggtcaaagtcaaattgttttaagtttgactacgtttatagacaaatatagtaatatttataatattaaattagtttcaccaaatatataattgaatatatattttcataataaatttgtcttgggttaaaaatattactatttttttctacatatatagttaaacttaaagcaatttaactttgactaaagtcaaaacgtcttataacctgaaacagagggagtagtattggaagatgggattgttttgaagtatagtatttttttttcacagaaagcattctatatagtctacaagaaaactacggtacaaaacattaggacaatcatcttgaacaaatcctgaaaatttgtcctagttacagttgcaacatgtgccaacgaacagctatacccatgaagatggatgcatggaacaaatcacaaaagaatgaaattctgtacaataaatgaagagatcgatctggacaaagagacgaaacaagccaagaccatccggaggagcagttcaagggtgtcgccgccgccgcagctaagcgagttgcctagacgcgtcctccggtgagagcttgcccggcggcaaagcacatccgcgtcctggccattgagggcagccagctgctccgagtgctcgccgatgatgctcgcggcgcggctgtcctcggcgagtatgatctcgtacccgtccctgaggctgtccatgccagcgacgatgtcaccgtcgagcagcagctgccagaacgcgccgccgacgagcgggccaccgcgcgatgccgaggcgtagatggcgtcgagcaccaagtcgaggaagtagttcctctgcgccttgttggcgccgacctccttccagaggaacttgccgtactcggtgacgagaagcggcatgccgaggtacgccgccgtggcgtcaatgtgggagcgcgtccagttccggaagaaagtggcctgctcgtcggcgctggagccccatagccagacgtccgggtagaggtggatggtggcgaagtcgacggcggcggtgcggtgcgtggcgacgtagttggtgccgtagtagatgccccacgggttgagctccttgctctcgtgctcgccggcgccgtaaaacccctccagcccgggtgtcaccaggtgccggccgtcgacgctcttcacgtacggcgccatctcctccacccacgcctgcaccatggcgccggttgggtcggcgtagcatcgcggctcgttcatgagctcccaggcgaagatggtggggtcgtccttgtacgccacgcccgtcagggtgttcaccctcgtcagcaccgtctgcatcgatcgacgccgatgcaacggcagcatgaatgaatgagtgagattgaaatgtaacacatcgattatcgatgcatatgctttgcatatatactgaccttgacgtggttcttgaagtaggacttgacgatggtgctggtgaagaagtcgtcgtcggaggtgaggttgtggccggcgtcccccgcccaccgcacgtactgccgcttgcctccaaaattgtcaaagttgttggtcaggcagaggagaaggtatataccgtgccgccttgcttcggcgatcacaaagtccagcccctgcccagaaaaacgttacagagaagacaaccagtgagtttttgcgttggtttggacgacgacgatggtaagcaagcgaggatgacctggaacatggtctcgttgtagacgcccggcgacgactgcagcggctggtcgccgccgtcgctgaaggcccacgttcttgccaggttgagcccgtgcgccgatgcctgctggaacgccgtcgccactgcgccgcgcagcgccgggtcggccgccatcatcatcagccagtacgcgttgaacccgctgaagaagatcgtcctgccgcagtccaccacgaactgcgtgccgtccacggccaccatgccatcgccaggcgccacggcagcgcgccagggtggaggtctttgaactaaagcgcaagaactcatgcatttatcattatcaagatgattgacatcagaagatttgtacagcctcactataggtcaaaacttactatgctcaagccacaccttatctgcttttcaccagcatttcatgaaaaattttatattgttcactgatttagcccccacatgttatttttttttctcttttaaacatcacttgcaaacaaaggaaacataatctgatctagatgaaaatttttactgaggatgaataaaaacaaaaacagcttcccttgcccactccaggaaaaaaaggataaatacaatcagtatggcataacaactcgtaaccatactaatggctgagaaactattacagctagatgcttcatattcaatgccagtcagtcaataacggtgaagtttttttttttgtgtgtaaagcgtcaaatgatagggaaacaaaagtatagaatcaaaaatcaacctacgccaaattaaaccatagacctagagataaagccattcacatgtctcagaaaatgcaccatttgtgctaaacaagtccagatttcagggcaggacaaacatagggagcaaattgtttaacagaagattaacaaatcacagataagtgtaaacaagagcaacgtgcaccatttatattgtaataacagcacagatcatgctttgatgaagagatctcatgaaaatatcccaaccaatccatagcaggttccacatgaaaattttaaaccaggggtgttagacaaaagttatagaatggtaatacaataaatttagcattagattgaaacttaagcaatcaacgacctaaataatagaaagatggcacacatccagattctctctcttttgcaaccacaatcacctcaacttcaaattcctaccgaaatcaaacagtaaccagcaaaataaaaatcccattcctcacgaaacctccctaaatcataatacgcctaaatctaagaaaacgaaaattcctcactgaattcaactctaagcccctgataatcaaccaaaattctacttccacagaatctaagcttaacccatcccaggtaggctatccaggaaccaaacctaatccacccaaattgcaggtcggctattcaggaatccaaccgtaatctagccaattgagaattcgtgctgttcggctatccaaaatacaccacaacaccccgtacgtctagccatgagcccgtgacgaattttttagaaccaaaaaaaaaaaaacagaaacagagcaaaccatggccccatctagatcccaaaaaaaaagggacagagaaaggagaggcgaatgaacgctcattcgataaagcgatacctagggttgaggtccgtggatggctcagcagcgtcggactcggaccggagcaagcgacaccccccgtgtcgccctcgaaatccgcccctagtatcctccctgggcagccccgagcatcgccggagaggccccgcggctgcgagtttattcggaggcttccccgcggcggcggcggcgcaagtcaagttcagttgggtggagacgggcgagcgctgggcaccagtgaaagaggaggggatcgaaggatgcggcgaggtagagaggtggtcgtcgcgtgtgtcggtggcgcgcgttggattttcttgcagcattcgattgattggattggattcgaatgatcccaaaaagcggttcgaatcacaaaggcgggggattcgcctcgacgaggtgtggcaaactggcaacggcacgtgtcggagccgggttggacaggattggcccttgcctacaatgccttcatctcaaccgtccatcagccatccgagaggctgcaagccggcaaactgcagcttggttgccgctgtcatcttcatcaatgggaaagacagggaaactttaacagacaattgcttatttaaacctcgttgtctctatttttttaagtttactcacttgaccatattttttaaaattgaagttgtcgtttgaccttatttgcaaacactgttaacatttcatttaaaaaaactatttatacgccaaattgacaaaat

SEQ ID NO: 41033 - DNA, 2177 bp, Oryza sativa
gcgacagtggcgcatggctctcagctctatgtgtgttttgctttatctatattttattaattatatgcaatttgggatgggaaaaagataattatatcatattttgttaatttgatttgtcaaatatatcaatttgaagccaaatcgattaaacttgtctcaaatctcggagctatgctaaatttattacaactagcatggtggcccgcgcagattgcgtggctagcatcattatattttctcatataatagcatatatgttttctcattatattattcaaatatattaaaatgataacataattttaaattttgcaataactttacaaaactactaatgtgtaatattcatattgtattttatatacgtgttagttattaattattttttatatcaaattttagttatttgtaaattatatatatttctatatggactctagactcgtcttttaatatttctttttttaattccaaattttctgtaaattgtatttctatatagactctatgctcttctttcaatattatttatttttatttctgaatttttattatttctaattgtatttctatgtggactctaaactcatctttcaatattctttaatttttaattttcgaattttagttacttctaaattgtattcctatattgactttaaactcttcttcccatgtttttcttaatttctaattttagttatttgtaaattttatttttatacggactctaaactttacttttaattttgttatgtttattccaaattttagttagttttcaattcctatatggactctatactctactcataatattcctatttttaattctgaatttctattatttcctaattgtatttctatgtggactctatactctacttctaatatttcttatttttaattccgaattcagtaattttctaattgtatttctatatggactctacactctacttctaatattccttatttttaattttgaatttcagttatttcctaattgtacttctatatgaactctatacgctacttctaatattccttattttttaattctgaatttcagttatttcctaattgtatttctatatggactctagtctactattctaatattccttattttttaatttcgaatttcaactatttttaaattgtatttctatatggactctatatggactctagtatcctcttctaatattcttattttttaattccgaatttcagttatttctaaattgtatttctatatggactctgccttttatttttctccgattaatgtgagaatttctagaccatgagagcgaatatggaggctcctttttctattcctttaataatataatagattatgtcaaagattcgaataaaaaaagcttttatatattatggtcaaatgaacaagagaaaaaaatatgacaatttggttcttagcaccgttatcttgttttcacataacaggtttagtcttgatctttcattttgagaaatgggtcaaataagcaaatttgaaaaagtgaggacaaattagaagttatgcttccgaacagcgtcaaataagcaaattgccccaaactctaaacttgcaccatggaccgataaacatggatagattaaatcttattgaatcttttttcgactgcgttctgaactacaagttcccatcttcagattccttacactttttgcgaaatttttctatacaaaagtttctttaaaagttcatattaatatattttaaaatttaattaattaatgactcactttgcgcgtggggagaagattctaaccctttcatccggatgcacccctctaacaccaaccgtcaacggtccaacacgttaatgggcggaagctttggcccatacatactaggcccgacatgacctgttaatgggtcaccggcccaccgccactgcccaagcaaaatgcaggccgaccgcgtccaccgctcgcgctcggctcggcatgggcgcctcatcgtctccgccaaccgccgcgtcgtggcttcgccgggatccatctgggtcgccgccgacttggtgaggcggcgttgcaatctgagtgatttgggattccttgatccgttgctcctgcattgaataatttgggtataaatgtatggcctttggatcagtttgctacttgcttcccttcccacg

SEQ ID NO: 41034 - DNA, 3301 bp, Oryza sativa
tctctactgtattccactatcaacactataatttaacaattacaaacagtaaagaaaattctactgtcaataattaagaatggtagtataaacaaatatggtactccatcgtagtaaccgttgcaaaacaccttatacaggaaactatggtacaaaacatacatcgtcagaacagccatcctgaagcgttcctgatgatttcgacaggttacagttgcaagatgtgccaacgaacaactatacctaaggagaaggatgcaagctatatacaaactagaaaagaacaaaattgtcttgaataaatgaagagatcgatctagacaaagagatgaagcgaatcaagagcgttcgggggagtcggagtgcgtcgctgtcgccgccgctgccaagacgcgtcttccggtgcgagctcgccggccgccggcggcggcggcgaagcgcctccgcgtcctggccgttgaggctggccagctgctcggagtgctcgccgatgatgctcgcggcgcggctgtcctcggcgagtatgatctcgtacccgtccctgaggtcgtccatgccggcgacgacgtcgtcgtcgaggagcagctgccagaacgcgccgccgacgagcgggccgccgcgcgacgccgaggcgtagatggcgtcgagcaccacgtcgaggaagtagttcctctgcgtcttgttggcgccgccgcccttccagaggaacttgccgtactcggtgacgagcagcggcttgccgaggaacgccgccgtgtcgtggacgtgggagcgcgtccagttgcggaagaaggcggcctgctcgtcggcggtggagccccatagccagacgtccgggtagaggtggatggtggcgaagtcgacgccgacggcgcggtgcgtggccacgtagttggtgccgtagtagatgccccacgggttgagctccttgctctcgtgctcgccgtcgccgtagaacccctccagcccggccgtcaccaggtggcggccgccgtcgacgcgcttcacgtacggcgccatctcctccacccacgcctgcaccatgccgcccgtcgggtcggcgtcgcaccgcggctcgttcatgagctcccacgcgaagatcgtcggatcatccttgtacgccacccccgtcaccgtgttcaccctcgtcagcaccgcctgcacgagagatcgagctccagctctttaacatctagtatatcgatgtatgtatatatcgattgtgacgtaccttgacgtggttcttgtagtaggatttgacgacggagctggtgaagaagtcgtcgccggcggtgaggttgtggccggcgtcggccgcccaccggacgtactgacgcttgccgccgaaatcgtcgaagttgttggtgaggcagaggagaaggtatatgccatgtcgtctcgcctcggcgatcacaaagtccagcccctgcaagcaaaaaagaaaaccagagaaaatcaaacaaaaactgtgagtttttgttcaccattccacgtgacaaatggtcattgatatacgacgaatggtggtgacctggaacatggcctcgtcgtagacgcccggcgacgactgcagcggctggtcgccgccgtcgctgaaggcccaggtccgggcgaggttgaggccgcgcgatgacgcctgggcgaacgcggcgacgacggcggcgcggcgcgccgggtcggacgccatcatcatcagccagtacgcgttgaacccgctgaagtagatcgtcctgccgccctccaccacgaactgcgtcccgtccacgcccaccatgccgccgcccgccgccgccgcggcggcgccgaagacggcggcgatgatgatcgcggcggcggccggccgtggcctcaccgtcatcgccgccatgtgtgttgcacagcttgcgccctgcacttctactacacttgtgacttgttcatgcaaatatgcaacgcgatcgaattcgtgtgcgttttttatatatataggcgcatgagcagagcctagaagatgcacgttaattagatggaagtagtacgtggacaacggtggtgatcgtcgccggcagctagcgtccatgacgtgacggctgtgtgtgttttgaatatctgaaacattccatgcgttctgccatgctagaatgcatatacaggacggcgcagatcgatcatatcgagctagaatgcatcgtgttgttttgtacaatttcgtcttgccgttttctttctttctttcttgcgaggagtcctgccgctttcgtctccatgaacactacgcgattactttcgcaggagaatggccacgtcgtcgtacaaaattagttattaatgtttttcaaactaaattaattaagtgttttttgggtgattttggtgccagaaacgtcagcatggactacacaagggacacggaagtacgtgttgcaatgatatgatcgtccttacaaagtgttcgatgctgcacaggtggtggtgccgtcggactcgatcggtcggtcggtttggatggcggagccaaaattagccacgttaacggagtacgtggaactgcatatactcataataatccacagtcatatggttcaaaacaaaataaaattcaagatgcactactacgtgcttaagatgcagtggtcacatttcttctaattaatttttaatcatacttctacttcttttctttctttttccttttaacacgaaaagaaaaaaaacttcctccagtttgttctgaaattccgatcgccaaagaggcagctaggtaggcagattttttttagacgtaacgaatacaattaatctagtaatgctgctgcaagtacatctaatcacatcaacgtactttatggcgaattaattactgtattaatgtactatctgtccagagcataatgtttcgttaagattaaactaaaccgtatagacatggggaggtacgtacagtcgtacagcatcagtcggcaaaaaaaaaaaaaagaggttgctaggcagtaacatcgataggtaactgtaacaacaaccgctgcaagtgcagagttaacttcttaatgttggcacttacccatcttgcctaattaatccttccttccttgccgactttcccaaaggagaactagatacttacgctagctccattggtaggtgatataagtttaaagggtcaaagtaaagctttgttgttctctgaacgaattccacagataaaaaaaaaaagtctaaagccggctgtggccggctgaaagttctcacttctcaggtcgtaaatcccatcgctgctttcggcatgcttcgcaccttccatctgcaaatatatttgtccaaa

SEQ ID NO: 41035 - DNA, 1053 bp, Oryza sativa
aatggttgtcttcagagctgtactacaaaggggtttcttcagatatgctctaattaaagagaaaaaacgggtttcttcagagctgtagtactgaaaggtttcttcagagttgctcaaaataaagataaaaaagaagcaatgtctcctcaatcttgtgcacgtcacttgtgcaaggttgtgcaaatctttattggattctataagttcgttctagataccggcagatgcagcatcgcagcaatatccactgtgtgcgtttctagttgaaagccattcagtgaactgcaatttcttcttttttttaaaaaaaaagaaaaggaagaagaagaagaagaagaagaagaagaagaagaagaagaagaagaaagaatctttgcaatgataagtcaaagcatatattggatcaattcaaggtaaggatcgtgtcaagcttgtagaaaagtttggcacatatatgcaagaacgaacctacgagtgtcgtgccgtggcgcggcagcagtttgcaagtgtcgagcgtacgtacgttgcgtggtttaccagcacgcatctgcaatgatctcttggagacttcgactcgtgcaatgtacttcttgtttggacatctctcgttggattttggccgtttatattctttgtggatatagggttaatgaaaaatctatcatctaaaaaataatcttttgttggactactcggaaatcggatcagatgcatgcttatcgccactcgagacccgtctctctctactgctattttttcttttcaatttttaccattcacagcacaaatcttttactatctgaattatcgatgaactgtcagcatcgattttttttcttgaacggtcatcaatctccatcctttagcagatatttaggagccctttgaaacacgcatgacaaaaaaaaagcatgaatcgatgtcctcccacggaaaaaaaaagggaatagtgtatatttttaatcccacataaattcaaaacacataaattgggaagagtagtcatttgattgcatcacaataaaaaaaactgaaagtgttccaacatcttgg

SEQ ID NO: 41036 - DNA, 9734 bp, Oryza sativa
aaaaggaaataacgtcatttctaagacttcacaattcacaagcaatgcaaagtgctatgcatcatgcgcacgtaatgacgtttgtcgtgtaatatatatatctccaagagtacctgagcggtttgtcgtgtcccttttcgagatttaacatatttattttatttatagatagctcttgctcttggtcactgaacaacaaaagaagaagaaaaatctgcatccactgcatttgaatacctaactcgccgcatgactatagacatgattgctggagtatatctgtgatagattctagctaacaactactgtagcttgaaaacatgttgacgattgagatctagttaatgaaagttgctgtgttccaatccaagagagaaccaaatgaccataaaaaatgcaaactgaataagacaccgcgagcaattaaattaacagaaaatcacataatggacttgatgtgtaagctctccctttccatctgattgccttattttgcagaacattttataaataatcacgtggaacgttatgtaaataaaataacgctaatctttggttgaacaccttggagcttcattatagccgatgaaaaagagaagattgtcaaaagtgtaaattttgtttgcaaacatttgaatcgcttaagctttccaaagcaaatcacaactaatactgagatatgcaattcccaaatgctcccagcttttcctgttgatctaatagcaagggcaagacacaccttcgatttttggcacattgaaatttgtttctttcgaaagtgagagaaatgtaagcttagtaaatggcgttcattttcgcttcagtaatcactaatcagccattactctgaaagactcatggaagagatgtttagaaaataaatgttacctactgatagataattcgatcagagatgatggaaaataaatgaaaaggaaaaggacagtagtatgcatcagtgcaattagcacgttttttatttttgtaatctgaataacgcgctccagactccagagcacctgacagcttcgacaagagtacgaggcctggcacaaaatgttggccaggaagcccacattagccatttcaggcctgggcttttgcaggccagaactctagtagcaggttgtaggagtgctccattttgcacgaacagagttcaaaacaacacatgtaggataggatggcaacagattgatctattaaactgaaaatatgcccgttaaaagaaacttcatgaagcagacaaactcaataactggtgagctgatagtggggtgatatacaattaaagagtagccaagcctgcagagcaaatcaaattactacaaagaaaaactctgttcgacaggtgggcgaaaaagaaagtaacaagtgattctggagatatgaacaaacatttggaggtttcagaaatcaagcccattctctctagcagcatcagccagagctttaatgcgaccatggtagaggaaaccaccccggtcaaaaacaactttggtaattcctttctccaagcaagacttggcaatcacttcaccaatcttttgtgccacttcctggaaaccaaccagaacaacagagaactttcatcagaaacagagctgtgactttcggcaagaaacaactgcagaaatatattcgatatattttttttcacactaaactttaagatacgtgttcaacactgttaatcctatactatctgacctgtggaacatttaatttgtaagtagagctcagaaccatgtactaaaatggaaatgccacatgcataaaaccataaaaaacaaccgcgacaacttcaaacagctttcattttttgtgcattcctctgggttttcttcagagctacatcagcaaaggatcgtcagatatttcaatggtaagtttttctagaacctattgatttcgcaatcaatgtctccaagagacgacactaggttaaggatttgaacaagtgagattgaattgagcatgattgtctgatcagacaaatatggatgcacaatcatcttttcacataagtgcacctacaaaatgttaatagcatcacctacggtattattgtggtactgcactgctcaatttattattttcagagagaaaaagaagcaaagaaattagacatgggtaagtcaaaatcaacttacaactgttggccctgccgagtattccaagtcctttgaaagagacttgtgcattgtggaagctgaaaccagagtgcatgactttgtatcgtcaatcacttgagcatataaatgtttgtttgagcggaaaacactgagtcttggcctctccgtggtgccactaacctgaaataaattatgtaaggtttacacaaaggcatgcttttattcacagaaacatgcattctgattctggcaaagcctacaaactgagtcacccaccatagtatgcacaaagccacaaactgtttgtttgcgacctcacggccaactgacattctaacaagtaggactaatcaagacatacataaacaagatattactcgtttgaactggacgtcactgaggatgacactagcgaatcctactctccttagtgtaccgccgccacaaaggcatttcatcaaatacgtcaacggcatgacattgctctcaccccacaagcctcacacctaccaactaaccgcaaaaaggagcgcgcaatcatcgcattgcaagagattggaaacaacgttggctaattcccctcgtgcaggcgctattactaccttcttgcggaggcggacatggcgggcgatgcggtcggcctggggagtggacaccttgacctttgcaacgacgacgagagaggcccgccgccgcgcctgcgagggcgagggcgcggagatggccggaatggggatgccgaggctcccggacacggtcgccgcgaaggcgcgcgcgccggcgagcgccggcgaggcgagcatggctaagtgcggcgactacgctgctctctacttgtctctccgacgagcccaatggctttgccttatcctatccaccctttgcattttaagctgatttggcaaacttacaacaagaccccgcgttaaaaaataatttatacacagcccccgagtacgtgatgggccaggcctatgtccacgaggagatgccgcgggtagggcccataatggaggggatgccgcgtggttgggcctaccaccacgagccaacttcccaatttggcccatttagatttagcgcacaatgatacagccatcgacacagcgatatcaaaccagattttgcccaaacgccagaacaaatcactctgatgaatactcgcaaaagatacaaaaagagaatcactctgaatctctctgatgaagatgaatttcgttagttcacttcacagaagggcattattacatcagactttacagaaagaatcgattcaactcttctcattagttattacagatcgatcgatcgagatgatcaatcgagcaatgcatatcttcatgcatctcagttgatcaaacaaacacctaactaattgattgatacgtagtacatagtacatgtctaactaaacctgttctctgacgaaaaacactgcactacttagtgctacagccgctcactacacctcaatcaaaaacttgtttcatttaattagggttcgagccaagaatgtcgtcgagggtttctccggaagccagccgctggatgatctcctcttcgcccatgcaaggtccgttcgtcgtctcgatgaattcgtctccgccgccggcaacctccatcgtcggagcccacggcaatggctcgtcgttcatcagatacctcatgtactgctccgtcgtggccgtgtcgaattccactcccaaactgtcgtccatcggcgccgacagcaacgcatccaggtccaactccggcaggatcgccggctgctcgctcccggcctcctcttgccgcggccgcgcgctgggcggcgcctccgggtgatccgcgccgtcgtccgccttcctcttcgagccggagcatggcgaatcggccgacttcgccgccgccgccgtgcgcgcctccgcgcagaccgcgcgcggcgagcggtagaccttgcagagcacctgcttgtctgctccgtcgatggcgtcgtcgtcgaggccgtactccgtcatgcaccaccctagcctcgtgaacgtgcgcgccgaccccgacgacgacgactcgtagacgccataggagaacttctggaggtacccgacgcggcggccatcggcgccgatcacggccttcttgccgccctccgacttccacacgctctcgccgccgccgccgccgccgaccgcgcgctgccgcctcccggaggtcttgcgcttgctggtgaagcgcggggagcagaagaagtaccagacgctgctgctcccatgggtgcccggcgccggtctgtgctcgccgacgagctcggccggattggcggagtagacgtcggcgtggttgatgaggcggtcctcgaaggggatcttggcgatgctggggcggaggaagagggtgatgaggccgtcgtcggaagggtggaagacgtagcctggctcaagagcgatctcgtcgtcgtcggccatgtcggcggcgctagctctcgcgttgccctagcttcacctcgatcaggggagaatctgaattgatcgaggagagctagagctagcagatggtagccgatcgagggtatttatcgtggacgtggcgcacgtacgcgcgatcaaatcgcagtacagacaatgcaatcgatcgagagttcgagaccgactcggactcaggcgaaccaaatggtttttttttttttttggcgggaatgcggtatttgtacgcgtaatatgattgtttgttgcgaaatgctaatcgattagtccatccaaattatggtttcttgatgggctaggcccggctgggagaggcccaattcggtgactggtgaggcccgtcatcgaagcaacgtcatgtggtcaggcccactagcacagccatcctgcgttacttggcccatttagaatcggaccgcaacaattctattcgtgacaggccgtgccggctccttctctaatggcctcctttcacttaacttttgggtttttctcattgagtattgaggaggatcctctagtacacagctggagcaattttatgactatctgatcccattaagcagtatttgattattatcttttttgcgttaagcaatcttcattcctcaagatcatctcttttttttcttaaaaaaaagagagaaaccttcaacttgtgataattttgcacacttttcattgaggtttatatctatttgcttacatattcatctgcagacaaaatgtttttttatgtcctctaatactctataccgaattggaagcaagaagaattcttggtctctagtattgcacgtgtctcagaaaataaaagttattttgaattgctgaggatttgggatggtttatttctcctttttcccccctctatacgcagttccacagaatcttttttgatactttcaagaaccatgttgatactgcaaggatctatcagtgttatatttaatgagcctcaatatccttgtttttcttgattatatatgttcagttgtatcagaaaataccaaagataacaaggaaaaatataccagttttctatttcttaaagttaacattattctgttttggacttccattgagcatcatcaaatcgcagagtacttctatatgacagtgaaatcccttcttttttttaatatatatattctaaattgctaaatagtacagatgcacctctttgttttccttgcagcaatcaatttccttcattatcaattgcaatatttgtctactaatattttagcgcagtttgtttaccatggaacaattattattaactaatactgtattttatatagtagtattttttttaagactgcatcctgctagtgctagttcatactgccatgctggaatgttctggaatgccaaaatctggcaggaaataacttcgtaggatttgcggcacatatcagcttatctctcacaaaaatcgttaaaaatttcgcacgttccagacgaagcctagcggatttagaatttggattagaaaaaaaaaaagaggcaaaaattgcgaatagtaatcaatctcctggtccatgaaacccgtggatgaaggagcgctagcagtatatcatgttgaagggcattcatctctatctctgttattgctgctgtcgctgctgcatcataaatgagagccatgtgaagcgcccaaactatacatgtttatcttcaatttaacttacatataggagtacttaagacaggtcatggtggtactgtgtctgcacgaacgggtgcattacattcatgtatcattattcattaggtaggattagtaaatgaaacgagaatggagaaatgatttggcaaaatttgctccattgcaagcagtggcagagccagaattttatacctggggggtcaattactaatgatttatatttaagtgggttatttctctaatttttttgaatttatacatgaaatcgagatttatatggtgtttttcaaaaagccgtggggtcagccgatcccacagaaatggcctaaatccgccactaattggaaacccaaaagatgagaaacaaagttagggaggaagagatgaacggacagctcgtacattttttctgtctactacaaaaatggtaggggaaccccggttgtagtcgagcaaaagcgtagggttaccgagaaaaaccctaaggttttaaaaactgagatggttaccacgaaaaactgagatggttaccacggtaatcgtgaggtaatagcgtagtattataaaccctgactaccactgttagctcttcctttttttcatatttcaggtgtacatcctaccatggcagctccctgagaagattagcagcactgacatctttacaacttctaaagcagatagcagctaaccttaaaagtacacagtagtggactttgtcaatctgcactcacaaagtgagctattgtcctcatcatgaattcaaactgggctgtttatttcccagcttttggattcaaattttgtctctgttaggttccccaaacctgactgcaatggcaacgaggtagctgttcgtttccaaagctgttgctaccagtactgaagtacagtatgaatgtatgattacctgaatttcctctcacacactgaaagtctgaaacatcacaatccatccgatccttctgatcagaaaaagaagaaaacgtccatgtcgaattgctcaatcatgcttttgaaaagacaatggcaccacattccagaatcaaaccatcatattgttcatgaactacgttaaacagaatgcagagagaggagtcaagaaaagatcacgcagacaatagctagctagcacatgcatctgggaccatcatctcatgtagatagtacaagtaccctactcgtcgtaagatggaggagtcctactactacctcctctctcaatccgtccccaaatataaggattcagatttgtcctaagttagaatcttttagctaatcaagtttttatcgaaaagagtaggatgaaaataaaatatattcaaaaaataaactaccgcatcaaaaaataaactatgaaaatatatttcaaaacaatgctcatatgatactatcaatatattctgttcgtaaatattattattcttttcataaatttaagatagtatccttatatatattttgagacagaggctttaagataatagctaactgacttgattaatcaggcatttagatttgtagcgtggcatatgggccaggataataatgatggatttcttagtgataatgactgagtccactgaccggcctggactcgtggagaaggtgtagtaacatacacggctaaattaaagctagtactccattgattttggtggagtgcatgctacagtgcatcaattgatcggtcagttttaaccagtgatgaattacttcctgccagtacagtgtttcagttaaggcgtattgacacggtggtgccagccaaagtctttcaggatttgtactgaacaaaatcctttattgtgatggcatatgtgccggcatggagtgactggacgagtgtaaaaatatttgacagattgcaacacaaagattgcctccaaaaaaacatatttgttacagtgtttttctgcattcctaagaagtgatgccggctgttcactgcctgtttgaagtaaatgacagtgaattcagccaatccaagatcaaatcttgtgcacatcagagagaagaggagttcccaatctctcacggaattcattgaaaaggaggcaggaatcaaagatgccattttcaatttggcatcgtcttccttgcattgcatgtagcaagtagcaaccatttgcttatctcttcttcttcagttgttcttctccttgcactgctgccttttgaccgcgacacgcacttgaaataaagctgaaacacgaaccgtggctcacctcacctacttccaaacaaactctgaatatttttttagaattagacctcagactttgggcttcttttctttctttcttggtccctgcaactcagaagattcaccggccaggcatctttccattatcctgctccaattctcttctcatcttgtttgcatgattgatactagattgccacagtggcctcaaagatttcacatttttctgaagaaaaaaaaaactgattttgtctgaaactgcatatgcacgtgcatgcatagtatatgtacacaaccctgattttatttacatgtcaatttttaagaaagaaagaagcgaacatagaggtcaaatcaagcgacctgaagaacagaggagcaggtagaaatgcagaaaaaaaaagttgagcaaaatacacagctcgttcatccattggggcagaccggcagagtagtagagtgtagattcaccattaaaagtaaaagaaagaaaagaacgaaaaaacactgaacataaacaatccccttaggtaataaacacccagtttatcctctctagtgaagcagtaataaagaactgactccatggaattacactacaagttactaacattttaccggctaatttttacttttttatccaagcagcaatgagcttagattgccttcttgtttgagacgccaattaacccaacctagctttgcctttcttgcttgatcgatgctttgcagcttcgagctcctaccagaagcacacggacgacgacgcggcgggcgccggggcgtgggcggcgccgccggagaggcggccgtagcggccgaagcgggcgccgcggcggtggatgttccggcggcgggagacccaggcgaagcagaggcggaggcgcgcgcgcagccgccggagccccgtggccgcggcgcggcggagcctgcggagcccgacccagacgacgcgccgcgcccgcgcccgcggcgagagctcgacgtcgcgcgagaagtggtagctccgcaggaacagctgcctccgctccacctgccgctcccaccgcgccatgtactccacgtacggccacgccgccgccgccgcaggcgccttcgccgccacccgcacgccggacatggcccagccacaggttcttggcctgctctgctctcttcttctttcccaaggcgcgcgcgcgagcgagcgagcgagcgagcttacgttgtggctgcggcgaggaatggagaattgataggaggaggaggaggaggttgcggcg

SEQ ID NO: 41037 - DNA, 3022 bp, Oryza sativa
tactgctaggggggggggggggaatccttgttgcgtatggaggcaatagtgccggtttgtgatgtacaagtaactgcatatcataaaccatacatgccggtgctgtcaatgaaaaggatgcacgcttaagggtatttttctttttttagttaatcaagggtaattttattagataggaaaaatattgacattttttgtcgcaactctaatacaatcaaaattttgcaagtacaaaaggagtactaggttagtatattgtgggggagaattacatgaccaacccagtgtgtaattaggtctttgatgcgtttgtttatgtaaaccgtacggaggtgggcttccgttggatggatgggagcagagagtcgttgacctgaatgacatgaatgtcccttctgtactcttctgctcctctccacccaaaatgtccttttggattcttcgcactgcagcatcatggatatagggctgtgtttagttcagtacaaagtttagattttacttgaaattagagatgatgtgactgaaaagttacgtgtgtatgacaggttgatatgatggaaaaggactaaagtttggatctaaactttggatctaaacacagccatagcatgcctcaaaggcaaatgaaaagtccacataaatttaattcaatagtttgtgtggtttgtgatggaaatggaatgcttcttacatgaacttttgatggatcaaatgaaacaccattggtatgtgagggcctcagtatgtctttgttttccaagactgtctaatgttcaggttagcggaacttcactatggttctgtcaaatgcttcgttcgtttctgactcaacttattctggcatgggtaacgagttctttctctgggttgataatatttgttattttggacaagagcacgatctcaaaaaaacaactttgaccattattttcattataatatgtataaaagtgttaacaaatatatgattttattaaagtactttttaagactaatctatacatgtagtcaccatatttgaaagataaatattttaaaaatgatccataattaaagattttaaagattgacctcacacttatttaaaacgacaagtattatcagtccggaaggagtataaccattaatcatgtaagtattaactattatatattaaaaaatatttttgtttcattttaataattttttatatattttttacacaaaatatatcgtgtattagttcgaaaaacgtgctctctgtaaacgattgagtaacctagtctctaagctcattaagaacgcagccaagtcttggccatcatttttttaggaaatgtgtactgatttctagaacatatattctagttttaatttcaataaggagagatttcatgtggctgaaaactgcaatataaaaaggtgaaacggaatctggctgtatcacaagtgaagaccaaagcatgaaacagtgtatccttgaatccttcagtagctgtcgatctgatcgtgattatacgaaggttcttgcgtgccacaggtggatacaagatgaattcttgaggaaagctactcacaagtgggcgtttctctcagacatgtcacctcggaagttcgttatatttctggctggtcgttgcagcaaccagctgaaaatgaaactgcaggtcagttgtttctgcatggtattcctgggttcaggaatttgatatatgagtatttaaatatcaacttggagttaaaagatgagcagtctgtgtcatcattttcatttataaattaattaattaagctcgatccatcaacagatgggtgtgtgccgttaattcgatgcgtgctctgaactttctgaagagacgatatatacattgaccagttggcttacagtacgtaagtcagtgaaggattattagctagcagattaatcacagtaaatagacgtatgttgagggtaatataaaaaagtcgattgttggtaaagaatcaattactagctagcattccatggtagcactccactactgcttaactacgatgaacatatggatagatctttttgtgacgtccacatcacaagcaagaaagatgattacttatgttaattacccgaggtagaagaaattaagagcgagttggttattaaatcagggagctggctggcatatactatcattagtttattactattactatgcgatggagtagaagggagtaggtgatggtagttcacgctaactagctactagtacagtaatctctaatctcggctggtcacagcgtacactgcatctgcatgagcgccggctttacttaattaagtattcaattgcttagttaatctcatagaatatctatcattaattaactaacccccgtgcgtgtgtgtatcaatcgtacagggttggcatgcacagatgatggcgtcttgtcatatttgcagtgcagatgcttcaaattttagttgtctgaactaatgatgagcttgcgtgtacactgtagctagagtgaggagagagctagcggcgagcctgccctgatctatcgcttgcaaatggcgtccaagctaattcgtgtctgcatgataccagcaatcaattcctcgtcaaatacgtaaagatacttcatcctgaatggactgctctaatgattacttgctactaataatctcgtactattatcactcagtgatgataccatgcatgatgactcaaatatatatggattcaaaattaaaatgaaaatgtattactactactatggaaatataaggaacaaccacccttaacccaaagaccaataaataattattattacctcgtagtttggattacctaataaatagaatatatgcacccaataaaattagatatcttgatggtggaggatttaaataataatatttgagtgaaaaaaatgtactacttaataacatgcatgcatgcctgtcttagggcacccacaatggttatctataagctctctacaagagatccatgtcatcatattttcctacttggaagagattaaatgaagagagaga

SEQ ID NO: 41038 - DNA, 6529 bp, Oryza sativa
ctaatcgcccatgataaagacatgactgatgacaacttaattgattaatcctttctgtccagcctgatctgttggaacttgcacgtaattcctcacaaaaagaaaacaagatacggagtactgtagtactagtactcctgatgtagcttgtcagaactcagaacgggaaagaattaatcgcgtatcaagtggcaaatcgtgatactagaactattaacactctaatggttcgcagatgtaaggatggtgcagtgctcctactgggcttcagataaattcagagttctgaatttctgatatcatgtctgccagcatttgatgttctagttaattactgtaggacacggatggtgatatgagataataaccatagttagctcagatttgaggtaaatactcgctccatgtacttgacagccatcaaagatactacttctacgtagcagtgcaaagctactcttaatctagtcgagtactaccatgcagctagcaaccgatttgcaggccagtacactctactggtactaatggttgtagtaaattattggtactatgaatgatctggtattcagtaggagtacgtgtgtaacgtcaagtaggtctcgtccccaaaaattcgatctgattccacttgtcttgcaaacaaaggcagctgcagatccaagtcaaccaattttagttctgcaactcttctcgagtagtagtatggctgtgggaacctgatagtaataagatactgggcagcagtaatcactactatagtattagcaatagctttcttctcactctttgcttacctgtaacagagtgagtgttggggtttgaaaaacacatcatgcatctccatcaagaacagttactgctcaaggatttgttattctgaaaacggtgcgtgcttgtccaagaagactgtatcctcataatttattcaatttgttcacttcagttctctacacgccatccctctgcctaatctgctcatggcatgtgcatgatcgtcatcgacccagataaccacatcatatatattaaatctttagtttacctttcacattagcgtgtaactctcttctgggttactgcagaaaataaaaactgtaaaacaggtagtagtgatggtaacgtgagtttgttaaatagctaggcagatggttaatttctagtggaacttcatttcatttcaccacttggcaagttctctaagatataaaaaaaaaggaattaggtaatggcatgatgatatcagctatcttaagctgttaccaagatacttcctccgggtttttttaatagataacgctatacatttgacaatttatttatttcaaagtttttatataaatatgcaaaaaaaatataaatcatgtttaaaacaatgctaaaccaaatcacatgaaaataaaaggtagttacataatttttcagtatgataaatggttaaacatgtattcaaaagttaatcggctatataaaccggatgtactacctctgtcctaaaataagtgtaactgtgagtatccgagtccaatatttgaccgtccgtcttatttaaaaaatttataaaaaaaataaaaaaaaagtcatacatttttatcatctaataacaataaaaatagtaatcataagtttttttaatagaataagacgaacggtcaaacgttggatatgaacggtgcaaaacttactacctctacggagaaataatgtgtgtgtgtgtgttggggggtggggagtgttgtactggaggtaaggtacagcagggcagggacggcacgaacagcgtgtgtggtgttttgtcatgcaatgcaatggtcacgactcacgagccacggcatgaagccgtcattccggccaatgcttggcgacaggacgagtcctgttcctccgtgtgcaaaatgtacgtacagattcagtaatgggaaacatgcgtgcaatgcagctactcctactaggcagcagtactgggcagcccaatggtttggttcagagatcatccaccggcacgagcacaacccgtggggaaattaaattacggtctacacagtctccagcaaaaagattacggcctaaactaagcaaatccatagttaattaatggtcttctttcgttgtcaggcacatgtttttatcgtgttaggatcaacaaaccaactccgtccttttacatgggcacagcctcgaactttgacctgatagatatgtctcccatttcacgcatttcgctgtgccgtttaatcgatatcgtcatatcgtcagccaccaaatcgacctaccacttctgaattctgacaccggaagaacaccacgcccccctgcctttggtgccaaactgcgactgggtctatgtatacgtaagcagcacacacatgacacgtcgacacacacagatcgcgtttgctcaaatgtaagaaacacatcaaacttaagcaacagtaaactactctgagttgtacgcaagagaaactgtgtccagcttcgacaatctacacaactcgtagcagtagttttggctagccgaccaaccattagctaccaagttgaacgacggtgcatccgtatgaacgtttttctatctcccgttgcacgcagcattgaccatgtcatcttcaggtacgtgccacctgccggaacaaccgaccaaacctttacacgacaaacggcaacctttgatatgccccagatgcaaacttttgacaagcaccagatgtaaagttgtttgacattggacagtgattctaattggcgcgaacagtttctgatggcatcagccagtccagtcgtgtaggaacgagctgtacacacggttcatttaatcttaacatcctattgagaactcccaggtggtaacaaaaatttaacgtccctgtaaaacccgtattacatataaatgaacagaaggctctcctttggtggtcagcgtgccaaaatcttcacgacggaatgacgacacagagctgtactaaccagtgcaaaatcttcgtcaggcaatagtgttgggcatgtatggatcagatgaagggggactgggctttggtgttccttggcatgtgttgaatagtccagccgcttgttggaacatgatcaagcccagaaggagcaactcccgagcggcagggaagagtgttgtttctaccatctacttgtttgggcagtctgatgctcggtgcccgctttcgccacagttgaagcaagcaccactgaagctcctgctgctgtaaatgaggaacagctcattagcttaagaaagcagcatgagttaactagtagcatgtttaagtaattgttctggtactgagaaggtacaagtaatcactggccatgattcagggaggcaagattatgctgtagcaagagctagctaggaaacccgtcattaatttcacagcaaagctttaattacaacacatgagttggtcatatgacaagacttaacttcataagagtagctagtactaacaaacatgagtggctaaggaaaagactaaacattctaaagttaccaggtaagcaaattttgtctaactcataatgtatttcattttctctggtggcatctcctagaagaaagatacagcatggatgaaaaaagaatagacattatgttatttctgcgatgttgtgaaactcacctgtccctagacccaaaagatgatgagcggccaccaaaggatgacgagctacgactgccgtaagatgacccgcggccaccaaaggatgacgaacggttcgatcttctcccgccaccaaagtcatcatctgaccaactatcattgtcagatctgaagctcctgccaccacggcgaaatctgtcttcaccatcagagtcccaaccaccccgcccgcctcttgagccaccacccctggaccgtctgttcctgaaaccccggtccgagtttgagaatcggccataactatcagtagcaggaccatcatcctgtaatgcaggtagctgcaagcagagaacaaaaggaaaacagtcatcacattagctcacaaagaaccaattccgcatccaaaacaagaccagggattgctattgcattctatactgtgtgtagtgcaagaataatggtagaatattccctattttacttgccatttaaagtcaatttaaatgccttggttggaaataaatggaaatgccaccacgccagacaaatacttgtgtatcatcacacagattacgtatagcaattgcactataaattccaatagcaataattgaaaaataccaagctgcaaaggttacctttgtcactttggttatggtgtttcctgggggcagttccatactaagcaaatccctcgcaatctcctcaggtaaatcgaaaactgcaccttgaacctgacacaaccaacaatgcgccaatgcatgagcatcacagtgaaagtcatacacataaatgcaggagttttgaagatatgcatgaaaaagtagtgatatgtgtcatcgatttctgcaatgcatactattgcacgtaatgcacattaattaaagaagatatatatgctgcaaaactagtatcagccaacagcttcaaaactgcatgctcaattgctcatagacccaatgcactcatgcacagaaattaatgatcgacatgctcaagcaagagctcaccttctcatctgctgtaaggaaaattttgccaacttcatcagcagcagctgaagaaacatcagacagaaagccagtaacagatctaggagaaaagaacccccttccatatcctggatctctagttagttgcaaagtcacccatccctgtgttttaatagagggtaagaaatcatatgagtgcttctagctttaaaaagaaaatataaacggtaaacgcacaacaaaactttgagcaactcaaaaaaaaaagtggagcttttctatacaattatttgattgcccattataaatttataaaagatgcaatttcagtaatcagtactagtagcccattgtattcatataacattaggtggatataaatcctcaaatgtagaaggcataaatcaggacagctggatgaagttgatgggtagctataactaaggtagggaaaaaggaagtgttcgatacaatggtagaaatagtaaaatatcagttaatgatggatacatgtaatttcctcgggtcacttattaattcttacctgctcatgactgataagagaacgtgaagagggtggctgagaaaatccactcagatgtgccaatgcagaagcaagagcattaggtcctaattcttcttgcagtctttcagctgctggaatgaagtactgaatcgactccgtgtgcacacctcttaaagtagctatgacatgttcagcagaggactccagcacatcctcaattgctggaggacttatgaagtcaaatctgcatccaacatcacgctcaagtgatctaactgtccttctctggctgtttgtgaacatcaagattgcagttcctgctttcccagctcggccagtgcgtccagaacgatgaacaaaagtctctggatcattgggcaattcataatggataatctgcattaaaatgaaatcctctcgttaattgatccatacacacctacagttcatcccagatagcataatgctcgaatgcagttaatttgttaactagtcgtaagattaacccaagatatcagattgagatgctataaaacacatcaaagctagatgatatttcaatacaaaaacctaagttcggggggaaaaatggacagtttgatgatctaattttagcactgtaaataataatggagtttaaaactcagaagcttcactgataatcgctttatggaaaggaaagagttaagatctgtgaggaagggtgatttacagaattacaatatctaagaatcaaatgaagtgaagaggatatgtgaacccaccaaatcaacattcggtatatcaagaccacgggcagcaacatcggttgctacgagaacagtaaatttcccttgacgaaaaccatttagtgtcctctcacgctgatgctgtgaaatatcaccatgcagtgcctccgaagcaatactgtttgtcagtgctaatgatacctcgtctgcatcccttttcgtcttggtgaacacaatggttttcccaccctttgcatacacctgataacaagatatttttagataattgagtggccaacgctcagcaaaacagactagttataaagtcagtaaaaagttcgatagacatggaagatgtatgaatgaattatgttctgaaatcttaattggattgaagtaaaaaaaaaaaacttatcgggcatctactggcatgatgatacaccaacatagctgtataaactgtaactggtttcatgatcttattagtttctgaatctcaggaggctgagccgaaaagagaggaggggaaaaggcagctaaaaaatccatgaactgcaataacataccgtaatgagatcactaagaacagtgcgcttcgatgtagatgtgagcgggatagcataaagtttgattccttcagcaagtttttcatcttgatcgccgacctgagta

SEQ ID NO: 41039 - DNA, 4907 bp, Oryza sativa
ttcctacaacaacatcaacaccacgggagagtgcgttctgctggacattatatgagacacctccataaacacagactggactgagcttgggtgctgattcttttatttccttctcaacttgctggctaacttcctattaggtgctagaaccaaaacacgaggaatacgacctcgcctaccaaaagggaaaaaaaagggttaatgcacttgttaagtatcaactgattgtcatgcaatacaatgtgaagctgcataggaagatgaatggatacctcacactccgtccatcatcctcctccattaattgcttgatcatgggaatgccgaaggctagcgtcttcccggttcctgtctttgctctagcaatcaggtcacggccgtcaagagctggaatcaatacagccctctggaacagcgaaaataaatcagaaaagggtcaagcaaataagcaccatcaaggtgagcatgtgaaagctgaaattcaaagggaaataaacttatttggctatttgtatcgacatttcataatatgcaccatgccatttggtatgacatggatatcgttttattcttttagaagcaaggataaacgtaaaactggatattgttttattcttttagaagcaaggataaacgtacaactgtcctgattcaacaaataacaaatatgtaatttaatgatagttagcagtatctgtaggaataggacgaatttgatatgcagcaaatctatgaagttctacgcatcaacggaacagcaatcagcactctagtttgatattagagtaaattccacaaaactacatgttttgtagtccaagttgcaacaaaccacacaccctttgacacctggcacttaactacatatgttttagtactgaagtttcacaaaactaacgaatgaatccatcggcgagatggcgtggatgcattctctgatagtgtagttttatgaaacttcaataccaaaatatatgcagttaagtgccaagtgttaaaatatttgtggttttctgcgacttgaaccacaaactatgtagttatgtgaaatttaatcttgatattatggagcgcaaaaataattatggaaccagctatcacttgctccatagtttcgcagttcaattctcaagtgatatatcctaggagcaacttagcgtagactactctcactttccccactaaacgagtcatgccgcacttatcccgccactgttttttttttaaatcaaaacaagccccatcatgaattgctcaatacaggcttattcaccacgaactcatccccccaacaaatcctacactaacaccaattccctcgctgtctccgcctaataccgaaacctgcaatttgacatcaagcacagttaagctatccaaaactcgaaacggagcgcaaattggcatcacctggatggggaacaggtgggtaatcccgcgcttctcgagcgtggatacgagctgctcgggcaggccgagcctggcaatggcgagctcgtcctcgtccccctccccgccacccaccgcctcgaccccctcctcgtcactcccgtaggccccctcctcctcctcctcctcctcgtcgctgagctgcagccgcttgaacgcgtgctcgctgagcaccgagttgggcgacgcgatggcccccgcggccgcccaccggccgccgcccgcgcgccgcagcgcccagcagcggaaggcggcgcggaggcgcagagacggcgccgctccggctcccgcggcggcggcggaggcgctagggttggagagggagagggaggggagcgtgaggagggaagccattggagaggagaggtgggagaaaggaggaggggggagagagagagagaggggggaagtgataagaaatgaaacgagcggctggtcttgaggtggtaggaaggcgagggtttatatggcggggtgggggtagcattggatagggggacggggaagggtttgggggagaagggtttttgcgggtcgacgaggaggcctctcgttcacaagaaccactagcacagagagcctatctgtctctgccttgtactcttctgctgctatcataccagggtccagggctctcttttgaaatatctcaggcttagtgtcatactcctatcttcttggataatattaagtctgcaaattattcatggtctgcaagtatatggtatgtctacagtctgcttttgagtggtttaatatcttattagtgataaaaaaaatgagctatatctataattgttggtgtgttagttcgatcatttaaggttttttttcttgaacatgctataaaaaaccgcacacatgaataacattgtcatacgctacaaaaagtttacgggaggtttgaaatgtaagaattagagatggtaattttggatagctcacaggaaataacacacaaaaatttatttgtggaagaaataaatagttgagagaggaaaaacagtgtgcaatggacttcaaggagaagcatgaaatccaaacaaaggatttcaagtacattggaattttagtattgtttggctgcaatttatcgtcgctgcattgcaacctggcttggctatgatgtagcatagccgaacaagcattttcttatgaaatgatgtttaggtatccaatccattagattttgtactatcttattcttttgtttcaaatgacttgataataaaatttctaagtaataaaatcctttaaaattcttatgaaatttattcaatccaaaggagcccttgtaagaactctaccatcatcgctacctttaattcttaaatatattctagcaccaaacacattagaatattgtaaattttaaatgattgcgaacatatttttactgatttcctcactgtaaattaaattaaggttatttgaaaacaagagaatcggtttggttgggaggtcatagtttgctaacatccctaaggttttgttcagataggtctaaatatagaccattctacgtgtacgggcctaaaatttgtactaggctgcccgcctacacataaggacggaccgaaatggaccgtattcggtatagaactccggaatcctagaactccacaagcagaaaaggaaattgggcttcagaaaaaggccaatatacgtagcgggcctgattcctccaatggcccaatacttctgctccacccgtgaaaatttatctttttacgatttctcaacaaactttgcacctcaccgttattttattcaactttgtctaaactatttgttaactttatatcctacgatatttaattgatcctcaatgagctaatcagattttcagctcattggcgactgtccagctcacaacttcacagatgtttatatctgaagataaattgtttagtatttccccttcaatccacttcctgcctttgttgttatcttgctaatcctacattttctgaatctttccaatgttacagaagaattatgcactagtttgattacatttgggatcattcttcttaaccaaaaccaaatccaaagctggtccctggagcagtcattggttaagcatcatgataatataataatataagacggaatcagcaatcggcgctgcagactagctggcattcaaccaacaagtacctacctgactgtcattgcataatctgaagttctggaccatttggatcgtgtctctgtagtttttttttaaaaaaaaggaataatattcaaatcaggcagattattgttcaggcaatcaagccagtgggtagcaagctcgggcttagctgtatcagactatcaagcagagccagcagagatactgtttgttatgtcaagctaccgcttatattaataaagtcgcccaaactgttagttatgacacaaaagatacgatgatgattaatataacaacaattataattataattatgataccattttttttgctggtattaatagccagatatacaagatgctaatagcagttgctgcatcggatttcaggctgtaatattcagacgttgacgtaactgtcggctgcagcaggtgcccattttggccaagctaattaactaatcatacttaacttgcacattagtacaagtggtggatttcctacgttatctcagctgttaattgcaagtcaacttacccagaatccgcgtcaaaacaatgtcacgacaaatgtaaatggacaaacgtacattacagttctctccctgattccatattaattgatgctttagataaagttgatatcaaacttttataattttaaccatcaataactttaaaaaaatattaagtttaaaagaactaaaacaatatatacagatttttctttaaaagcactataataaaaatagatatatatatatttattatatattataatagaaaaataaggtcaaaaatataagatatattttgtagactgtgtcattgttcaaaacgttaattaaaataaaaccggaaggagtacaagataaatccccgtataattgattctcacacaaataattacatggataaaccaaaatccctgaaaatttcgtacgtttttttttaataaagatcacgcggtttcatgcatcaaagctctccgtaatgttggaaacttcgattatggtttgaaaacaaattcagagacagcagactcgcacacgcttcgagagaagacgaaggaaagaaatctgaatctttccttctcgaagaccggtccccttcaaatccccatagaaaaaaaaaattcaaatcgagccattaaattaaactaatgaaaaatcaaacgaaaattaatcaaatccaaccaacgtaatcagaagcagatgcaaattaaacacctcctcctggcacagttaacccatttctcctactgctcctcctcctccttccccaaccactctcaaccaatggcgcatcaaaccggagccaat

SEQ ID NO: 41040 - DNA, 2571 bp, Oryza sativa
accagcgattcatcgtccgcctcatcttcatggtcccggtaatgcaacgcagctcgtccccgtagctccccccctcgcgccagatctgtcgatgccttcgcggtttttagcgtttttttttgtggggggtgaattcgtgggggggggggggggggtggtttcgcggtcgcgagctggcctggaatgcgagcccgtttggatggcttcgattacgcgtcgttccgagttcccgcctctgattcatggagcctaagcacctgcaggaggctgcaattaacttgcacatgattttttttctttttctttttgtgtgcgtggatctacgagtagatttgttggtcctgttaggtttgatcggtgtccagatgttgtgttgaagaaaatttgatagcacggcaactccgtggctgcaatcgctgtgctgattgatgaatttgctcgagctagctgatcctgatgatcttttaatggttgcaatcatttgtattatcatgtttcatctggtgtacatttacatttagcccttatattgaattgattttgtttgcagcacttcagcatattaactctgatgatgtttatttgttgcaggtctatgccgtgatgtcgttcctttcccttatcttaccagataattcaatatattttaattctattcgagagatgtaagtcaatcttataatcttgccccttaatgtgaactaactgttcttttggattgtggttcctgttttctgctcacttgttgggagctgaacatgtaatcttgtatctccaatgatcttaaagttatgttgtagacactagacaagcagcaaatataagaactgccataaaaactttcttttggcattctctaattgccaatgggcacaacttttcttttgttgccacacgttagtatgatttgacatctgtgccagcattgttgatattgctggtgcaccatgtcacattctagctctgatgcacttcttttgctatcacctgatttatactccctccgtttcacaatgtaagtcattctaacattttccacattcatattgatgttaatgagacatatatatctatctagattcattaacatccatatgaatgtggaaaatgttagaatgacttacattgcgaaacggaggaagtatatactagcaatatcatcatgacaacattggtacactgcccatgtcttcatatgtgttgtgtttacgtttagctactgtgttgataagcctcagcaatcactagtgtagagaagatctattatgccatttgcgccacatcacatgcattcatatttctagatgtcgttttaatccatcagcccatgaaccatgatttcagatgttaaatacacttgatatatgaagactattgtcactgttaatcttgagtgtcttactaagaccaacaacacacatgaagaaaacaagggggagaaagcgcattgaatgatcaccacttctatataactacaaaatcatcataatctgacacagtatgctaataagttattgtaatggaaatgctaataagttattgtaatggacatggccttcattcttacagaactgctggtttataaattctatgaataatttgatgccatgaccaaggatatgattctattgctgttttcttgtctgtgcttgttaagggcgtaaggcacatagcctcctatcaatgttttatgcgatcgtcgatactttttttttccacgttttgaattttttttactgcacttgtgttttaggatctgaaccaataaatgcatatccgactaatgttaaaatctctctgattgtttttcagttatgatgcttgggtcatctacaatttcttttcactttgcttggcatgggttggaggtcctggtgctgtggtggtaagtttgaatgggcgaaccctgaagccatcgtggtttctgatgacttgctgttttccagctattcctctagatgggtgcgtacatatcttttgcacatattaagtgcttattgtaacaatctaatgcttcaacatgcagttgcacagtaacattcagagagtatgtcatatctatgcaagtgctgattaaaattatgttattggacaggcgttttattcggagatgcaaacaaggctgtttgcagtttgtgattcttaagcctattttggtggttattaccttcatactttatgcgaaaggaaaatacgcagatggaaactttagtgtcaagcaatcctatctatacattactatcatatatacagtctcatactcaatggcactatatgctcttgcggtgttctatgcggcatgcagagatctgcttcggccatataatcctgtcccaaaattcatcatgatcaaatcagtagtgtttgtcacatattggcaggtaaatatacaacagtcaaaattttttcacatccaagtacgattgctatctcaagttccaatatgtcttatcagactgtttacagtaaagatgtttcctagccaaggaattgttatgtcttgggtcatgctatattttaaagttctcctttgcagggtgtcctggttttccttgctgcaaaatctcggtt

SEQ ID NO: 41041 - DNA, 944 bp, Oryza sativa
  unsure (1)..(944): unsure at all n locations
nnnnnnnnnnnnnnnnnnnnnnnnnnnnnnnnnnnnnnnnnnnnnnnnnattgttcatttctaaatttttatgataattacttcattgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctatttttgtacgaaaacatcaccccgtcataacttgatgatccatccttgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactg

SEQ ID NO: 41042 - DNA, 1994 bp, Oryza sativa
  unsure (1)..(1994): unsure at all n locations
nnnnnnnnnnnnnnnnnnnnnnnnnnnnnnnnnnnnnnnnnnnnnnnnnnnnnnnnnnnnttcctatagaaaacttttacaaaaaatacattgtttagcagtttgaaaaagcatgcttaacgaaagaggatgtttagccgtttgaaaaggcatgcttaaggaaagaggaagatgagctgagaaagaaggggaaagaacatatcttaataagtagacaaatccaagcgtgattaactaagtattagtctaaaagaacttgaaaatagagtagtatgattttttaaagcaactttcatattaagaatttttgaaaaaaaaaacacaccgtttaatagtttgaaaagcgaaagcgcgcgtgcaaaaaaaaaaggaactgtgaggtagcaaaggggaaaaacacagcatgagtaggcagatctgttatttgacaattggtgaccaggctctgtttggcaagactgcaactcaagaacttttgcagaaaatagagtttattatgaataaagaaatccaataatctgattttacacgaaagtaaagaacagtgatgatcttaatctggagctccataaaaactcgagttagagcggtgccaaacagcgctgcataacacagtatacgacaatcccaacagttattactgcttcaaccagtagaagacatgcatagatgagatttactcataaatcaactcaaattatgtgatctagtcttgagtttctggcagcgtatctataaacgcattacacagcaagtcatggagttctcttacaaacgagctgctgcataacaacattcagatgaactaaaatgaacgatcgtgggggcaaatcaaacttgacgccattccagcctgcgtatattaatacaaggaaaacagcgtttcaaattaatcccccaacaagcgacaagctgaaacaacagcaaaagattatcttcacctatttcctttcgcttgtatccccccatggcaaagaaaagttgatggcccagaagaacataaaagagtctggcaggcaacaataagctaatcagcaactgaatagctaaagccagtgctgtgatatatctttgatgttactaggaacggagcattttaactttgggcatggacttcttcatctgacgagccctttctttttcctctttcttgcggagtgcctcggcgctcaatttggcctctgcctcttccataagttttttcttctcagccttcttcctttgaagggcttcctgccttagaccctgttgctccctgaaagcctcctgggaagcttttgttcttgcagcttcagttttggaacgagcctgcaattaccatgaataagaagaattagacactgtaaccgaaaaatggttgtggcctaaaacaaagatagaggagatactcacatggttgctgagcttgtaacgccccaccaaatcaatgtagtatggcacgagagcaactaatcttgtcatctcagccatgttgcttgcatctggcagtacaaacttgaaagaaaggactttcttgtaagagcctgccagttgatctgaaaaatgaagtgagatgaaccatttcccaaatttctcaaaagctttgtcaccaagcacctgcagagaaacaggttgtaaaacattatatatgtatgccactgtatagcattgctcagtcttactaaagacatgcggatcatattgagccagcccatgacaaaattctgagcaaagctatgtcaatccttaattactaaaccttccatctaattttctttatcatagcattaagacaggctacttcagtcgttaaaaaagatatagatggcgactttggtagaactctagcagtcaaaaattcaaggtactccctaagttcttcgctatgcaaatgtgcaaaacatcaacagctaggaacagtaccccgactttcccaagacaaatatggcatgttcaatatcaacactgccttatgcaaaagcctgatgatattattaaattacaaacataatgaa

SEQ ID NO: 41043 - DNA, 3478 bp, Oryza sativa
  unsure (1)..(3478): unsure at all n locations
nnnnnnnnnnnnnnnnnnnnnnnnnnnnnnnnnnnnnnnnnnnnnnnnnnnnnnnnnnnnnnctgcaattaccatgaataagaagaattagacactgtaaccgaaaaatggttgtggcctaaaacaaagatagaggagatactcacatggttgctgagcttgtaacgccccaccaaatcaatgtagtatggcacgagagcaactaatcttgtcatctcagccatgttgcttgcatctggcagtacaaacttgaaagaaaggactttcttgtaagagcctgccagttgatctgaaaaatgaagtgagatgaaccatttcccaaatttctcaaaagctttgtcaccaaggacctgcagagaaacaggttgtaaaacattatatatgtatgccactgtatagcattgctcagtcttactaaagacatgcggatcatattgagccagcccatgacaaaattctgagcaaagctatgtcaatccttaattactaaaccttccatctaattttctttatcatagcattaagacaggctacttcagtcgttaaaaaagatatagatggcgactttggtagaactctagcagtcaaaaattcaaggtactccctaagttcttcgctatccaaatgtgcaaaacatcaacagctaggaacagtaccccgactttcccaagacaaatatggcatgttcaatatcaacactgccttatgcaaaagcctgatgatattattaaattacaaacataatgaaatgataatacaagccatcatcacattacttgatccacagttactattctgggaaaatcttggtacaagaatagttatgaacataatagaatccaattggtgccaattcacccaaaaagtaagaaactcagatcaattcacaatttaattcctttacacttcatccatattgaagttagtgattaatgatataattgaagggagtgagatgtttctcgaatgtcgaatattgcacctttctcacttccaaattatttgatgataatttgtaatatataccgtttcgttttagaaggcacttacctatattactttcataaaagaatcaacatcaacaggacacctcactatatcatctgtacaatcttaccagaagaaccatttacccagtaccaccgaagctaaaaacagcaattctaaaaataagtaagcaggttaaatcatcacctggtccagcacggcttcagtaatcatatccccagcaacctcctttgactcggccactaccgcaagctcatccgcaacccatctcctcccggcgggtgccgaggtcagaaccccggcaaatttctgcagatccctctcctccttctgcatcgtcttggccgccttcttcctcgccacggccaacatgacgtggtccatggcttcctcgttcatcaccacctcgaacgtgatggtgtccttcctggggaacaccagctccaccagcttggacagcaggtcgtgccgcgcgcgcatctccatggtggcgagcatcccctggcagtaccgcctcccgctcgcgtagaacttgaacacgtcctgcccttccttcatcaggagcggcgtgtccttgccgtcgccggtgccgaggaggctgaagttcttgtcgaagatggagtccctggtggcgaacctggtggcccaggcgagcgcgatcgcctcgttctgccgcttcccggtgaagtagttgagcaggaagcagatcaggaagctgacgcacgcgatctcgacggtgtacgcgcggagcagctccgcgggccgccggggcggggctggcgccgcctcggccgcggcatcggccgcgggatctgacggggcggcttccgccggcgtggaggattcgtcggaggaggccgcttccgggacagggatgccctcgaactcgtcctcgtcccagagatcgagcgtcggggtggggttcggcggggtcagcgtcgggttgggatcggggttagggtttggagcggaggtggtggtggtggtggtggtgacgggaggggaaggagttgaagtggagagggagatgcgcggcggcggcgggagctcgacgtcgagcccctcgtcgtcttcgtcgtctgccgaggccgcgtcggcgtgggcggagtggaggtcgtcggagccaaagccctcgaagtgggcggcgagggtgagggagaaggacagcgcgagcaggaggaggactagcgccgcgcgtggcggccggatcgagctcgccgtcgccatggacggggaggtttggactctggaagtggggataattctcctgttcttttttttttctttttcgggtggacgcgtagggaagacgaaggagatgtttgctactacagcggcggccggctgcgatttgcgaaaggtgagagataaaggtaggcactcgatttgggcgctgaaggcttgtagcgggaggtgaagtagttgatcgttggacttggatctgatcgatctgtggtttctcgaaatttaatgacacttcgcaactaagtgcacttcgaatggtaggatcgaaaaaaataaaggtataaaacacacataattctgataaaaaaataaatgtaaatcagagttttataaaacacagaaaaaatacaggaattgccgtttgagtgaactacataaaaaacatagaaattggatgagaaagatagactcgaagaaaattttctaagaggttgtagctcttgctaagattcctccaaaatccatgtgcaatgagccattccataggaattttatagaatttgaaagctttcttgaatcaaatggtcacacaggaaaaattcctataggatttgaatcctatgaaatttctacataaaattctttgaatcaaatgggccctaaataaattgtgtgaattccagcatgcaattggcaattgcagttttatggtgcagatcaaattctcaatgagaaaaaatgagtgaattccataaaattactgtttactatagttaaagttaaagaaaatataaagttcgacatctaacacattaatctagaatctacaccctccgttcaaaaaaccaatttatatggatgaacataatgcttgcgcagattcattcctataagttatttttttatacgaaagtaggtactacagctcacataatcacactgttatcaattattttttgtattctcaacatttacaagtttaaaagttacattccaatcacttaaagtattttcgcaggcatccctctctcactcaatctctcatttcctctctcgccctgcaggcatgctatagtcgcatgtttcacccttgtcctctaaactgtttaggccgaataggggggacgacatttaacacccccccccctctctgcttcaacaagtttagtaataagttcactctagatccctcagtttgtcgcctagtctaattttcatccttagtccagaaaaccagatacaacgcatccatcaactcacaaaaccgtgcagaataggtccctca

SEQ ID NO: 41044 - DNA, 2235 bp, Oryza sativa
  unsure (1)..(2235): unsure at all n locations
ttttctccgccaccggaacgccgcagctccctccttgctgcctcgcaggccacttccgccactgctgccttgcgtcgccattgacccccattgggacccataggggatagaagagggggtgaggtgaaggtagtacgacccacttacatatttttattttgtttgactaatatatgggcctcacatcttttgttgtaattttttattttccaattttattttttccggatcaaactgccacataagtgccacgtcaacgccacgtaggacgaagacttagtcaaaagatgccacgtatccacgtcagtcaaaaccgaggtcaataccacataggaacctcgtttgcactggttttgtaagttgggggatgcaatataccggtttttcgaactgaggatgaaaatcagactgggcgacaaattgagggacctaatgtgaacgtattccacaagcagcttattaccgcgttcacttccgttgctagctgggccaggcccgatggattaggcctctgtctttgttagtgcattcttgggccctgctacgcatgagcacgcgacagtttacttctgcgccgtcgtttaagttgtggttagtttggcttaacactgtcaggcgtttggtagatcggtggctgacgacgccgacccgtgttttggctgcacctactcttctagtgcctcgtctgcacccagatttgctgccatatattggtcacatgcagcgaagtgccaaagctacaatgcacccgtgtgatcgagagtagctagcgtacgtacgagcaatcttcccttgtaagccgtgccagtcatgatttctcttgctgaatagctgacacgcacgcacacgcacaaaatggttttcgtgcatcgttgctagtaatcgcgctactataccccaagcttttcccaaccatgcatagcaaggcaaaactgaaaaagttgctacgcaatttaatcataaaagcaaatacttcattatattacttatttgctcgtacacggtcgatcgatcgatcgatcacgacacgccacatatatatgcacacacatcatacatattccaagtagcaaatacgcgatatagcaaagctagcatgcatatgcaagctacatgcatgcaggcacgaagtaggtagcacatctagctagctaggatcatcacaaggttgccgccatgtatcatcaccggtcggttggatagcaaagcggcggcgcggtgatcgagcggtgatatattggtcgagatgatcaagggcacttgtggcggccgttgtgggtggtcatgttggcgtagcaggggcagacgttctcgttgccggaggtgcccggcggcacgcagccgcagcgctggcagcaggtgccgcatgctctcaggcacatcttcggccgccccgacttgctgcaccggtacccgcacttcgccccgcaatctacacgagattacatacatttgcatgcaactcatcagttcatcacactcacacagatcagaaaaaaagggaaaagaaaaactgaactagatcacgcattgcttaccgatggcgtaagcttgtccatgtggagcagtagtctgaagaccaaacaagaaataaacaggatcggatcagtaactgaaatatatacaattcaggaaaccgtttcgtttaggttaaaagatcagtttgaaatatctgattaattacctcgacgaggagcaggatggcgacgagcgagatgcacaagagcgacttggccatactggccatgatgatcaaacgactgaacctgaacgagccgaattcaactgaatttgcaaggtgaaattaaagtactggttctgtttgcgaggtggaggtgatgaacaaaagacgccggccggtagcccaatttatagggcgagaggtcggatggggctgccagatctatcacacggtgtatcccaggaggcacgcatacgcagcagcagcacgcagcacagcaagctctgcgtgcgccccccatccttggtggttccgtgttgggctctccacgtcgccacaccttgcatgcatcaatcgcttctgtgatcagatcagcgtgcaaacaattttaattatgtcttcgatgagaaatcagcggctggatatattagtgattagttctctgacgagcactaagcttgcatgcgtgctgtaatctacacgctccccgctgctgaannnnnnnnnnnnnnnnnnnnnnnnnnnnnnnnnnnnnnnnnnnnnnnnnnnnnnnn

SEQ ID NO: 41045 - DNA, 1929 bp, Oryza sativa
  unsure (1)..(1929): unsure at all n locations
cgagagatctcaggagtgcgctagcgcggggcccacgtgtcagcagcacaccggagatctctgaaagctatccatggcttggaattggttcttggctcgtgactcgcgtgagcatgtttcttccatgaagatatttgttaagccagtagcagctgtagcactgagagttattaggagccagatcgcaaaaattattcgagtggttggtgaggtctcgtcggggatcgactaacctactcgtttgatcgtggaacacgacgaagagggtccctttctatgacgaaggcaaatcaagccatcaactttgatttttctagagggaaatgatcgatgattctatcacaggagagagagcacatcactgatgagtttctgggcaaatacggttacgcacgccctgcactttaaattcgcaataatacaaaaatttctactttcaatgtaaaaaaaaccaatctagcagcctcatctttttacatatccttttacagtagcatacccatactaaagctacggtaacatttggtaatgcacgtagtcacgtttttacaagcatatatatacatatatatatatatatatatatatatatatatatatatatatatatatatatatatatatatatatatatatatatgtatgtatgtatgtatgtaacaaataatacataatcatattcgcaaataagtcgcgaccgaaatcgttcatcaaaaatttcgaaacatctaggaaacaacaaaatacaaaaagtaattatgctagcaaacaactaaaaagcaaaaatgcttagagatgttatattaactgatccacttcttttctctgactccgaccgccttacatgatgagcacatgatattttggctgcttaatacaatctctacagcacatgctggctgcacggaggaagtattattttcatttggatgtatacaaataaaactcattacaatttgcaactgaggtgaatcaaaaataccatagcttggccttagaaagagagaaaatcagaatattctagaccaaaagctttctaaatcagcatacctgatattattactatatgaaaataataatccatgaccatcgacaattatatataatcacttcaatatacaatatatgtccacacaaaaagaaacagtggagttatttttatagatattcatataatcttgttagttttgacaagtataattcaagaccagaatctggataatttttcacacgatttccatgatccgcatcagaaaaacaaataatccttacccaaaaatcctaggcaacttggtagtcctacaaaaaccgatccttgtaagttgcaacctgaaatttatcggatctgaaaaataagaatgctaatattagccataaaacaacatttccaatatggcccatgaaaatatatacaacgtttgatgtaatttggtagaaaagcacttggtaaattaccatcattttcttgatttaccattgtcacagttgcccaaaggaattttactgaaaacaccttagcaaacaaatggtgtatgtagagcttggcaaacatcttggcagattcacatcttccaaaattcgaacagtgtattcatatttctcattctagttgagaatgccaaaaaaaactggcgttctctctcatgctcctccctctcaaagaaacatgtattcacatacagcacaaccccacactgccctgacatgttttccagtacagaatcctcagtagacaaactaccaacaatctaggacaggaattggcaatctgggaagcttgaggttactaacaaaagaataaaaaataatatttcagtcgatataacactccatctactgcanactcaaattgttgaagaatcgttgattggttcttaccccacaaaatatgaaagcgatggatcgacggcaacctgatgtcagggtgac

SEQ ID NO: 41046 - DNA, 5855 bp, Oryza sativa
ttatagggtagataagtcaaaatttgaatcatttgcttttagatcactaaaaacatgtatataaaaattttattcacaaatcatttcttgtttgcaattatgtcatttggcttttttcctcaataagccaaacaatgaccctatagatttggatgggacatcacctagtactttgttgtactcgggctctttatattcatcgtttacatgatagcatctggtaaggtgtacactggcccgtcgcgccatttgtgtccctcaactaatgaattgttcacttcacatccctcatcaccgattaggattccacatcagccaaaattgcccacaaaccactaagagagtctatttgcactggtttcatcagttgaaacctgttatatctgttattatggttctaaggatgtgatttaaactcaacctcaagataagggatacaaagtgaacttattcctgtttaattacagatgaagttgtgggccgatatgtgcataagttgggccttcaattcttttgcattcctcgataaaattataatggcaaaatttgctgtaggacacctaaaaaatgtgtaattagctgtgggacatcgcaaaaacgtgaattgcctaaggacactctaaaggtgtggtaatttgctgtaggacactgcacgcattaaaatataatatccacctaattgatgagagagaaaccacatcaaatgaccattttgcccttatctttatcttgcttcttccgacgtttctaaaaagaacaaaaaccaaatcacatcagcggggtgtaccactgtgaccttgagcttgagaacctgctgcttaactaggctgagaacctccgacttcgggctcagcacagtctgctaccatgcgcgccccgacgagctcctccacaccgcttgtggcacgccgacgtacattgtcccctacgtgctcgccgggtgcctacgatagcaccaaggccgacctctagtcctgtagcatcatcctctattgctcgccggcgcgctactgttccaagacgagaacctggtgtgcatctatcacaagatgcggcaggtgacttcagctgcccgacgtggttgacaacggacgcacggaagctcatcaagatgttgttcgacctcaacccagacacctgcatcaccttcgccggcctccacaagatgcagtggttccggaagatggcacatgttctgtgacccatctcaccaagctcgcgcaggagccagtggacatgcttggcaatgtcgacaacgacaaggatgaattgcgcaaggtgctgaacgccttccacctgatgtcccttccaagggctttgacttgtcgccgttgctcgtgcgtacgaccctgccgtgtcgcaagggcgagccatggcgcgcatgggtggcatgtgattcacgacgcgcgagccggcgagcggcgtggtcacgcgattggaggcgctcgcgatgggcaacaccatgcccgtgcacgtgataacgagcagcgtgttcagggtgtgcctcaagtgtgaggagccatggggcggctcgccggcgcattttatttggtttggtgtttattcttttcggaagcatcggaagaacagcaggaagaggggaagaagataagggcaaaacggtcatttgatgtggtttctctctcatcaattaggttgatattatattttaatacgtctagtgtcctgcagcaaattaccacacttttgaagtgtccttgggcaaatttacgtttttgtgatgtctcatagctaattacatattttttaggtgtcctgtaacaaattttgccaattataaaatgctttactattgttccctttccaacttcgccgccatctgcgcgcgcgtatggcaacgtactacatcactgatcactcagcgcgatactgcgtgcagggcttggccatgttagctttctcgaccttgatctccaccggcggcaaccaatgcagcagcgccgccgtcgccggcggcaagacctgcccaccgtcgactctgcgggtggcgttcttctacatctccctctacatggtggccgtcgcgcagggcggccacaagccgtgcgtgcaggcgttcggcgccgaccagttcgacccgagcgaccccgaggagtcggtctccaggagctccttcttcaactggtggtacttcggcatgtgcggcggcaccgccgtcacgctggtgttcctcagctacgtccaggacaacatcggctggggcctcggcttcggcatcccctgcgtcgtcatggcgtgcgccctcgccgtgttcctgctcggcaccaggacgtaccgctactacgtctccggcagcaagaagggcgtggtcgctcgcgccggcgaggcactcgcggcgtggcgaaacagggcgaagtcgatcccccttcttccgccggcttcgcaggagtgccatccaacggcgacatcggcgccggagttcaggtaaaccagtaatgctcgctgcaatgcgtcttcacgcatctggtaatcttgcacatatggtgttcgataacatgattttttttgtctgcaattttgtagcacgggagtagaggaggacgaacaggtggtgggcaaggcgggcctcgtggagcaagcgaagggcatcgtccggctgttcccgatctgggcgacgtgcctgatctacgccgtggcgttagcgcagtcgtcgacgttcttcacgaagcaagcggggacgctggaccggcggatcggcgaccatatacaggtcccaccggcggcgctgcagagctttatcagcatcaccatcgtggccatcatcccggtctacgaccccgtcatcgtgccggtggcgcgccgctacacgggcgtcccctcgggcatcaccatgctgcagcggatcggcgccgggatggtgctgtccctggtgtccatggtgatcgcggcgctcgtcgagacccgccggctgcgggcggcgcgggacgccgggctcgtcgacaaggcgggcgtcccggtgccgatgagcctgtggtggatggtgccgcagtacgtgctgttcggcgcggcggacgtgttcaccatggtggggctccaggagttcttctacgaccaggtgcccgacaagctgcgcagcctcgggctggcgctctacctcagcatcttcggcgtcggcagcttcatcagcagcgcgctcgtgtccgggatcgaccgggcgacggcggcgagggccgccagctggttctccaacaacctcaaccgcgcccacctcgactacttctactggctgatcgccgcgctcagcgcgctcgagctgctcgcctacggctacttcgccgtcacgttcaagtacaagaacaagaacaagggagctctcctcgcaacttctacgtcctgttgatgatgcacacaaattgtgctttaggtatgtacatgaatcagctgggtacatatctacatatttaaactttggggagatgttcttaattatgttattagtgttttccgaatatcagcctttgatctatcacagtaaagatgaacatattatttttttatgggaggggaatgtggttttattttcgcgagcttttgaatgggaatggggccgtaccacttcgaaaatcctaaacgtcgggcgccggcgcggctgcaaaaaatcgggcgccgggcgccagccctggcgtctcccaccgcgcgcgcgcgccccgccccgccacctgtcctctgccgccctcgtcacgtgtccctacatatactctattacaacaaattactcatatattttcgaaactctcgattaagggaattcgttttattttttgttccataaaaaatatttcacctagtgtacttacaatgttttactatgtatagatataatgttacagcgaattgaaacattcttttacaacaaatcacccacatattttagaaaccctctattaagggaattcgtttcattttttgttccacaaaaaatgtttcacctaatgtacttataatgtttcactacgtatagctcaaatgttgcagtgaactgaaacattttttcgctatttgctgaaatattgtttttatataaagtgaaataacgcccaattttttgagaaactgttgtttcatacgttgtagcaaaatgttttacgaggtgatttggttgtgtttcaactttttaaatcattgaaatatttttgatctacctagtgaaataattactatctacttagtggaacaatttctatatacttggcggaacagcgtgcaatatttaaaaataattcaataataagctaatttttttttcatcggattatattaatgtgtggtcttgttttaaagatttaattgcaacgagtttagtggtgcaatcggatcgtgaattggataagtaatttttgagaaaaattagtttaaagtttatttaaaaaacttgacacatgcatggctgcatgttctgtgcatgcagtgcctaaaaataatctctctgtgcatgcgtgtagtagttttgggtcctgtgattttctttctcccggatcggatggctgggacggccggacggccgcccgattttttgtctccccggatcgggcgcccgatctctagtgccctccgtaccacttcgtcggtcagattgcattttttttcctttactagcaattagcagagtggcccgcataaatcgggtggctagcatcgttttattttttttccgtataatactctgcataaaacatgtggctagcatcgttttatttttttctcatataatagtttaaatattttcacgttttatgattaaaatatattaaaactagcaacataactttaaattatgtactaacttaaccaaactaaccaatcacgaactaactaatgcgtgatatttatattgtattgtatatatgtgatatattcatattgtattgtatatatgtgatagttattaattatttttaaattttgaattttagatatttctaaaatatactttttatggattctagattaaaactagctaggtggcctgcgctattatacggctagcacccatacaaaattatctttttttacatatgattttattaaataactatcttatgttagaactttaaaagaccgactttatcatccccgtgtttttaatagtcatgccaattactacgccttatttcgttttcatcgctttatttgctttctcgatctaccattgttttcattcatcctcgttggaacctttactgttggtgatatgggcccgggggtatcaggtttagagggaggaggctgccccccgatgccatgtggccctcccccaaggggagtcaggcccgaggtggggtggcggccactccttccccagatactagtcggaggaggctgccccccgatgccacgtggcccatcccccgaggggagtcaggcccgaggtagggcaacggccactccttcccagagactggatggaggaggctgcccttcaatgccacgtggccctcccccgaggggggtcaggcccgaggtagggcggcggccactccctggccgagactagagggagaaggccgccccaggcaccacgtggctcccccccgaggggcgatcgggcccgaggtcgggcggcggccgccccctcccgtgactaggggtcgggctcccccgaccccctctctaggtcaccacgtacggtgggttaggtgtccacctccaggtgcccacctgcccgcatttatggcatcccgagcggtcgcgccacgccgcgttttatgcggtgtgcagtgcacttaaccggtctgtgaccggtcgaatgactgatgggacccaagatgttaggcgcaccatcacgtgtgccaggcgacgtgcagcccgacatgggtaccgagctcgaattcgcc

SEQ ID NO: 41047 - DNA, 1023 bp, Oryza sativa
  unsure (1)..(1023): unsure at all n locations
atggctgttacggaatgtagcgaattctggatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaggtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcaaaatcagattcaagaaatgcagatgtagaactatcccatcatatcgatcgagcacaatctggtcatgccattcccagacattcattcttgcacaaagcaaacttcactcaagaatgttagataatgcatgtacaaaatttttgcccaattaagatgaaaaggatatatgcttttctctgctgaactgcatattctgaatcaatcatccatggtcatcaatactcaaaaattttgttggtatatcagtcatgggaattacatttgattttttctccctttgcacgtaaactcacagtcggcataaattttatacggtcctcacctaatgtttgggggttagtattagagtgggcaaattcatacatgtgagtgttacctccatatgtatatctgatgtacacaagttcatactgagctggtattatccaatgtacacaaaataaaaaaccttaaatttttttgagttcttataatgaacttagtagatatgtacttacaaaatnnnnnnnnnnnnnnnnnnnnnnnnnnnnnnnnnnnnnnnnnnnnnnnnnnnnnnnng

SEQ ID NO: 41048 - DNA, 5608 bp, Oryza sativa
  unsure (1)..(5608): unsure at all n locations
acgttcgattccagaaaaaaaaaagattcctaacgttgtgtaatccatcgtctatcatgtcgatttggttttttcgaagcgtcgttggttgaatgttctgacgtccgaatcttagtcttgcttgtcttttttttttacaacgagataaaattaaaattgatggagtggtttttgtttcctcatctattcttctgtattggaggccctacacatcacgattatcagactattttgttaagtatagctacttttcctgataacatattatataaaaataatattaaaaaaatacacatatttttaattgttatttggagagtacacggtggctttattttgtgtagacttgaccatgcgaggcagtgtaagatttgattgatcttattactggttgcaagactgagattgaaagagtattttagactatatgctaccacatgaataatccaattcttttgggtaaagcaagcatccacaattacattaaagatgttctaatttttcttatgatatgtcttaactgtaacgatctatacagacattatcattgacatggttatgcataaaaagtgtatattgatattggattgtttttcgcccgttgcaacgcacgggtatttttgctagttactataaagttgatgctcactactctcctaaaactcaacatgtaagtatgtcatatcatcacccacaagcaatatattattatctagagtattttaaatcatatacaagtatgtcacatcatcgtattttaaatattatgtcaatatgacatatcatttctaatgtatttttaaaattaacatgcaagcaatagctaaacaatattttcacatcattatcacattattgcttgcataatgtttaggtgaagttatatgtcaatatgtttaaatatgacattaaaccatccataaaattgacatatagagattagagaagttatatatgtcaattttaggtgaaatgatctttcagaaattaaaccatccataaatatttactccatttttttgctatccaatgccgttacgcatgttagatagacaattagcatgtagctatcagtttaggtgaaatgacatattctagtacatatacgtagtaatgtatgaacacctttggtcatgctaattattacgtgcaggtgagaacacatcacgcaaaagtaacgcattggatcctaaatgtgatagggccgaagtatttcagaaagaaccctggtttgtcccttgtaagagtattagtaacttgcccatgcaaatgtattttgcagactcatccaaatgcgtgtttcccgctatatatctttgcttcaagctaacgtcttgcagactcaatatacacaaggcaattcattctcatttgcagaagaataaagaatcaagcttcaatgaaattgccaatcgatcttgaaaagtgtcggtgttataaataagacatcactaatattttttgttaggctcgacaggacccaccatataccaaattttatatgcaatcatgcatcatatacgaaaggtgttccgaataaagaaagagaaaaaaagtcctacttaagcacgacaaggactactcttatcgtatccatacttgttttcctaatacaagacctcctagtaggagaggggacacacatgggaggcgaacaaaagcaaatacggatctagacaagccaatacaatacaatttcaatctcgccgaatgatattcgagaaggcagaatacactagccgccgaccacatgtgagagttctatgccgctaggctgatcgggactagattaaggcatccccaatgttatacttatgtgatattgatatataaacggcaacaccaacttcagccaataggagtagggaaattactcatcagttaagggatctgaacctatataaaagtcactatctcccgtctcttttacctcgatctcgcgtataccctgtcacttacaatccccatactctacaaatactgtagggggatttggtgcttcaaggtttcgacgagatgggtccaaaaggcgaatcttctgaacaaaaaatcttcgacgtcttcagacctaggagatatgacctgaccgaattatgctccacttcaaatcagaatcgtcatcgtcccaatctacatcaagacactgctgctacgaattttccgatgaggaagacatcgacgaattggggtctgggagaaatgacccgaccaaaatatgttactcctatatatcgtaaccatcgtcgctgttgacggtcctcaactaccaaatttgaccatcaattcctgcataaattttaccaaagtctaccaccaaatctagcggtatggatttattacgtactaaccaattccataattattggtgagtatttgtatgcaagtgattacttgtgcaaattaagagaaaacacaaataagagaacataattccaaccaatgaggagaagagtacatggatcaaagagcacacaccaggaggtgaaccgcctcaacttcgtccaaacaccccaaaacgacatgaggacccaccaggcagtgacccatatgaaaggtgctgtcagggggcttagccagggtttggccgaaccaggggtgttagcgccgtcaacgccggagagcttgttcagggacatgcgaggctcgtccgtggcgtagactcatcaggctggtcgagctcgacatcgatcgccagttcatcatgtaaacccgccgtgaatagctagatttactgctggtcggagagggcttcagacatttagcatgcgagcgtcaagaacatggtctggtaggcagccaccgtggatgtctgcatcagccgcttcagttcaccgagcgagttgcagtggatcggtggaccgaattggccatggcagaggtctttgaactcatcccacgtcggaggccccttgtgaatttcatagtgaaagtaccattcctgtgcgttgtcggcgaggtggtacgttgccaacccaacacgatcactgtcatgcgtcttctggccacagaagaattgctcacagtggttgaacctgttgagcggatcgtccttgtcatcatacttggggaactccaatttgtagaaacgaggaacgctggtagcgctgcccgtatcctgtggtcctgtcaccaatggcggcgattggcccgtcacggcaggcgtacccaggatgccactgccgcccaaacaaggtgcgatctgtggcgacgatgatgacatcgtgccctggagttgttccagggatgtgatgcgtgatgtggccaccgcaacggtccgactgagatcagctagatcgtgcttggaagccaacaatgatcacatccctggaaccttctgacatttggtcttggagcttggtgggcgagtcggtgggtttgagaatgggttgtttgtggatggagagatcttctgacaccatggtcttggagcttggttgttacgagctccggtgtatgatctaatggggtaggagtgagtaatcggtggctgaggtttcggcaacttaattagaagatcggcgacccgtggtagtggcacagaagaagagatgagaaaccagagaaagagatgggaaacaaagtggaatcttgcaagctgatttcaatcccaaatgccctgtaaataggcttacaaatctaacttaatgcctaacaaatatgaggaaaatgtggagataacaatccaatctcaattaaacttatcattggctaggagtgtagctgtccgacacggccgctgttaggcgcccgtgctcgcgtcgcctgctcctgtgcgcgctacaccttccgcgtcgcgtgtcttcctccttcggttgcagacgatgtgtcacgcccagaaattgctaacctgaattttaagcagaatgtgtattaaatatctgtccagggccagccacgtcttacaaaagtaataaaataaatctaaaaaatgcaacggaaaaagcaaataaacaagacttaatcttcacgaccaaaagtatagcttcctccataaactacaggcaatccttgacgtccggaacaagctcaatcctcagagaactcatcatctgaaccaatttctgcctctgggtgggtgggggtgggggggataaaacaagactgagtaccaaccactgtactcaacaagtcataccaacgggaaggtatgatgcaaggtattctcaaaggagtggctcattggatatttgcaataaaagcaacatttataaatcattattttgaatgagtaaaaacagtgtataattaagtagtattaaatcatcattgtccaacgctaaatccacgttgcaacaggtccaaccaaaccacctgaactacaccagttctataagtcatattattatagtgggactaatcacggtgaactggttgaccacccaataaccgcaagcacggctattcgaatagttttacctctgatcagaggtgtacaactttacccacaagacatgattccacacatgttaccatgctgatgttgactagggttcccgatcttccgaaaggttctaataggtagtcgatttggacggagtcacgacacagttcgatccggcttctaaacaaacacgctcttgagccccgcaatcgcagcaccacgtctcctctggttatcacccgtgttgaaacacggatgacctcgccgagaaggcaaatccctgtttgcgaatcgaagaacacaaacaagaacaaagaagaatacaaccaaaattgcaaataaatgataaagctcacgagttggggtcttacaaaccgatctagcggcgaaactgttcttgacagaataatctaagcaaaacccaaaccctaaatatgacgacgggtattgatatatagaatttagggtcgtgtaaacaacccttgacgcaaccctaatgggttccaacacgatacacggcctaaacgcccaaatacgatgacgcagcaccggaatagattatggacgttaaattgttcggtcgattcccgttgacttggaaagaatttgaacgtgggaccagaaccattggaaaggttatgttctaagttttccatccatataaggaacgccccaatccgtgcacatatgcgacttgggcgcctgttttagtgcagactggtcctggactctgaatcgtactcgaagtcgacctggtttgggcctccatattgacttggacgtccttgatgatcctccatgcctctaagtccctctctaagtccttgtcctctcctttattcctaatcacaatatattcattaggtagcaatctattctcaaaatcatataaagaagaatataggaacgagctcacctctaaattcaattgtcgcgcacgagctcttgttattggtccttgaatgaccggtggaggattgttgtatgtatctgaaggagtgatgtcctcatcacatgccctgaagtaccgccacgatactgcaaagggggaaatcgtgacaaaacccatcatataactctccctaaccaaacatacccatctcaggtttcaccccctccttatgccaagtcgggcaatcccctctcgtgcctaggtaaatccggaaacaannnnnnnnnnnnnnnnnnnnnnnnnnnnnnnnnnnnnnnnnnnnnnnnnnnnnnnnn

SEQ ID NO: 41049 - DNA, 3563 bp, Oryza sativa
aatccggaaacaacgagaggcaattatctaggtctgaaccgcacaatcgcctctacccttgccatggtatgttagctaggttaagttatactctagattaagcctggagcccatgctgcatgtgataagaacgagtatatcttccatggattcccgagaaccggtccttaattgtcatgggtacgacttccaaaatcatgcatgtacccacaacccaccattaaagcatattttagtttaattaaaccgtaaccatggtggtacatcatcatacaattaaggactaaattataatgaatcccattgtgagctaattgatctaagtatggctaagcattcctaaaccaatcacctagtcaattataactcaagttatcaatggcataagatattcaacatgctgagtacgataggcatccatcccacatgacattctaaaacaatgcaatttaatagaaagtaggggattttgtaaaatagactcaacatgatcaatgatgtatgtatgacttgccttgctcttgagctgactgaatctcggcaaccactttgaaataaattggatctccggaactgacggaatctaaacgccatcgaggcatactagcaatacgagctataagggctcctaagcagcgaaataacccaaatttttttatcttgttctggacgtcgaagatccatgtggtttatggtggcagctatgcttttggtcgtgaagattaagtcttgtttattcattttttccgttgcatttgtgagatctattttgttatttttgtagaacgtggatctagatagagatttaatacacattctgcttggaattcgagtaagcgaatttctgtccgtgacacgatgccaaccatgacagttcggtatcatgtcgtatgcaacgtatgccagcattcatgttcatatatatgtatagttgtattggtcggctctgataccatttgtaacgctcaaggccgaaaacgatgtggctcttagttttggatatacttttgagtatgtgtaaggaaaatggagggagtggaatatttagagaattaattatgggctaaatgaggttttgtatttgggatgggaggataaaatatattttcttgcaattattctaaaaatattattcttctgccaaggttggagtcaagctatagaaattaaattacagactagataggaattgactattggaatatttatataaaaaaattggatagaggagaattagagataactctagatccaaggttttggttaaggattaattcgaatgaaatcagaattacggtggttgaagttcaagggcaatatcagaggatttcttagaccataattcatacaagtaaaaagtttttcaattaaattaaataaaggaattttagtctaaaaaagttttgaaattcgaaaataaaattcaatcacaaaattcatcaatttagccaaatatatttttaaataaaaaacacaatagaaattaaatgttggttagtttgaggaggttactctaattattctcctaggtttagaaggttattaaggtgctgaattagaaaataattatttttaggatgttacaacagcacaggcgtggttcgagttttcacgccacgtgccgtcgaggcggtcgaagaatgcgttgcggctcagcaggagctcgcgcggagtcaacacatcagcgtaaatccaaattggcgcgctagggctagtcgacatgtactcgcactgtgaaaggcgggcgtaattaaatagaaggaaaactatgcaggtaggaaattaatcaccgcaagacaaagaataaagtagtactcactccgggttgataataattatcgttttggacatgagcatggtcttaaaaaaaattaaccattattttttattttaatatgtgtcgaatttttaacaaatatgtgattttattaaagtatttttttaaaactaatttatatatgtagtcactgtatttgaaagataaatattataaaaatgatttataatcaaagatactaaagtttgacctaactcctatgtaaaataataagtattatcaacccggagagagtaggttttaggtttcaaatcatcatcgatacaagttccaggttgcagctgcgagaagcacttatatgcgaatgggccatgcctgggccggcactgcccggcacgaagtgccgaccgtaccgtgccggcccgatcactggtgggccgtacctagcgcgtgcttgggccgggctgtgccgtgccggacgggtcctgtggccatctatatatgcgatatgcggcggacagtttgagaaaatgacaaaagtatgatgtagcacagtattacacagtgatatgtactaatcataaaaataatttttataaataagacgttaagtcagacgttggatataaccagtgcaaaactgcacttattttattttatgacggatgtagtactccctagagcgagaaccgcgatgcagtatcaagcaatcacagccgttgattccttctcttcacagtcttcagaacagagtccgattttcttcagagttgtgacagctgtcgatctgattaacgacgcgtgacgttccgttttcagcccttgagccttctcagctccgccacgaactcccgcacgaacctcctctgcacggcgtcgtccatcaagaactcccgccatttcttctcctcgccgccgccgtcttctcctccggcgaacgccgccgccagcgcgtcgcgcacgtcctcacgcccgaaccacccgtcgcgggcgcggcgcgcgacctcggtgcccacgcggagctcgcgcgcgaacagcgcggcgttgaggtactggtcgcccttcatcggcagcagcacgaggcggcagccggcgacgagcccctccacgacggagctgagcccggagtggttgacgaagcagcccacgctgcggtggcgcaggatgtgctgctgctgcacccacccggtgtgcaggatccctctccccttcaccctctcctccaaccccggcggcgtgagcttcctcagctccgcctcggcgtccgtgcccttggggaagttgagcactgcgaggaacggcagggcggtggcctctagtccgaggaggagctccgtcgcggcggcgtgcagcaggaaggtctcgctgccgaaggaggcgaacacgacggagttgtccgggaaggaggagagccacgtcgcccaccgctcctccagctcgcctcgcggcggctccggcacgatgggccccgtcacgagcaccggcttgccgtgctccgccgcgatgtagtcgatgtaggggccttccatctcggcgcaggtcttgatgaccagggcgtcgcaggcgttgtggcatgcggcgacgcggtcgtacacgcacggcatgccgtggaagctctcgaacacgtagctgaagtcggcggcctggtaggccggcacggtggcgagcggcgacgacggcgggaacccctccggcgccgacgcgaggtcgtcgacggtcgggcgccccggcccggggaggcggcggcgcgcgggggccatgacgtacgcgccggagaccgcggcga

SEQ ID NO: 41050 - DNA, 3637 bp, Oryza sativa
tgtataaccatattgcacgatgagcatactaagaagctaaagccataatgttgtggttgtagccatggctgccgccgttggtttgataattgtttgtaggcagggttgctagcttgctgattgctcaaatggcacataaagagtaaactctcgatttagttgatgtagtaagctctacatggattgatggatatgctttgaaccttttagattttcccctgtttgcaccaaaagagtaactcatatgcacttaacagactcatatgagtagtgttccgcttgacaaccaccaagccgaaataggtgctctgtgttatagctgttcacctaggctgccacttaggcgcttaacccacttggttaggcacttggcaccagcctgttgccagagcctagcaccaagggcagcaccagaatcgagatttatgtcggttattggtttaccctgataaatatttataggcaaatgcttgatttttttttatgatgatgtggaagctagaaattagctcaacatcaatcaggttgacagataacttctgggcagttgggaaatatgagctgaaattcctgattgataatcattagcctctcaacattttaacaatacaatagcctttttatgattggcatagtagtaagtaaagtttgcatgctaagacttgtgatttctctgtgctattagtaaacagctttcttcattttgtattatacaattattgggttaggggtaagtttatctaacttttttcgatacatggaaaattcagatttggaccatacttctgccagcctgttatcgctggacttggagaggacaatgagccatttatttgtaccatggactgcattggtgcaaagtatgtatcagttcaattgtgtttttgtttttattcaaattaatttcttttggatctattcatacacatctggatggttatccattgctcatgttctgcaatttactgcattgattaatatgcccgccttagtcttattccacatttagatggttaggtggggagttatctacatctttaatttataaatatgtttgtcatatctaacaaaggttacctcccaaatttctaaatcatcattaacaaaagaccccatgtgaatgaacaacgtgatttatgggttcaccattcttgtttctatcctgaattccatgacacccaaacacgattggctccgtctctgtcccagagaaatgtgtgcatgcttgacattggtaacttgctctatcagagatttgcttgattccttttttgttcctttctgaatttgatatattttttctatctgcttcatcatgtactgaaacaactttgatactattattccaatagcatgccacctgtttaagtttttggtctaagtccgtgtgcctgatatgtctgattaggcgtttgaacgcttgtttctcatattcttgtgagctgattgaggatgtttatttctgtgcagggaactagctaaggatttcgttgtatcggggacagcatcggagtctctatatggtgcttgtgagtccatgtacaaaccaaacatggtatgcatttgtttgtttgtatgatcacatttagcccgtgtaacattctttatgggataacatcatgggctatagcaatttcgcatttctgtttggatctgtataatatattataattctgttgcattgtactgtttagatttctaccactattttgaatgatagatgttacatgacaacatattatttttcttgacaaaggaacctgaagaactctttgagactatctcacaagctctgcagtcatcagttgatcgtgattgcctcagtggttggggaggctttgttctgcttgtgtaagttcacttcactaattcaagattggatgagtggcttcatttttcttctgttaaacagcttttgaattaaaatacgttatgcaccattattttatctaccgttctgcaataaattggtagaagttcatcagtaatgatttttttcccaatcaaatataattggagctcaaagtcctaccgcattccgcattttagttgtttcagcacttcatttgagcatcaatacgtttcttttacataatcttcttttgggttttcaggacaccaaccgaagtaaaagagtgtgtgatcaagggcaggatggactaaatttatcattgcgaagagttcttggaaccatttctgatgcctgctgttcctggtctctcagcattactatccgtgttgtatgtggattccgagggaaccttgtaatatcaaagatgttcattcacccgtagaagaaactgttgttttcttacttttctacgcttcctatgaatgaaaggacttctatttgttgcatgagatgtgcacttcttggcagtccttggccttgatgatgacgattatactgatcagtaagccggctactggttaattagctaagaatacgcgtatcgtggtgcaatgagctactcatactcacccttctcaggcatttgttcgttcaccgtttctatatcttggcaacactttttctgaaatggatgttagtgctttgtcgagtatggagccgacgatgtgaagtctattctgagtgcgagtcgttgcgactcagattttaagttacagtactaactacagttcatagcttgtagtgctcagagttcaatggtcttggctgctttacaaaaattggtaaaaaccgaggacgacttttggtcaattctatacaactaactaaaactgcttgtttttcacaaattggtctccaatgatttcatggaaatggagcgattttcgttcagtactgtaaaccctagtattgcaaaccctgttagtgcttccttcgttattttttactcaaactacaaaaaatacccatgcgttgcattgcaacgggtaagtgctattttaataataataataataatattatatatggtttgtgggaactcgcttggatccgtatttcatctcaagttagtatgcgagtttttttaaagagatttcttatacgactccttttgtattttcaaaatcaaacgagcttaaaatccaactcaaacacaacgaacttaaaaccgactcaaaacgtaccaaaatttttgcaaaaacaactctaatttttataatagtagagaagagatagagatatacatgttttttttgttattgtttcgagcatcaatacaatctcaaatatgtgtttggtcattgtttcctccaactatagatgtattgaaccccataattttttctacttagatattgtttagattctaacttttttcttcaaacttcgtgtgtgtttagttcacgttaaaattaaaagtttggttgaaattggaacaatgtgacggaaaagttggaagtttatatgtgtagaaaaaattagaagtttatatgtgtagaaaaaattgatgtgatggaaaagttgaaagtttgaagaaaaaatttggaactaaactccgccttataacttttcgccacatagaactttcgtacacacataaacctctaactcttccctcacatcgtttaatttctttgaactttaattttagtgtggaactaaacacagcctaatagtatgtactgaaccaagtcgtcactaagaagtgcataccattatctgtcg

SEQ ID NO: 41051 - DNA, 3031 bp, Oryza sativa
  unsure (1)..(3031): unsure at all n locations
ctttcttttaatgcttgtcctctcgatcgtaacgatatcgcgagctggatttgcccgcggctatgtggtgtgtaatagtagtggaatgtaaggctaggaattcatgtgtgggttgggatctgcattgggatttgttggtttggagtgcctgcgttgctactgattcagagttgttttagagctttcccctggatagggttttgaattcctgtttcttttgcaaggagtcgagtatgggtttcaggtaggactacttctgcggggatgggtttagacaaaccgagtgcagttcagcttcatgatatgcggattgatttggttgtatatgtgctgcttatttcaaagactctggttttgtctgagtccatcggacataagggctttggatttctatattaggcaattaggcatgttcatactgttacgcataaggccataagtacaataattgatttcgtatacatatttgagcaggctgatggtgattttattattcatcattgttcccattgtgaagattagctcttttgtttgacctgcctgccttgtgctagcctcattctttgcacttggtgtgtttcccaacatctttaccacatttaacatgaaatgatcctagaacgcaaatgaagattaacctactagtcctagtcaattctttttcaccgtcaagtaaatcacatgcctcgttaacaaaattcagtaattttcaaacaactgggaaagttccttgaagatgtttccttgtattaaagaaaatgtacttccatgaagaccacataacttctcaatctaggtttcgctggaaagatgatgccatatcaataggataccatgaaaagttccattgcttgatgcttcttacggcttatgcttattgatctgcaggagggaaggaacaccatatggccacataaccctcaaaccggatggagttactgtgtgatgattccttcttggatcgctcagacacctgaagctagtgcgactgctgacaacttcttgaaatccatagttgtgagtactgcttatattatcatcacgttatttttgtcagtcaatttggattgacgtacagattggaaatgttgtgtctctggtattaccgctatgctacaacataaatgtgcttggagtggattacaagtgagaaaaccttgttagaccaataaaaaggacaaaagaagttcagcacttatcaacgaagaactgagcttctttcaaaactatctcatattgggtagtggatgccaactttctaatgtattacctttttattgttctttcattttgagtaaatcgtgtcactttccaatattccaccatacttatcaaactagtttattaggctgctggactcacaaaactgtacttttctttaaatcactaaagggtcacttttggttgttagcacactgtcctgactcttaatgacaacatggcgtgttgaggcatacccctgtatggggtgcaaattttgttgtgataaccaatcgctgacgtgcagtacactagaggtgattctccctctccgcacaactgcctcacttgtctcagtacacagggggtttgagttgggggtgagagagaactatgtaaggccaaaactcatgggggacaagtgcaaatcacaatagccatggctgaagtcattaactcacgtgcagcccatgccacaatggtgtatgccaacatgacatgccataggaagtattgtgctaatgattcagggtgacctactggcagaaatatactttttggtgttttggtaactgtggtgcatcttacctctcttttggctcactagtttagtcgtgatcgacgggcaagagacacttatgtaattctgttgcatatatcatgcaattcctgtttgttgtgaactttgatactgttctgtttatgatctcattttaatgcccataaaggacagttttacaggatacatgttggtatacaatctccagaaggcatcagctctagccacggagttcttcgaaggtttagtgactttctaaagttatcttctgatgtaagttgagacacctctttgctattttcttctttcacatgccaagtgtctttaaattgtaccgaccttctttcctgagctagaagcccactaacattttcagttggaacatacctttcaagaacaacctccagtgatttttaaataagaataatcccctatcgtatcctgagtggtctgccagattaatttatctggcattaaatttgaaaatgtaatcaaacctttgaattggacttgcatgcctgcaagtcgactctgaatgcacaattgcttgcttctccagtgacttccgttgcaacttaggatttttggtgcattgcatcacacaggtagtcagacttcagatactttaaaacatactgttattataaatcttgacttagtgtatacggtatgcttacctgggccaaattagtttttacagatttttgcatcttccgctggtgacttcataatgaggacttcaccttttgcaattttatggtttctataatgaatgtggacattttggaagtctcatcttggatatgattctgagaaaaaaagattattactttccattcgacctctaatccaatatcatttcttcattctaagattctcccgtactgcagcttaagcaggaatttcccagaaaaggaatcccccctgctccaccgaagcatgccttttcaagaataaattcaagcagggtgcttctagaagaggttagccgttatgtatattgattaatttttgctttgttcgatgtcaaatactacattcagttgtgcttagcctttttgaccggtggttcttgaaatgttttgtttgcagagaaggaacgctttggaggagtggatgcaaaagctactttctgacattgagttgtcgagaagtgcacctgttgctgcttttcttgagctggaagctgctgcacgctcatgtatgttccgnnnnnnnnnnnnnnnnnnnnnnnnnnnnnnnnnnnnnnnnnnnnnnnnnnnnnnnnnnnnn

SEQ ID NO: 41052 - DNA, 2420 bp, Oryza sativa
caggaatttcccagaaaaggaatcccccctgctccaccgaagcatgccttttcaagaataaattcaagcagggtgcttctagaagaggttagccgttatgtatattgattaatttttgctttgttcgatgtcaaatactacattcagttgtgcttagcctttttgaccggtggttcttgaaatgttttgtttgcagagaaggaacgctttggaggagtggatgcaaaagctactttctgacattgagttgtcgagaagtgcacctgttgctgcttttcttgagctggaagctgctgcacgctcatgtatgttccgcttgacatattctattgaagacactttttcctgattgtgcattgatccatttattaactaaaatttcttaacatttttagcaaatgtttaattacgctatttttctgaatgaaagattaccaagattggaatcagcgcccttctgaagtgggttcttcagcaaaaagtagtgcagattcttctccgcgtcctgatgaacatggttcaggtgttctctctgagtccagtcaaatgaattcagcctttgctcatggtaacggtccgacaggagcaactggtaatggtatgctgggagagtctatcttagatcagcccaatgagcgggctagtagcatgtcaaatcacaggaaaaagaaccatgtctttttggaacatggtgttaggaatggttccatagatacttataagggagtggtttccgaagaggatcacgattctaaccctggccatgccaggaaggactctgctgaaagtataggaagtgatttgagttctttgaggggcagtgaattatcggttcctggagttagtagttccctttgggatggtcctgtggatcttccaagtggaattgatggacatagccaaacagaacaatttacaggtttagatatgcagcttttatatgatatggatgcacaaatcatccttcctgctgatcaaaggccgaagttgactagacttttgatcagcatggacagaagacaggtgacagcaaaaactgatatggaggatctcatagcacgactaaatcaggaagtggctgtcaaagaatatcttgcgacaaaggttacgttttctacctgacattcatttgtgatgcctatggattatgcttaaacacatgatatgctttgttttatatgtcacgagtttaaaataaattgatttgtgtttttttgttcatactttattgatgtacgttgttcttgtgcttctctgctattctgtgcaggtcaaagatttggaggttgagttggaagctacgaagaaaaaagacaaagagattctacatcaggctgttttgaccgaaagagagaaaattacccaacttcaatgggataaggatgagctctacaggaagtactctgaaatggagtcaaacctgaagattgaacaagttggttttcctctttgtctcctctttgtcatcatggcttggtttcttactatccatcttacaagtattttcttacatttctttctacttaattgcagaatgagaaaactcgtgtgcagtcagagaaaacaactgctagcggtgaaaaagaaatgttactggaagagctagaaactaaacgaaaagaagttgagagtttgcagcaacatattggagaattcgaggcaaagtctaaagcagatataaaagttcttgttaaagaggtgaaatctcttcggaactcccaaaaagagatgaagaaagtgctgaatcagtatcatgaggagaagactgaattagaggtataaatgtaaatttaaagcttttctttctcgcagaactatgatagtatctataaattgtgtgaaattgttgctatggctggcctctcattgctcaaagccaggagagcataaccctttacaagttgcaaactagattttggttgtagctaagagaaagtggcttgtcaaagtcattagacaagtccccacaaaaaaaaaagtcattagacaagagtaagcctttgaaagcatgcaagccatcttgagtgtttgcttttccacttctaacttattaccctgatttctgcatctccaccacccatgcaacatgttgtccatttttggaatattatcatgaattgttgtacttgcctacttggtatctgacaagatgagcttaacagtcttcttttgatcaacaaacatatggaccttttcccttttttattatataaccagcacagccatctattctttatgtgattccttttgtcaaggccggctgaataaagatttctatctacacaagctagattcaacagcgatttctttatctatatataatcactcttggaggacaattgaattaatttaatgctacctgtttgtacaccacttaactaaagaaattgagagagagaatgaaggggtgaggtgttctt

SEQ ID NO: 41053 - DNA, 3042 bp, Oryza sativa
  unsure (1)..(3042): unsure at all n locations
nnnnnnnnnnnnnnnnnnnnnnnnnnnnnnnnnnnnnnnnnnnnnnnnnnnnnnnnnnnnntaaataaattgagagagagaatgaaggggtgaggtgatcttttgttgttttgctttgcacactatgatatggttgatcataagaccaaggatagtgcgatcttctcaggtcgcgtgggcttgtcctgtcacggctagaggctttgattagctagggtttgggcagaaaccttaccttttatagggataactcaagactgctgctatacacacccgtgggtatttttcatgtaaatagtagtttgaccctcaagaaggtcattactcttccgttcaggaatataaggtgtattttgactgtccaattttgaagagctttgacgaactattaatccaataatatttaggttttaccataagaaaaggatattattggattcatgtttgaaattactttcttatgactctgattttgacagtgtaaaagtaccttaaaaaacatctttaattttccagctaaatcagatccttcctaagtcctaactgatagatagggtacaaaataaccaatcccatgctttgaaactaataattatttaggcaatagatattcttggaaggtatgtaaacccttcccatattctgttctacaatatgcattactgtccgtgcttcaagcatcaacgctcataacagctgatttatcaacaactttgatccaatctatccctattaccattttttgttttcttaaattcaagcttctggtagttatacttcttgcaatcggcattctctctagctactaattgtatttattatatattacagaggattgttaacagggagaaacagcggtcaacacgtgcaaggttctcccgtgaaaaaattcttcacgaatgcagactgctccgtgagcgtctacaggaatgtactgccaagtttgttgcagatgagcaagacactatgactattgatttatcatctttgcctgatgctttagatcttgtgacgacatcagacaatagaatacgtttgcttgttgctgaggtaatgttttaaatatcttttgattagttattgtcattcaaactccttctagcttctcacgggaaaggcacacttagaaagttgagctcaaactccgacggaaacatcagacactacctgacactagattcttcaaaggatctggagtcagatttggaacaactcctggcctaaattgatttgtagtttcctcagcctctgcttatgtttgaagtttgagccacctagttgggccttcaaagctgcattcttgattctattggaacaaggtttacgtgttagttttggttagctctggggaacagttttcatcttcccagctgaagagtgatatcatttcagagtcagtaaaactatatttaacaaaatgagtaaaatgatctatattttcacaaactttttttcctattttacagtcatagatgcatttactttagattacatactggcgccactatacctaaaaaagaagtcttgccaatgaccaatgtaatggtcatcttggtacagaagacattgttttcagtgttatgtacctgtccatttagaaattgattttgaatattcaaagttacgcttctgttttcatgaagttctcacttccttgtgcccatgaaagcggatctgttagttacatttacattcacaatctgtgttctataatgatcctctctcaatctctcaggctcaacttctgtcacgagatgatgaacagggctcttctgatgatggtgataattctgatggtaaatcctcagttaccatgagcagtgaagatgcatatgttactgatgaagagacaacaaaaatgttatctgatctgcttattgacaatgcacaactgaggttgcgcttgaattctctcatccgtaatgctgtaaatactgctgtgaagacggagaaagaaggtagtgatggaaccgtgccaaaaaagacggtgcttaattggttattggacagatagaaaaaccagtatatattcttgtgaattagctcttctagttatgcggccttctcaaagttatatgatgagtattgttataatgtgggagtaacaggagtggagaaaaaaaaatcaaaatcttccttacatgcagatcaagcatgtggtggtgttgtatctcttatttacaaagattgatcaaggataatatatttaggaggcttctgagcctggcctcctagcgggagaacggtagggctcatatggttttggggaggcttgcaactggagtggtagagaacatgggtcccccttttttgcaccatacttcaatttgtaattgccgagctgatggatagctgcatggttgtatctttgtacagatgtttcagatggtgagttcccagcaggaaagcattgtacactatagttaaactctggattaatcttcttcacccatagagtgctcaactgttaaatcagtacttcttactcatgcagttgcacctcttccagactgaaaacttctcaaagttctcatgttgcatacagctggtaataagagcgtaatttactcaggcatggacacctgaccctgcctgatgtttagatcattacgtgcgtacctttatacagatggtagccgccacctgtgtaatattttccatgtcactttcagtctttcgttagagttttcaagtcgctttctattttactttattaaatgttcttgacaagattaaaaggcgtatcctgaaattttttatccagatgttcttttttagataatagaatctctactattataaaaattaaaaatgtttttgccggtactttggtacgtcatccatgtgatcgttcgcttttagaaatatagataagtatttgactcggattttaagttcgtttgttttaggaaatataaaactaagtcgtataaaaaaatcttttaaaaaaactcacatactaacttgagataaaagttggactcctgactgcatctcatatttgttgcaacgcaccggtatttttttttctagtaaaagaaa

SEQ ID NO: 41054 - DNA, 2027 bp, Oryza sativa
gggtggagctcgtcggcggcggctcgcgacgacctctacggcggatctagaggggggcagcagcggagctcagggcggagctcggcggtgtcggtgacggttctgaccgcgcgacgacggggcggcggtggccaaccgtggcgacgacggggcggcggggctggccgcggcgacgacggggaggcgggggccggccgcgcgacgacggggcgacggtggccggccgcggcgacgacgaggtgacgacgccctcgtcacatgtgcatgccgcactgctgcatggagagagagagagggggaaacaggcgtgggtcccacatatggctagccggttttggctggccaactttagctagtctggtggggaatttagacagccggatggcttggagaggcatttggctagtctgttggagtagattttttttgtgtaagttagccaaattttaacttagagagccatttggctaggctcttggagatgctctaaggcctataactacaagatcattcagaacgatttgatctccattgtttgcacttaagtttaccagtacgtcgttagaaattgaatttttaagttgctcaaagtatatgtatataaaatttacacattattttttcgctattaagcgttgctgcttatccaaacattagcattgtttagataggtgttgtattcgctcggtcttatctctattctaggtttcggcaataaacctactaaatatactttaattaaacgtatagagaaaacacctctagaactatgtatttacggttaaagacttttgtcctacttgctagcgactcaattacatttataaccttcctagccactttcctcattttcccctttttcaacatttcctcttcctctcccctgagggtgcgccaccctaacccgatcttccctatctccagcgtcacctccatctccctaccctacgatgccactcaagctatcctgttaacatagaaccatctcgaaattgcttcgtagtcatcacgcgacgtgtgattcgttagaatcgctctttgcagatctacctctcagtgtccaaatccgatctgtttattggtgtcaaattttattgtccactgcaacatgcagccttgactggccggtggtgggggcggttgacatcgttcggccacatcgtcgtcataccgagcaatcttcgctgaccataccaccgtttttctcgtgatgtcatatcttcaggttccacttacctattctcatcttctcttttaagactatcctattgtgcttgtctcttggacctcctagtctcttcccgagacaacgttttctctgtaggacatgctgataccgagacacctcatccctttcaccgcggtatcaaacccatgtaaaaataaaaagcctatataggagttatattgccggggaaactttttttcttaaagaactacacgagttgtggaatgtaattattatagggtcacattgctggagatgcgagtttttttttttttacttttagaactttattacgagttgtgaatgtaatttagttcaagtcacatggtcttttcaccattgacacggcacccaagcgaaccggagcgcgtggaagatgggaatcgcccctccgcggcacgagtccacgacggcaagaaaaagcgcccacccggcccacgcaaaaaaaaaaacaaaaaaggtagcactccatctgggcccacctgtcggcaccgggcgcgtagcgcgttcacgcctcatcacagtagtatcagtagagagaaagaaagaaaagaaagaaaaaaaaaaaggaaaaaagccgacgtaatcaatgggggacagcgcgatcggtccaagttaccgtcgttaaacgatcgcgagctccgcctccgcctccgcctccgcgatccgcctccgcctcgagcccaaacccacccaccaacccaacccaatcccatcgagaggaggggacgcggcggcggcggcggatcggcggcgggggaaggaaggggatgggcggcggaggcggggagtatgacgg

SEQ ID NO: 41055 - DNA, 2077 bp, Oryza sativa
ctatacccatgactatgagtacaccttagagatttcatctctacatgtaatgtttcttggagttttgcaaagctacactctctcattcgagaaagttgtggtttcctgcctgcagagactaggcaaggttgatgagcactgaacagctgtgtttatattcttctacactatatcaaatgattgttgcatgggcaaattcatgcgtgtatcctttgttagttctgcgtaatgtttatcctttgtagtaatgccaggtatttgtgcacagtattatctctatgccatataactaactgatcatggtttctgaaaattcattttagttgctcgaaggagctcttgatgcttctggagatgatttggattcagcaataaagagtttaaacaatctgcgcttggagtctacagaggctatcttatcagctactggttgcaaatctgaaaatgggctccccacagcagtttatccgtctgttgaaggttcagcttttaaccaaaagctttttatttctaggatctgtgcatataattctcatgcactagtacttcttgcttttgtcacacttaaattttagacaccgcagtaccaatctatcataatgatccatgtgggtcatgatatactctttcaaattgtctatcaatattattcagagatctctagccttgctggtttctttgatgtctgttcttatgtttatattctgcaacagtttctttgatgtctgtcttatgtttatattctgcaacgtaatgcgctgttcaattaaagacactgcacacgattcagtcaattatgttatatggagtgtgcatgattaactagacataaattctgatgactgcatccacatatcttctatcttccattcttttgtattcaccatatttagaatagttgtgtattccttctcagtgtgtccccaagctgtcaagttctcgcgttgcattttctggctatatactacccaagttctttgtattttttctaccaaaatactgccaggctttgtccagcaatgttaaactatattattaaaagaataaaatatttacagaacgattacaaggaaagagaaaggaaaacccaagccaattctaaactatcgtttcctctcacaacacatgaatcggttgcatctcactcccttgtgcaaatgtagcatactgtatatatgacaacagcaactattttgcatatcttggcaggtattgttaataatggtggtgtgagtacagctaatgaacacccagctgctgcagatagttgccagacaggtaataatggttctgaatgggttgagctatttgtcagagagatgacaaatgcatctgacatgggcgatgcgcgtgctcgcgcctcaagagctttagaagttttggagaagtcaatcgtggagcgtacaggagctgatgcagcacaaaacttgcaaaaggtacacgtgtgtctatcttctctagggtgtaaaaaacatcgtagtgtttggtcagcaattcggcatgtagaaaacatgcatcaatgcatgatttaggagtaacaataacattgaatactttcatatttttctttctgtacaggaaaatatgatgcttaaggagcaattgaccgtcgtgctgcgagagaacgctgtcctcaagcgagcggtcgccattcaacatgagcgccaaaaggagttcgacgagaggagccaggaggttcagagtttgaagcaacttgttgtgcagtaccaggagcaactgaggaccctagaggtggcaaccacaatcctatctccttttgcaagtttctttctttttctgcctaacatacatactgatgaagaatctactggggtaaaaaatgctgcagataaacaactatgcgctgacgatgcatctgaagcaggctcagcagaacaactccatccccgggcacttcaatcctgacgtcttctaacttttgccgcaagacggtctgtccagaataataatctctgaagatgtcatgtgttgttggtgggaaatgaataataatctctgaagatgtcatgtgttgtgttgttggtgggaaattgcctactgcctctgcgataggaga

SEQ ID NO: 41056 - DNA, 1528 bp, Oryza sativa
  unsure (1)..(1528): unsure at all n locations
gatcttatgcaggaggggacaccagcgtagaaggtggcttaccaacctccttttctaattccggcgccaatagttggggacattggcggcgatgaggtagacaatccattctgctaccaaaggtatctcccgctccatctccctgccaccaatacgttcttctcatgcaatgaaaactgctttgaatggcattgaaaactgctttcaatggtggatgtagcacatatgaacgacgggtggttgcatacctaattttttgtatgaaaatanctgttaggtatagtaagtactagaacattagcgtgccggttggcatgctttctttatagcagttatttcaacattcatgttccatcaaatattgtattatcttgcatataattacgagtatatataatctcctgcaatgttaatatgggattaattatatatgtttaaagcaatctatgtttccggtgtcgattaattatatatgttgagtttctaccaatttattgagataattgatattagaaagtattaagaaagtagaaagtaggtggagttaaatattagaagggtctctgaaaaaatattagaagattgataagtttttttttctaaaaaaaatgactgattgtaggcaaagaattcatgggaagattgtaacttacaaagcttacctcgataatccataatactctctatgtccacaaatattagttaagttgtggcctatgggcggtctttgggttcacttcacccctcatttttgtaggtcactataccatgttgccctctctttttcagttgagctgaaactaatttacaggagtatactggtgtccatgaatgcagcctgtcacacttgttttgttccctcgtgcatgacatgacatgattaatttgggacccctgctggctgcagctaactagctagcggctgttgcttgcttgacctgtttattttaaaactactagtaacagtaagagtagaataatcagtaaggagttctgaaaccttgccctgaacagcttcagcttgctccaacagtccaactgcacccacgaatagttaggagtagctttttcatatattgccattcttaactagataatccccgcaaaaaaaattaactagataatcttgctgttgttatacgagaaatagcatggatgcttaacatttattgagcgcaactctttttcgaaggttataatacaagtccctggctctgatccattaactaggacacacacacacacacacacacatatatatatatatatatatatatatatatatatatatatatatatatatatatatatatatatatatatatatatagagaaaatcccttgtatacccttgaaattttaactaatcccttctatgcctctgaattttgcttactttcttatatacccctaaaatttgattttgatcccttccatacccctcccgtcagttgattgttagttgaccgtctaatttctataaaaatgaccattttaccctttggatgaacatagaaatttatgaatt

SEQ ID NO: 41057 - DNA, 6422 bp, Oryza sativa
  unsure (1)..(6422): unsure at all n locations
nnnnnnnnnnnnnnnnnnnnnnnnnnnnnnnnnnnnnnnnnnnnnnnnnnnnnnnaaaaatgaccattttaccctttggatgaacatagaaatttatgaattacattattaaaaatgtaaaagcttctcacacgagactattatagctatgagtttgttgtgcgatgcattatttatcccaaaaaatatttttagataatgaaataaaaaattgtgtatttatttttaaaaaaagtaataaaaaaaaggatcattcatacaaagataggacaaccaattttcataataatttttttatgaatgctcccgatcaaaaaaaatcattgtcctattaaaatttcaaataaaaattttaatttattaccttttttatttccaaaatttatgtcaaaattttctgcactaattatttagtctcattagtttcataaaatgcacgtactgtgcactcaaacaaaattttcaatcgcttttaagcttatattcaaacctatagcatcaagggcaaaaaaagacatttgcaaccaaatgtaatagtgaaataatggaaaatgtaacggtaggggcagggtaccgagctcaaattcgaatttcaggggtatagaagagatcgggtaaatttcacgggtacgaaagggactgagtgagttttcaggggtacacagggaatttactcatatattatatacacacacactgatgtactctgatttttagctatcattgccatgatcagtccctttggtctttactacattttagacattgattgattcggtgatagattcacctttacatcacaaatcgaaatactttatttatatgttgggggtctgtcgcatctgattttcgttttaggatttataaattatttaataaattatcattagaatttatattaaatgttcattaatttacaagtgaagttaaatgtgggaaataaaattccctaaatataaagcatgactggatttaatttttattaaattctccataattaattatactatctggaattttctcggattttttcagagctcaattactaattttaataatacaaagattttttcagtaattagttaatcaataaactaatcattaaatgatctatatgtaattttgttaaatgttttggttgtttaaaaatccttaaattataaattgagttattataaatgatcttaaaatcctaaaagaaaagctctaagtttagtttaataaatctcaatgtaaaaatggtctagataaaactttggtaaatatttctcttgtttctttagtttctggattttttgggatttatttgagccaaggaagtatttttaataaatggaattgcattccatgaataaatttaaatagaaaaggtttttaaaatctcccttttggctttgggccgaaagtcggcccagccttccctctcttatccccggtcacgtgcgctcggcccaagtcagcccaggccaagccgcccctcctcctctctctcagccgccgacatatggggcccacatgtcggggtcttctccttcctccagccgctcggccgagtccgagccgctgcgcctctctgccaaattcgctggcgaccatgatgtcccaagccgcagccggtgatgatgtcatgctgacgtcataaagccccttttcccttctaaaaataaatcttaattgtgtcataaatcataaatccttttctgtataaggttaaaatcagattaatcttaaaaaatccatttctaattcattgtaaatcagattaatgtgtttcaagttgcaaaagtgtataaaataaagatctatatattaaaattatatataaattgtgttataaatttatttaatcttttttaaataggtttaattgaattaaatcctgtaaaatttatgactaattcatatgaagtcagaatgaggccgttcaagtctttaaattcatctaaaatcatgatctacatgtttgtttactttttatgtactgtttatttggtttttattagtccttttcctcattttgcgtgttagcttgtcgtttccgtcgttgcgaaggttcgtgagtgcgttggaagtgttcaataagactaattgaagaccgattattgcaaggcaagttgatcctatatttaaattctttatttatttcaactgtgcatttaatttcgaatgtcatcgggtggtgtgaacttatacctttgctatggccaattttcattgattatcctatttcttgataccttgggctataatttgactagttggactttatatattggttcgactagatattagtataattgcttagccatgcttagaaacattagcacatgattgggatgattaatgtttcactattacttaatgatggatatttaatggtagctcacgatggtcaatcgtgattggttattaattacttgtcaactaaaacttgattaatggtgagttgtaagcatatggttttgatggttgtgctcatgacaaggaccggttcgcgagctactgttgtgagacattaaccgtgccaaccacaagctagcatgggcaacggctggacactttgtgtagcaaggctcaccgtggtgcaccagactgtgaagcggcgagaagtccgtgggggtcgctggggagttcatgcctctggttattgaggaggtgattatgatccaggaaaggtgcgttgctttgagttgagttatgcgaggggtcttgtcacaatcactcgccatggtgacgtgtctgcgcggacacggtgacatgacaatgggttgtgtcttgtgggtacagtagtacatctctggccagagtaaaactattcgaatagctatgcccgtggtcatgggcaagttgagcaatgtttttcgtgattagtcccacactactcattaatgataataatgtgataattaatttggcttctggtttggaatggcttattcctagtttggaggtttgatctgtacgaccagggttggttgtcaaggtttggttgggcctgtgcagcatgggtgtgctattcagtgttgattaatattgatgattaattactctactgttttacaattcttaaatgtttgctaaatgctgcttttgcaaatgagcctatattatgccatcctttggtatatttttgcacttgcatatttgctgtgtgtcttgcggagtattccatgtactcaccttgcaataattaatcaaaccttagttgaagaaaaaggatctaaaaggagcagacatttagcttatacctcagttgagctgcttatgggagtggagccggagcttcgctagaccgttaatccgctgttgtttttcttttcttttgtaagtatgtaatattattattatgacggatttgtatattaaattgtcagtttgtgtacctcggctgattcctggacaaggattttatgcacaaattagttcagaaattactagtgaattttcaagtgtgacaaggttcatgtctctaacaactgatcccatcttgtattggtactgtgttttatcctttccaggacaatattggaagacgatagcgaccacaagctcctattgagaaggcactcatcgggcaaatcaacattgaggatatgagtggaaaagctaaggatgtgattagtgaggaggggagcaccaaggagatgaaggatagcgacgatgatgttggcatggtcattgggggatatgcacaagatctatacaatcatagcggcctagaagaactcatgcaagaccaagatgcgttggaaaaatcggtaaagaattttccggaatgttttaagagcacaaaatttagatgaatgattaaattatgtgttgcttttatgctggtttggtggttatgaatgatggcctaacatagtatcttgaagtgtttggacttttggtattgtatatggaagcatgtgtaattatggtagtacatgagtggtgatgaatggtatcctgcaaaattattttaaaatatgatcgtttattgtggtaaatgaaattaatatgatgtttctaacattacaaacaatatgacgatgatgcatgcaatgcttatgaaactcaagaatgatacagcttcccacatgacatgatttactcctaatgctgatattacatcgtcatatatacaacctgaaaactgcccaaaatatgaaaccatgataaacttcccatattacatatttcaaaagctgaaaccatcataaaacttctcacattacatggtttgttgcatttacttgcgtaacactgatcttaacttatcatatatacaacctgacatttaaccaaaagttgaaaccaggatagtgctttaccatattgcatgatttactgcacttggttggctaatgctgttcttaccttattatatagctcaaaaccacaactaagggtattagggagaatgtctagacgctctagcctctctttacccatatgagggatctcgtatccatttccaccattagctttcataacctctaacaagcaagattgcaatgttaggaacaccctatttagcttgttctcatcataggcctgatgctcagcattatctattaggtcatccatattcctggatatccttctatatgttaatgattgtagagacgcaaaaaacccaagatctagtgcattcatatatggggaattaggaggctgatgcatgagtcggatgtcaaacccttttgggaaactgcataggcaaatcgaggatcatccactaggacatgagaaggagcattatcctactaaatccatatactgttgtgtgtttcttctcgaggccaacttgctattatagctggtaggagtttagcaattagaaatgaccttacggtatctcgatcaaccttgattgtcttggtgactagagtcccccttggtctattatgacttgtcctttgcggtggttcctaagtagtacaataatcaagttagattaacaattaatttagataaaatcactaagtaaaaatgcatatatgaagaggttatggtacctttctggtgaaaggccacaagcctatcttgccgtcaaaagtgcagataccttcttcattgtatctaggcctagcaactgctgccaagaacatcattttatcaatagaatttttgttttggacaggtctgtatggatcatcctcccaatggaccatgtaaatggttcttgtccttttagttgtattgaaccattttttatctatgtgtacagtgtttcgcatatcaatgaacttgggttcatttggcaaagtatgccaatctaacatggaaagacaccaccgcagccttgatggtttattctcttccttcaacaatggctttagtgtgtttgagtgacatcttagcagcacttctttcaacatcctatgcaacatgctctttggtataccagaggctgatgcaaatgaccgtaaagtgccccttagttgcaagggaacattagcaacatctgtcatgttgatttcattctttttgcaaccacaattcttttttttcctagaccttacatcgattggtattccgtgggcaagacattgcttcactcttcgccaaatagcttgcactctagcccttttcacattaaacattgctgtaacttcagttgtactacctctgtttcaggttataagactttctagcattgtccacattcatatagatgttaatgaatccaggcgcatatatatatatttctagattcattaatatatatatgaatatagtcaatgctagaaagtcttataatatgaaacgcaggaagtaacatttttttcttagggttccattgttagtttttccagcaaatgcagcatatatatgttgtctttgtattttggtcagatttttgttttgatgttcatcttcctaacctgaatcatccaactcctcttgttcgaaaacaacttccacatcacccgcatacacgccgtactcttgcatgtctacaacaacaattataaggttagtcatctgtatcaattcagaattttaatattttattgtcatgtatcaacattcttgcaaaattatggcacaactttttaggttcaccacgtggttttatttgtaatatgatttaaccatacatattagatctaagtgcgacagagagacattgacacaatttagtttatgtgctttctttcagattgctgtggtagtgaaccaattgacatgacaattgtatgtaaatacaccatatcaatgtatttattggtcaatctcattattatttgtgatttactatgtgctgaaatgtctaatttacaatccttaattgttattgcaactaatacaaccaatgacatggctagacgtactattgtaggtagttggcatgatataatattactaacttctaatttaaaacatggtttcagataaataatattattcttcaatgatcctttgggtaaaaccac

SEQ ID NO: 41058 - DNA, 789 bp, Oryza sativa
ttgcaagtgttatgggctctgttccgcttaatgttttctttaggagagctttagttggacataatctaacatgttggtatgaattgtgtgcttctattgctcatatccagttggatgattcttctgattgttttagatggaattatcatcagaatggtcagttctcggttagatcaatgtacttacatttaataaataacggttacattgatagaaataaggtcatttggaagcttaagatgccgttaaagattaagatctttatgtggtacttgctaaagggagttgtgttaactaaacataatctagcaagaaggaattttaatgggagtttaagatgcagtgtctgtatgaaaaatgagactattcatcatttgtcatagattgtcattatgcgaagtttatttggagagctgtcagtttcttttggattataccttcctagaagcatatctgatattttttatggttggctttgggggtggacaagaaaaagagtaaactgatacttgttggtgcctctgctttatgttgggctctgtgtttgagtaggaatgatagagtttttgataaatcatcatctgtttcctatatgcaggtaattttcagagcaacatattggcttcggctgtgggctcaactgcaaaagtgtgaggaagatggagagttcttgaatgttgcatgtcgtaatcttgagacgacggttatgcaacttttcgccaaccatggctagagattcaccaacagactcgagtagttctctttggcttggttgcttttcttttattc

SEQ ID NO: 41059 - DNA, 2063 bp, Oryza sativa
  unsure (1)..(2063): unsure at all n locations
annnnnnnnnnnnnnnnnnnnnnnnnnnnnnnnnnnnnnnnnnnnnnnnnnnnnnnnntggatcaagttactgtcataatcagtattaccctttggagagaaaccattggtagcatcatctctcttttcaacttttttcttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacagatgtaattaggccctatttctttcaacttaggattattataatctagattattgagagtaggctgaaagaaacaaacaacttattgaagtagcttattataatctagagcccagcttattataatctgataagctcatttaggtaagctttttccagattattgggtgaaaaattatccaccatgccaccccactccctatttagacttaaaaacccaataatctaggctctaataagctaggaaagaaacaactaaccgcttattctactatagattatagcaatctagcttatagtaatctaactcaataatctagattataataatcctaagctgaaagaaacagggccttacaagaacacgtatatacacttcacactttacagtgagtttatgggctacaacgcctatagacacgacatacaaacaaacagaaaactactgtgagctagcaaagctatacctatataaagaatgaatcaaatatttgatcaattgccgccgccgagcaggtaacccttgagcgctttcgcaatggcaacggcgaccctcgtggctccagggaactggccggcgacgggtccaagcagcacaaaccacaagccgaggaggacgaagaagaatgcaacaagggcatatgcaggaccgtcgatggcggaagggtctccagcagtgtggaaaactatggaggacccggcagtggcgacgaggaagatgccacagttgatcagtagtctagcggcaggagggagctggcggtttgcagcggggatgttaggatgatggtgcaaccctggaacgggcattggtggatcagcggctgccgggttcaccgccgcgcgatctcccgtgatcttggaggcgcttctttgtgaaggctgtgagatttcagaatcaaataaacagggcattataagattcatcaaaaacaaaattaaaccattgaaaagcatgcatagctcaaagcagggatacaaacaggcataaatgtttgatactttgatatgaacttaaaatgcacagctcacttgttaataacgttttttatgcatttggtaacctactcctaacactacacaagcaggagtattgcatatgtgacttgtgatgagataacaataacgtgtaggtagcaaatattcttcaaaatgtagatacagaaatgataatgcattgcaacaatccatagaattagatcactcttttctagcattatgcatgtaaatcgcccatggggctaaactcttaaatctatctatcctgagtggtgtttcaggatgttgtaatcccttgattaagtttcttaggttgtcttatcagtaatcactgtcacgagatttagcctggtttccttttttgaaaatgatatacgtatgaccttgttgtccggctactgtgtacgaccatggccacaatgaaaggctcagacggcaaatgtctcactccgtgatagaatctgacatgcgcaggtgatgccgtaacggagtcggacatcagtctaacgctagcgtcgtatgtatagcagcgttcttaatttttctccctttccttttctggttgttgactcttttctggtcagttcttcaaagctgatcctcccattctatgcttcttctttcaccttcttttaatacaaagaatattgacttgcaattttcagaactagcaagaatccatgacacatgtaaccatctcaatatagtggtccccccaacagggcatctttcaagtcgaagaaatcaattagcatag

SEQ ID NO: 41060 - DNA, 1850 bp, Oryza sativa
taaaagcccccccctctccctcccccatcgcggcccgtaccttttcttgatggggattcagatctgcggttattgctagatctgaatttgttttcttggtcaatagctcgaggtgcattctgttccaagctttttgggatgtatttcatccggtatgtttgttactgggttggatgtggtttccatgcatcacgcattcattcatgtcagttgtggaaatcatggttgcgtaaatatcattaggaaaaacaagtgtactttgtgcagatggggtaacggtatgattgtgtatcctcatctgtatggtcgatgattgtatccatatgattggataaatgtgccctgctatttgtttgtttcatactggtaattatgtaaatcaggactgcgtagatgtggtaattgatattctgcagattttttggtatgatcggttgatgtattgctaccatgggtttttattaaatacaacatttagttaaagaaatacataaagagctatgcagttttgcgattgtatatatttgaagtatgaaatatgtttctagtgccatgttgtaataaactcgtccccttctgttttgttgttaactgtaacacaattccttccctgttcataaggattttgtgcttctctatataacaagcatgatatagtatgaaattgattgtttagatgcatgcttgccaatttggtagattaggtcaagctttaaatttgttcccttctgtttgttgttatacattatttcctttcgtgttggtaagaatttgagattcatatatcaagcatgatatatgtttgtagttctatgttgtaataaattctctcccttctgattgtaatgtttttctttcctgttcataagtcaattgcttttgttatgtccttacattgatgcagcctccttatgattatgttcataaggaaattagggctgttacagataatgatcttacattgatgtagtcttgtgatgcatcttttatgtatgattgactactgtattgctaaaatggtgaagcattatcttaagggatttagtacttgttctgtatctctaatttatgatgtttcaggcattgagtaattgtgtctctgtatcttcactgtgatatttctttgatatccagtaataaattcattgcatactacagtttgtgatcacaaattcgttcttctcttgatcaattcattgcatactacagtttggggtcataaattctctctgctcttgttcatgaattgtaaacagttctgttattttgttcatttattctttctgctcttttttcatgaattgttaacacttctcttgatctaagagaaatgatggcagtctcatttttttctttgattgtcacaagaatttactatctaaattaagttgcttgatggtggtggactattaacaacactgcaattttacaatgagacgggttatggggtatcagtgcatgttaaattattgcaaaacaaaatgtatcatgttttaacttgttgctcaagtgtttgtataccaacttctttctatggagggtccttttttttttcttttttgtaaaatgccgtatttgttcacatgcactgttttatttgtgtactccactattgcggatctaactttgttgtttgtttctcatcccacggtgtcacgtacctatttctagtatttctgcatttcaatttggatttgctacacactcgccttttttcttgaagtttttacatatatctgttatttctaactttgttgtttgtttctcatcccacggtgtcatgtacccatttctagtatttctgcattttaatttggatttgctacacgggtaccgagctcgaattcgcc

SEQ ID NO: 41061 - DNA, 836 bp, Oryza sativa
  unsure (1)..(836): unsure at all n locations
nnnnnnnnnnnnnnnnnnnnnnnnnnnnnnnnnnnnnnnnnnnnnnnnnnnnnnnnnnnnnagttacatgatgggctttgatccaaagaccttggagttatgcgcaaggctgcgctcatgcgaagcttctaatctcattgagaagcacagttgggcactgttcagagaaagcatgaaagatttcctagagcctgatgaggcagtgatactcgatccgtcatccctaaagagattgttgcttgaagccattgcatttggttcctttctttgggatgttgaggattatgttgacgagatttacaagttgcatgatagctgaaaaaagtacatgcaggaaactcctgatgccttgtaaatattcttgaatcttgtatatatgattagatatttagcttcttatgcatgtaaatcttcctgtcaaaattttgctatttctagcatcccagattgccagggtgctgaatgacttccgtaatttgctactcctataaaggttttggtacgatttctggagccaggtacacctcgtacttgtaatttgtgtttttttctccaggaattcctaactgccgctattcattttttacatacggagtatagtttgcagtcttttacataagtactactgtaaaactgaagcttaactcgatgtaatcgtttgaaagcttggaacatttaatactactaccatgttgtgactctcagagcacctgataacttcagtagtgtttggattggacccagaaaatatggaactgtctgaactcatgcccagaattacaccaagcagcatcactgctggcaattggacaattttttcatttgtgcccacatga

SEQ ID NO: 41062 - DNA, 911 bp, Oryza sativa
aacagctccagaaaggacacaatggcaggtgcctacaactggctgtctggcactgcattgaatgcacctcctcactcactctcacacacacacacacacaagagaggctctgcctctgcctcctcctccatcaaggaaggagtacatcacaggatacagatccagactccagagccccatagagagagaaaattcagctactcctagatgagaccctgagtgagagaagaagcaaagaaacaacaacaagaagaaagagagatcttcctctttcatcaacaatgccaccaccatcaatcaccaccaccaccaccaagctgttcttgctcctcctcctcctccatggaggccactgcctgaagagcttggacatggccatggagatggagatggattcagaggctcacagcaggatgctgtgggagtccagcagcagcaacggcaggaggtacatcagctacgacgccctgaggagcgacgtggtgccgtgctcgaggcagggtgtcccttactataactgcaggatcatgaccaccgccaacccttacacccggggatgcgagaccatcaccaggtgcagggatgtggatccgtgattactactgcactgcctgcttgttttgctggatgatcttgccatgagaggaattgcaggagtggctacctgagatgcaaatcttggtttttattttttttttgtttttcttttaccctctcttctgttctttcttcttctttatgttctgcatttgctgaatcattgtaggtgattcatggatgatttacatgttcaaagatcttatgagtatgtatatgtaagatctggttgcaagctataatattataaggaagcttggatcaggggaggtgtgctgctttgtgctgggtaccgagctcgaattcgccctata

SEQ ID NO: 41063 - DNA, 3533 bp, Oryza sativa
  unsure (1)..(3533): unsure at all n locations
nnnnnnnnnnnnnnnnnnnnnnnnnnnnnnnnnnnnnnnnnnnnnnnnnnnnattgacatggaaattggtccttttcttcgtttgttcaattgtactggtatgttaaacttggtatacccaattgagcacgttgaatcttttcggatgctcatcgtttcttcaatttttttaatagctactcgagtgatgaaacctgtttcgttcttgtttaataaagatattgctttgcagtgttttcaggggaaaaagactcaaatttcaccaattcattattcatggtgtgattcctcctcttttttcttggtgaggaaatcatcagtttgtgtatcaacttccgaacatactgaattgtacagaagagaagggtataagtctgaataaattcagaaagcactcttaatagattatgactggcactgttgcttcataaattcacacatctacttgagtgtctcagtaacaaaacaatgagcattactccgaagtgctactatgttagatattgtaactacagacaagagatatcacatgaatttggatttttttttcgagggagattctttaaagaacagagattttggtgagttaaaaaaaaaaagaagaagaccacatgctgacctgtagtcagccaccaatccttaatgcagagatcacatggatgcaccgacacaatcacacaaatgtcatctacccacatttctcccaccggcctgcgctgcactccccaaatagtgccctactgccctgacaagaaattgactgttgcacagtgtgtttgtatcgcaggtcaatgacgttggcatcgccatggctaaagtgatccacatagatagacccacgtaaagagattttaactatagcaatctccacaatgtatataaatacaaggtagcattaggccatcagcaatgggcacctcctcaacccgtgtctctcctcacggccgtccgcctcccgtcgctttttgaggctgatctgttccctagcaggggagcgcggcgcctcgcaggggacgcggctccctccgcgcctttggctactttttcgtggggggtctgagccaggcactgcattgaagcgtggggagctcgtggacatggcgccctaccccgatatttccccttgtaccctcgccctcatccacagccggcggccggcgacctcctcgtcctcatctgccgccgctgtcgccaccggtggctcgccgttgaccacctcgatgggagagagggagagggatagggagaggcaaatgacggcagtgagagggagagaagaagaccagatctggccacatctcgctgttgaccaccgcatcggcatgccagatccgcgcgtggctccccgtcggtgacaggcagaggaagaggggtggcggcgcggcacacagcctccagcgatgaccccacgacgagagagagagagagagagagagatggatccggtggtggagtaggcggccctcctcgtcgccctcgccgattaagctccggcggtagcggcggcctttctaatctccctcgcactccggccacatctggcgaggaagagtggatggcgagcggcggcggcgggagagagaggagagagaggcgaccatcggccgnggagagaggagggaggtggctgtggcggcgagatgggccacgaccacacgaacagaagcgagaagagagggcgaaagaaaagagaaggaaaaggacagtacgctggcacaaaggcgtatttggggatttttcatctagggatactttgggccaagacacccattgtgggctatagtatcctcaccgggttgcttcagattttgaggagcccatccaggggtatctcccagtgtgagctgagttcccctacgagtgttcatagttagtgacactctaggagtggctcacattgtggatgctcttaggagatgagagagaaatagagatagatagtattatttatttatgggtagtccatatgcttaatggatatcttttgttgttttctctatatggactagttacataatgttaataggtagctgaataaaatataatattatctatggactatatttgcatcacattgtggatgcctaactgtcgaaggtttcgctggatttttgtttcccagttcatatgaaagttgaaccaattttcatgaaaactgctggaaagagttacgagtatcgctcttttcagctatttcactgcattaattttgaggattatcggattgcttacctctcttgtttaagctatttcgtaggataatcatcacaatatttaattgataccatatatcatctagattatcaacttgcataaaaccggtcttggcttgagatgtaaatgagcaacatgaattagaattacaagaacatttcaatggggtaaaatagttttgatgtgaatatctgttaaatcaaaggtgtttttttggttattattctatgatgaacaattgggcattggagattattggttttgttatttggaatttattcacgagtggtttttggaaatatttagattcacaggtgatcgcaggatttattatttcatgtgaccggtcagaccgggctgtgcatgccggtcagaccggcggtggtcgagcggtcggaccggccagctcacggtctgaccgaccgacgctgtgtcggtttcggtttcgggttgtttgtttggatatccgtgattatttcatgattatggcttctagatggatactatacgtatgtaatactgttgtttgctaactcgatgcctcgggagagtatttgcggtgatggaccgggagtcggcttggggataagacgacgtctgtggtggtcagagatcatgcgagatacttaggctagagttaatgcacgtggttgatggagattccatatggcatacgatggaggtattgtgtgcgtatgagatgcggagtccaatttggaaggactccaaatttggtacgattggttatgtaagtttttttcttgtactagagggtttcctaaggtgtttaggactcttagtatgagtttggttcgtgggctttaggctgcctacctcgggtatatatagagagggagtgtgaggcttcccggtatcgctttagagagcaattgagttgagttttgagttatggtttcgagtttagtcgaaatttttgtaaggagtgctgttggtgcactttgtaaacacagagagaatcaataaagtcgtcatctactttaagagttcttcgatttgtgtttcatcgggtttcggcggtctaaccggcgatctaccggcggtcagaccggcggcatacgggcggtcagaccggtggcagcgacaggggcggcaggcttctcggcggttcgaccgatcgatctacatcggtcagaccgacgttcatcaggcggtcagaccggcgcaataccttcggtcagaccgcaatccatcaacttcgaggataacttttatttccactnaaagttttcggtttttgggtataccaaccattcacccccctctggttggcttagttcttgtgattgggtaccgagctc

SEQ ID NO: 41064 - DNA, 3188 bp, Oryza sativa
  unsure (1)..(3188): unsure at all n locations
cgcgggagagtagaacaacgggcgaaagcctagccttcgggccggcaacggcgacgcctgcgggcgccgttttccccttggggtgttgccgtgttttctattttcccagtgggttcttcaggtgaaaaccttgtcctggttacctaggacgaacggcggcggcgcttttggcgtcgttttccttcttggagacgtcgtttagaagtcatattcctttgagagtgttgtgtgcttgttttgttttaaacaataggatcagacgtataagcgtggtgtggttgtttattttctttttcctgactatagtctcccaggactataggcttgtattttattccttctttatcaatagaaacatcatactatcttatgcgggttgtttcaaaaaaaatggccgggaaaacaaaataaggctttgcagacaattttttttctaaaccacaagatagtgttcattgaagaaaacaaatgtgggctaagaaaatgcctgagaaataaaaataggctaatatatgggttgttaaataggaatgtccaaactgaagtccaacaaacacgcatccgcacatggggttgtaggatcgtgtgatcgcgcgggacgttggactagcgatcgatcgtgcagtagacttattacccctctattgcccctatttatgtactgtacatacttgcatacagtagcagtttcggaagcatctgctgtgtactcgtcgtgccacagaaccggtcgtcggcgtctttcttcctatacacgccaatggcagtgacagtggcccccacacgcagtgcgccagtgcctatatataaggcacacaggctcctggcacgccgcgccatgcaccgcaaagcgacacacgcgacacgccgcctccacctgtatccctcaatcaccgattcgtcgatctccccttctcctcctcctcctcctctccccggcggcggtggcggtggcctcccccagcgtgagagacagatcagagtgctcagctccccactaggtaggtgcgggtgtgttgccgcgtgcccccgccggcatggacacgtacgagnaggtgcgnagcatcgggtcaggcaacttcggggtgacacggctgatgtgcaaccgcgacaccggggagctcgtcgccgtcaagaccatcccactcggcaatcaccgggtccgagtccttctaccctcttcactagcgtaatagggttttggggttgtaggctggggtttggtgggtcttgctcgtgtggatccggtggccaacatttggttgttctgatggggctttggattggtttttgcgcagattaacaagagcgcgtaccgggagatcatcaaccaccgttcgctgcggcacccaaacatcatccagttcatagaggtgtgtatctattgttgtcttgttgatgaggagcaaacatttttggtttagaaaaaataggagcagatagtcagggattgttcactcattgttttgtccgtctgggttaattgtctgctatgccatgatttactagtttcttgagcatgaatattgaatgggtaaggattcgattttgtattttttttcctccctagtttgatgggttttggtgatgtgttttctatttgaaggtgacaattgtggaatgtaccatgtttcttcttcattctaatcactttatggtttaatctcggttttatgggtgcatttaagtttgatctccttttgatcttactcctttctctcataatcccatgccgtgtggaacaaaataaacaatgctttgttttcaatttgcacaggcgatcctaactcatacacatcttgcaatcgtgatggagtatgcatctggtggagaactctttgatcggattgtcgatcttgagcgatttagtgaggatgaggtcacaatatataatctctggttttgatttcaataatattttttaaagttttatgcttctaaagtttgtttcttctactcaatgcaggccagatatttcttccagcaattgatttggggtgtaagctattgccatcacatggtatggataaacaataaattggtcttatcttatcagcacattcaataatctaatgttccatgttgctctgtagtatgtgtagtagaaactgctagtatgttttctcaaataacgtgagtgggacctgaaaaaatgcttaaatattgcaaccatcttcgctactttctagaaaatatgccatagagatttgaagctggagaatgttctcttggatggcagcgcagctccgcgcctgaagatatgtgattttgggtactccaaggttgtctccaattattcagagtttgctcatgcttttagttcttttttagtttgaacaggaataattgtttgccatttctaacagtcatcaatgttgcattcaaggcccaaatcagcagttgggactccggcatatattgcaccagagatactaaacctccaggagtatgatgggaaggtgagttaaatagcttcttgtttacctatgatatgtactttgatgtttctttggtaacatttatcagaagcacgtcatttatcttggttccatatatggcttattttcttattttcctttcattatggcatgcatattaatactttccatgtcagaaaaaaaacctggaactggaagtacaagttgattatttagatatagaattattactttctaagcactttggcattgcctaattaacctagactattgcacagatatggtttgatgtaccaagaaccatcacattagcaagccatatgcgaataatggtatacgttcatgtgctttcatcacaagaatagttttgacttacagagtatgatatcgtttctagtttcaacacagttactattgattgaatcatggtactagttacactaactaaaattgacaaattgtggatgaccttgtcattgttttttttccctttgagataggtttagttcctgtgtgtatagcatgttagattcttcttgaagatgattttggagtaatgttgtaaacaagagagaagttcaaccagcgttagtgtgctatactctactatgatctcttaattcatagtacagttacacagttttggaaagataagcactgcagggctgaaatgaacttttagtaatgatttaactgattggttgcatactttgttatcaccaattgaaaactcagatagaagatatatct

SEQ ID NO: 41065 - DNA, 4920 bp, Oryza sativa
  unsure (1)..(4920): unsure at all n locations
nnnnnnnnnnnnnnnnnnnnnnnnnnnnnnnnnnnnnnnnnnnnnnnnnnnnnnnnnnnnnnncaaccagattcaccgtgattagcctcaccctagtctagtgtaatggaattgattagttcaggtggatggtggggcctgttgcaacgtggtgtagcgttggacagtggatggttaatattgagtaattattacaactgatttactgctttcaactaccgtctttaaatgctcgctttatgcaaatgaaccgctcaagctgtccttcaattatatcctgcatcataccctctattccggtatgacttgctgagtacggtggttgtactcagtcttgctctatttttccccaaacccccagagtttgagtgcgtgtcagatggtgggttctccgaggagtaggcttcgtccgtgctgtcgaggatgcatgtggagtggtgttcccgctgcagtccaagtcaaggcttagctccatttatcttttaattttccgctgcatttatgtaagacttttataatgtttgtaagacgtggatctgtatgtcgactttgtcgtttgtgtaccccggccggtcctcgacgggggttttaatgcacattttgcttggaattctattcgggaatttctgggcgtgacatcctgttttttagacagcacagttaattaattagtgacaagtgtatttttatattgtagcttgcagatgtatggtcgtgtggggttactctctatgtcatgcttgtgggggcctactcattgaagacaaggatgatcccaagaatattatgaagaccgtcaaggtgatagctcagtcctataatctcatggatatatttcattggcatttctgtgaatatatttgcggtcttgtttacactcatgaattccggcggcttatcttcgtttgcagctaataaaagcaattcaatatgagataccacagcaagtccacatatctactgattgcagagaactcatatcacgaatctttgtcagtgatccatcgaaggtaatgaacgcaagttaacatttatctcggtttccatattgatatccataagtgactttattttcatgtggtgattaattatggcatgtggtaaaccatactagtgaatgagccatatcgagctgtggtcttactctagaactcaagttcgatgagctcttttcttttcctgtatagagaatcaccatgcaggaaataaagaaccatccatggttcttgaagaatttcccgagggagctcacagaagaggcacaatctatctacttcacaaagaatgactatttccctactttctcagcccaaactagtggagaaatcatgactttcatggaagaagcgcagaaaatacccaaatcattcggcgatggctatattgattacagatcagatgaagaggaaatgcaggaagaggaggaggggccagaagagaacgaggaagaggaagatgaatgtgacaagattctaagggaggtccaagagaaggaaactccgaatatgaaagcacttagcatcggctagatggtgctacttgtaaggtcgggcatgttgataattgcatcgctatgtagtttgcgtttggtaggttgtatgcaattctggctgcagatacaatgtagtctaaattatacctttttgcatcttggaacataattttagtcgaatatgtatgtgtgatcttaagattcactctgaaggagagatgttttgtacatgaatccatccgattgtcttttggataaagagattttccattgtgtgcggcaaagcatctcttaataatctggataatttggagtgaaatttttctatgcatacgacccaattgtccgattcacgtacgattggatttgatcaatagttgtaaacggccacagtgcatatgaagatgctctcctttaattgatctatggttgcatgtctatcgttgtacaactgggtcgtacgtatagcagtactctttggagtgcatctgtgcatcaacatagcttttgcctggttaaaagcctaaagaagatagatcgctaccatgttttcaggtccatccaaaatggtcggtgccatggttggcatgaccatgaacagtaggatcgaccgacttcctagattattttttaagagaaaatccatgaaataccatcgacaagcaccataatcccagaaataccatcgacaaaagcatcttcctaaaaatgccattgcatctttctcccaaaaataccatcacagtcaaactgttattaacatctctccgttaagttgtatgaaaagacaattttaccccaggcaaccatttgctcacacaacatcatttgcattgtttgctcacacaacattattttgcattgatccatatttctgttagcatctaaatacagacatcaattttgctatcaatcaaattattttagaattaaattcacataaatcaaattcacaaaccaatttcacacattcgcctcgtccggacgcgctgcacctccacacgaggaggagcaactggcaaacaccactgcagaggcagcaactcagtatctctgcatcggaagagaaatccaaaagaaacttaacctaccactggacatcggcgggaagcgagcacaaagagaaagaagaaaccccgaggccaatgtcattgctcctggttcgtgaggcgagtacggcggcggtgccatctccactccgaggtccagtagctattctctgggaggaggagcagggacggagccatcggtgggggcttccgccgctagaaacccgcctctcccttgcggccgctgtggaccgttgcgccgccgccgtggaccgtcgccgagccccgcaccatcgccgctatggatagccgcaccgccgcctgcgacctcctcgccgcgtcctgccccatcgccgctatggaccgccatgccgccaccgtggaccgacgcctcatcgctgtcaccgagccctgcaccgagctgccgctaggagagccgcctggatcaggatcgttctagggttagggttagaaattttcactgtttcatctctctttttcttttaccataaaaactgggtatattctgcactgaggggaaaatggtcattgttaaaaaaaaataacggttgtaatggtgttgaattgacggtgatggtatttttgggagaaagaggcttgtgcaatggcatttctagaaactaggaagttgcttttatcgatggcattaatatctcgatgggcaactgaacaccagatggaaatggaaaatgcttcgtgtcgcgcgtccgacgggaagacaaacatcggacgccagcttcctcctctatactagtctaaaattgatttacctttcctggtgtttttcctggtttctctttccaagttacttttactcagccgtatgcatgcacaacttgcatgcaagtatataggaacatgcaaattgagacatgatctttaaaactatttttcttccaaactaattatgcgattcatgatccgattattgtggtatatttgttgttattaaatcttgcatgattatattctgacgaaaaaaatatatatgtttctactgttaaaattcagtgtttcactcaatgagaaacaaatgtttcaattagatatggactatgttgcactttaaagtttttttttgttgcaatgggtttttgaaatgtcacatatagctgttgttgcaataagcatttcatgatgtttcagtagttttttatatcaaaatatagccatatgagatcttgttataaagattttattataacaaatctaatgatgcaatcaaattacatatcaaatatatattttaagagaaaagagttcaaagaataaaaatatatgtgtacattataatatagtgctagtagccgtacatgctgcatacacaggctagcacatgtagctgcatgctcttgcgctttaaatgtagtgctaggtgcgctgctactaagggctgtgagaggcggccgatatttcgttttttattagacgtccgatgggtaacctcctccgatggaaattggagacacttgaaccagctaaggagtctctctgttgtggtctttaaccaaagcaggattatacctcctcggtgcccatggcccatggcccatgggaaaccacgcagccacgcaggtggttgcgaaggttggtgggggttcggaattttcttctccgacccccgtcagtcgtaatccgttcggctacgaatcgagatttcgatggcgagtaatgaattttttttatttttaattttttttattaaaagttttacaaaaataattttccatttgaaaattgacggaagtagccgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggctgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctccgcaagggtgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaa

SEQ ID NO: 41066 - DNA, 1241 bp, Oryza sativa
tgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaataaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggagtacggtacgggcaacccgtcctgcctgtacaggtgtgacctctggctgctcctgagtgtgcgcctctggagctcctccaaaaaaaaagctgacaggagcctagtacgtcgtggtggtctgcaccgtgcaagtcgtcgtcgtagaactggctagtaggaccagtcctaccggcgtgagacgaagaggccccagtaccgaagatcccggctgcaaatcatgctggacaaggaccatcagtttcgtacaggtatttaacagtattaataaaaagtaaagtaccgtgtgggcgagagatcgacgctccgtgagaggaagagctggcgaacgcgcccgaagaggtggcgaacgcccctgcggagctcgtggaa

SEQ ID NO: 41067 - DNA, 2703 bp, Oryza sativa
agacatgttatgtgaagaaaaaaaaagacgactgataaacttataacgcagcgaagttgcactaaccccacgtcgacaccagtaagtccccatcgtgtgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttaagtgaatataatgaaatttcacagaggagggactgggctttatagggggagaggcaaaaatcgccctcccccagggcggcaagggggccgcctgcaaaattccatgccccctcgccgcccatttgcaggcgcccccccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaggcggtaggcgactccttccgtcaattttcaaaatggaaaattatttttgtaaaacttttaataaaaaaaattataaataaaaaaaattcggcgagtaagtaggattgttctacggcccatgaagcggcccagatggctgggcccaagctggggccttcgcatagacttttcacgccttaatctgggcctgggatagtagtgatcaaacggtcatttgattgcctcggctcgtagcggacggcaggatcattcacaccctgattgagtgattgtgttgctttcgttgggagatgcagagcagcagaggagcacactgttctactcttctcgtatatgaacctggttatacgaggctcttcaaattattattggaataaaatgatttacaagtttaatgttcttgtttcgtcattcggtagtttggttctctacgtacccatttgttagtacttagtagcgttaaaatcttggtaaaatttgaaactatcaatttgttgataggagagagatatattgctcatatttagtttattataaatatgatatcagagttcataaaatatcatttaaatcttatttgcatgtacttttcagtgtaacatattggcttcgatcataggttattctacaaaagtgtgatgatgacactaaattaataaaagttgcatgtcgcaaactggagtcaaccggcctcatcttttcgcttatgcttatgcttatcaacgaaaatttaaattttcaatcttaaatttgaagttgatttttggattgttttttcattgaagtttatctttcagccttagcttttaggttgctaagaacatactacctccgttccataatataatgtattttggagggatgtgacacttcctaggactatgaatctggacaggctcagtgtcacatccctctaaaatctgttatattataggacggagggagtatataaaagttttgtttacaaatacttctcgtttgcaaatatgccgtttggcttattaaacaatgagactgaacggttgtgcaactttttgccaattttggctggaggttcacagatagaattcaataaatgtgcgttttattttttttctattggtgttagtaccggtgtgcgtctctatcagtttggatgtgtccctattatgtcttcctttgaggtgtgattatgtttgaaacttttttttaataattagctgtaattctgtgagcaaaggtcaggattatattttattatcttaaaaaaaataatgtcaaatttcgttccattgtgaagaaattttgccacatttgcattaccattggcttcaaacaaaaccattatattttcaatacttgtgaattgccatcacactacttatcacggattggaaaaaatatgagaaatcatgccatgtgtttatcccattgaaaaaagttcttcctcttgtggtgactctgcctacctaataagcaaacagataatatgaaagagaatgaggtgtaatccgagaaaagcttcataatcatacaagcttcttttattttccccttttcttatcccagaagaaaacctttttttcctcaattaaatctaacacagaaaacctttttatagaataaaccaaaccttgtgaagccaaactgcaaaaacttgtgggggagaagaagaaaaataaaaacttcgtcgagaaggcaaagcaaatcaagccaagataacgcggaagagaacgagaatatcacggctattaagacctcggaatccacgggtgatgaagaccaaatcctcgagcgttctcagcaactccttcccaatcctcctcctcatcttcctcgcggcggcagcatccgttccccagatcgccatgtcggccgagcagccggagcaggcggcccccgcggcgcagaggcgaccgtgcagatcgtctacctggaccgccccgcggacgccgaccccgaggagttccacatccgcaccctagcccccgttctcggcaggtatactcgcggaatttggatcccccgcctggttgtttctactatttgtgcgatctgggtaccgagc

SEQ ID NO: 41068 - DNA, 9710 bp, Oryza sativa
  unsure (1)..(9710): unsure at all n locations
nnnnnnnnnnnnnnnnnnnnnnnnnnnnnnnnnnnnnnnnnnnnnnnnnnnnnnnnnnnnnnnnnnctcaaattcttattggaacataaatgtatcatttgtcaatctgtaatacagcggccgtactgaataacttccatcttgttgagtaaaattaagtatgatccttaagcttttagatctttggacttaggtgtgattgattggtgatgttctgtggtaatgttgatggttatcaaagtttctttcacactgtagtcttccgttgcaataattgcgaaagcaatcattcttttctctcacaagcccaggttcaggcttaagtgcacactcacaaatcataggattgtaagctactaagaacctgttcggggattgtacattataactataactaattcttcattgccccataataatgtgcttcagtcatatttgtcatgtaatatttggtactttggaaccaggaagtacaatatttcctttgtagaccaggatgtatcaatttacatcctacttatcccatatagtatgaacaatcctattgaaggatatttgtgaattctgatgctcttagctgttattgtaagtatttgccaaactgataagatatttgcaaataaaacctattccttatgaactggacttgcatctgttcattttctaggattatatatgcaaggtttttcttttcaccgtggattttattaataccattttaacttatatttctaacatgattcgatcttacatatacgctatctatgaccaagcagctaccggatttcttagtgtactgttctttttatcattaatcaagtaaaacttatctaatgtacatgccagtgtcgtgtggttatagattacaatacggcacatgatttctttggattttggttaagtttctgaagtatgtatgctaaagtcgccaatagtgcgaatcgtacttgggccatttgcacttctgtttgtatccttacgtctgatttggctcctgcctcttttgttgcagagcaaccaggtgttcttcaggttgtaccaagccagacataccagctccatggacccggggctggcactggcacaatgaacacctttagtcttgtgtagtgtaccggcctagctgataaggtagtgtaatgcaagtgtttctggtgtgtgcatctcatggcatggttgtaatactatatggtagtaacaataagagatgcaacacctgtacatccccagtggatacaatgatcttttagcttgtatcctaagtttgtaatgagtattaaaaaaaaggctgtaatgcactaatgtataacaagatcatttgatactatatataactatgtgttgatctaatgttattctcttttagaattttgggtcttcatgttgctgagtttgcacctgtggaagaccttccctgtcttcgtatttgctttgttattcacattcgcaaaagtagtactccttccgtttcacaatgtaagactttttagcattgtccatatacatatagatgtaatgaatctaacacatacatatgtctagattcattatatgatgaatgtagacaatgctagaaagttttatattgtgaaacggaggaagtagtaacaataatcgtttacgacaaaaatacgcatgggcccactagtcagtgtcttcccagctccgcacagtggggaatacctctcgcaaggtgggccccaccaagcgcccatttcttaaccgacgaaacgggctcacgtgtctgaccatcgctcgcaatcgcaattcgcaagttggcatccaactccgtgccgtccctccctcccccccaacccgatgggaaacgcggcccgcggcgattcggccccggagctgctgctccgcgcggcggcgctggtgccgccggcgcactacgccctttgccgccctcctccttgcctgcgccttactgtaccgattcctcgagctccacctcatcggcgacctcctccgcggcctccgcgggggccgcgtcgcgctcaccttccacnccgcctcccacgtctaccaccgcgtcgcatccaagtgccgctccctccatggcaggtgagatgagagaactccgagttgtgtggattcgtcggaatatttttttgcgatgtcatcgctaacatcgggaacgctggtcggtcgcgtaggtacttggcgacgccgtggcttgcgagccctcatttgcagacactgttcctgagcatctctgggagacccccttcgttcacgtataggaggtaggagtaaattcatgtcttggaattgtgcatttactcgttgcatttgtctacggtctctctgcaccaacgtgagtatttgtccccttgtacattggtatgagatgttaatggactgttctgatggctcaatggcctaacggtatcacttgaaacttctcaatatggatatgcttgtgcggttttagcttccttttttccctatgaagttatgattgttgcgcaccattttgtataaaaataaggggcaataaacttttgtgcgaaatctggtatatgcagaattgcggcatgctgttcctttattattatatgatatatattggtatttagtattctcatgagttccagttccaagttcagtaagatcagctactataaggtagagactcatgttctgttttggttggacattacaaattaaacttggaacggtgctgcagctagttatgacattagtttgccatatttattaaattcttagttatgaaattagtttcccatattcattgaactctataacacaggcagctgtacacagttcgcgatggtgggaccattgctttggattggttactagcctctgattgtgaaggtgctgatgtttttgttggatagcttcagatcaataggctagagatgcctgatagttagttctatgttgcagaagaagatgttggtttttgtgatggagttatctctagggatgattcgacgcctcttgttgttgtgatacctggattaactagtgattctactgctgctgtaagtccctatgatttctctaccaaactttggtttaaacacaatctggaattttccataaaatcaattttaggtatttgggctaccttccctaattgttctaaacaagatgcaactgtctgttgcagtatgtgaagcacttggtcttttctatggcaagcaaagggtggaatgttgttgtaggcaatcataggggtctgggtggcatctccataactgtaagtttcctcctattctatagtgatatgcagcattgaaaaatcgatggtgtcatctgctttaactgattggtttaatagccatgcttgtctaaactaaagtccaaagacaaaaggatgataaaatgaactacagggcagaagtttcgagagaggcattgctgaagcttactgtcgatctgcaccttccgtacgaggacaagcaattaattaaccagtgtcataagattaaatatggtggaaagcacatttgttacttgtgctcccttaaattctgttagctgaatgattcatgtttgtcttataaggtagatattaggattgatagcaaatgtaaagacactgcatattcctgttttgaaccacttgaacattttttttttattaagcttttgaaccatgtggtccatattcccagtctattacatgatatgtgcatgaaagtgaaaatgggtgaaatggtgttaggcctaaaccatcaatcaatgatgctgatgtggaaattagaaaatccttgaatacatgttctgactccaggaaaattatgtcccagaatcatcaatttggtagcagttgatgaaaaatgttcaggtggtacttgttcctcaacctagtatttattcttgcagtctgattgcttctacaatgctggatggacagaagatttccgtgagattgtcaattaccttcatcagaagtatccacaggctccattatttgctgttgggacaagcataggtgccaatattctggtagactttgtctgttcttaagatcttctgttttgttttgcataatctctcttgcttgctctcactccacgcatgcacgcactctgctatacactgtagttgatattgtaaaagtgagctgcaatttgtttatgttgttttcatctgttgcccttttaggttaagtatctcggagaagaaggtgagggtacccctgtggctggtgctgtatctatttgctcaccctgggatctgctggtcagcgtctacagtttttttttttttttgaatttttttttatcgatctatagatatgctattttatgcataaataattgtttatttgttttgaaacacaattttgcattatgatacctatatttttgtttgctaacaatttcgctgtgtctcacttaatgaaataacaaatagcaaataatatcctcttctagtgtttcatttcacaccaatacttcttaattgttttcttacatctatccgtaatattttgttatatcaatcaatattgcaggtgaccaacagatttattcagcgcaagcttgtgcaacgatgttatgacaaagctcttgcaattggtctgaaagaatatgcaaaactgtatgttctcattacgcttctttaccagctaagcatttaaacaagactaacattgtatacaacttgccacaacctttattcattgaattactatagtttgtgctaatcaaggtttagtgattatcaaataaatcctttttcaatttatttgatttgcatttcaaataaaatacaatggcaatgatggtttgcgttttgcacctttagctaaagatccaagttcttgcctatatcaattgaaatgtgtgtttatgatctttgttaaaattaatttcattgtggacaaatcaagatgagacactattcttgagctcatggtatcaagggcctgcatcccatacaatcttgtggacaattgtagactagtatcctgggttagagtttatatgttaggtacaagcagtttgattagtgtggctttgtgatcatgttgctcattgcgacagaacccacataatggtcttactcgttgcctatcgtcaagtgctgtcttatggggatttggagggtcaagagggctttttgttaagtggtaggagagaaaccagcactaattgacaaatatcaaataagagaatgaggagagggtgggacgtccagtaaagaacttctgcttgcagtcaaccaagaatgattaaattagtaaatatgaagtttatgttccctgaacagttgtttttttgtatttcttcttactctcgagaaatttactgtagaccacatctcccttatggctttgctttgatggtgactgatgagtttccaatcccatgtgagccctaaggaaatgtttggacctttctgatgaattgttgcttaaacttgtgatctgatacttgaagagcaaatagctgttgctagctgaactgttaaggcactcgactattctagtgaggtccagactacattgaaggaattttctcatagttatgtgatagttggagtaatcggggtatttcatattgtgatctgtaactgatctgtgccgtaagaagatactaggtcttgtagcaaattcttgcagcactaactctcgagtagttaccatcttcagttctagtacaagtgccacaactgcagaatgtacactccatttactgataatctgattagaggacaataacttgaagtactacctccttactagattcatagtattaggatatgtccacatctagtaatagattaacttattctgggacggaggtagtacatgtttacattcagaccattaaacccatttccatctgcattaactctgatttttcttactttttgtaatttctaacaatgttaatgaatttaattgatacataatataccgaatatgcaaatgtcctgataaaatgtttaggcttagcagtctcgcaccatcatccagagcaacggatgtagtataagcccgtgctgcgtaatgacaaccaaagatggtgaatgcactttttcttcatactcaactactgagttttctccccattttgtttttgcagacaccaacccgtcttggcaagacttgctaactgggaagatattagaaaggtacattgactgactgaccctgttgttctattatctcatgtgtatatagtatgtactgtacattggaactttccctgtgaaccatgacaaagtattgagtgttgtttcagtttccataaaaaagggttatatattgtagttcacagaggctacagtagattacttttaagggtcaaaagagcaattgtccctttaaattaattggctggttacacaaatttgtacttatcctatcatcttctatttcattttttcagtcacgatctatcagggaattcgaccgtcatgccacttgtgtggttgcaaaatatgaggtattctttctaatgctagtgtacctgctaaatattttagcattgcttaatatcatgagttagatacttagatcaaatcaaatagcattgtgctgttccaattacatttgaaggtagaggtggactggcaaagcaacatacaactatttggttcaaacataaatggaccaaattaatttaccacctttgattttcaaagggatgtgatcagaattgaccataagctagtgcatcaaatccaattttgtaacaaataagcaaaattcaaattgaactgccagtaagcctcttaatctacttttaacaccagtaagcctctaacttgcatcagtataaatttgtcagacagtggacacattctaccgtcggtgcagcagtgcaaattacattagtaatgtgtcagtgcccctgctttgtatcagtgctcttgatgacccactttgcacaagggaggccattccctgggacgaatgcaggtaagcttacttttctttcaaaagatcaccatcctaaagttttattgtgtattgatgaggtccacattgtgtgattcagggcaaacaaaaacattgttttggcaactgcacctaacggtggccatcttgccttttttcaagggctaactgctggaaagctgtggtatgttgtttgcccctattatgaatagtaaggacaaagtaccgttacctttctgttcatggtctaagaaacttgaaaatagatatttgtaaggaattgcgattaccggggaaagcttgttttagttgtagttgataatttgtaggatattttagataagtagaagtaatatacatttataaacacaaaaattatgtattttgaggtgcaagcggctaaattatactattttgtgcggggatataattgggcagggatgaaaagacaattctttaatccgctttccactcacacctccatttttcacttgtgatgtttcttcaatatacattattatccaatagcgattaagtcagtgtgttcctttatgaatatttggtaggtgggtgggagctgtttctgagtttctacttgctctacatgatagcccctgcatgcatcggcaaaaggtagagattattaaatcgcaaactggcgtacgatagcatgaatacatgatataacatgtagttgaatgcaggcacaagaacacagcttgcacacttcgttggaatcatccattgataaaagcccatatgtgaatttcatggaagatgggatggtaactgcggtgacaaatgatgatgccaacaatagtgactcagataatcctatttccaatgaaatggaactccgcaatggcatggttggtgtgcaacaggatggaatcgccacagaaatacagaatgagtgtgacggtaataggtcacaagagaatgtgacgccagcccaagttcctgtaggatcacaggaacagccaaaacaaaacatagataaaatccaggatgctattgctcctgtaaagatatccattatcagtctcattctatcgcaggggagatctgtttggttgcttacttacattgcttttgtaacatcttggcctttccttggtgccctgggttttatcttgtttaggaaaaagttcaggaattctttgcctgctaaacggttatgaaactaaggcaattatgcttacagtacatacacataattgtttcacgtgtagtatgtaaaatgctggcaacaacagttcatatttgtgtatcagttcctaagaaaataaattatataggtgtaacatgctgtcatgcaatgattcaattcctctgtaattttctgtagttggaattactaaacatttcccagtattttactggttctgcatttcttctactctgcactactttgttattctaactacatttacaatgtttataggggatcagtgagggatttagctaatgtgaaacttctgtggagaggtagggatggaagtggatccacccacgggtacccccactaacttgtctctatttagtttataactataagaggtcgccatgtataatttcacggtaaatacagctagcacaaggatgcagtttgcaatttatcacaatcgattttaaataaaattacacatccatgttcgtggctactgaaccaaaacatgatgaaatcagatactgggtctagtatttctgtttttagctgttactagagttcatgaacaccagaatataaccgacgcagtaagttactagcagcaagcaactgaaaaacatcaggtgattaaacaccaacagttacaattctagaagacgcatgtctctaatcatttcttctaccagactaaggaacctttcagtcaatcctgtttgtcacgagcaagctgagcccgatgccttagttctgctctcttccatttcaccatcaaccgacataatgtaataagggagctaacctggaatagtaaaaagtgttcaatatgcatacaagatgaactgcaaatagatagagagcataacaccaactaattaataaggactttaataacagggaatggaaggtcttttactaaccacaatgaccatagatatgaagataaggggacccgaccagacgacagaaacaaaaactccagcgcggtcgaagtaatttcgtgtggcaatgctcttccagtgctctgccatatagctatttatcttttcagcaagataaactcctgaatctgcagataggcaaccatggaaccaatcagacaattaatcaaaccaagcagcctactctgatcaatcaaacaaccaggtttttattctagataatttactgccacctaacgtcctgagatatccgttgtctcttcctaatatcagaattgagaagataccaattatagaaactcacaatagccacaaactcaagctctgtagtagactttgagtggcacactagcagacaccaagaatactctaattctacattattgacagaataataaaatgttgatcatttatagtgcactccctctgtttcatattacaagtttcagccttatgcattcctttcacattacaagttttagcctcctgacataattttatcacattctttccactcaaacccttatcatagttcgcattgcgatatcctgaatatttgtcttgtgccaactgccaaggcatcacatctttagaaaggtttagtggccaattctgctttaacttctttgtgctcaaagcagcatctaggtgagcgctgtatgtgctaaagtttaagcaaatgcagtaactcggttaaactgttagttgctat

SEQ ID NO: 41069 - DNA, 1359 bp, Oryza sativa
aggcatcacatctttagaaaggtttagtggccaattctgctttaacttctttgtgctcaaagcagcatctaggtgagcgctgtatgtgctaaagtttaagcaaatgcagtaactcggttaaactgttagttgctattgacccaattactacgacaaggttcggtttatgcaaatggaagattatactaccaaaatattattataccctagcctctcttctccgacgacaatgtctcagtcctaaacatactgcaaaaatatgcaaaaagaaacaagaaaactcacaggcaagaaacagcatgaagagctggaaattggcattcctcctcaacccgacggccgtgagcaacagagtcgcatggaataccatcaagcaaatcagccatggttcctgaaatagcctcagtgccacaagcacaaggcacgcgaatcatcagcaaaagagaaaggaggcggcgcggcgcggcggctggaaatcggtgatctccgctaatctggggatcggggagttagttaccgtccagtcgacggcgcggacgaaggcgagaaggctgtcggcggcggggccgatcccgcggcggagctcggcggagagcgcctggacgaggcccgagacctggtccaggtgcgccatcacggcggcctgcgcctcctccatcggatggcgcgtgcggcggagggcggcagattggcccagagtactcaggaagaagaggggagatgtgctgccgagagttgttgcgatgattcggttgcctgcatatttgcaacgtttaccttcgcaaattttctccaaaatttatcatagagatgttggatgacacacatagtaaggctgagttccccgcacgagaaacggtgggccattttggtttgatgctaaaatgatgccctaccaaattgttggtattttaaatagtagtttggctagtgtttggtttgctaccaaaatatgccaataagacacataagttgccaaaacatttgttactaccaaaatttgccaatgatttggtattgccaatattttggcatgatagcaaaccaaacaagcccggtgttattaagtacttaaatatagataatatgatttttttaaacaactttcctatagaaaacttttacaaaaaatacattgtttagcagtttgaaaaagcatgcttaacgaaagaggatgtttagccgtttgaaaaggcatgcttaaggaaagaggaagatgagctgagaaagaaggggaaagaacatatcttaataagtagacaaatccaagcgtgattaactaagtattagtctaaaagaacttgaaaatagagtagtatgattttttaaagcaactttcatattaagaatttttgaaaa

SEQ ID NO: 41070 - DNA, 1964 bp, Oryza sativa
aaatcagtcctggccttatagccatcattcgagatcaaaccttctctggtagtgttggtgaaaacccgtacctccatcttcgggactttgagctagtgtgttcatgtctatccatcgtaggcatgacacatgaaactctaaagtggaagttgtttcctttttctcttagagatgaagcgaaacaatggtacactttgtctgtcaagaaattccacggtaaatgggaggagcttaagtgtagattctgccttgctttctttccattaacccgtgtaatcaatcttcgattagacatcctttcgttctgacagaacgagaaggaatctctcggtgcagcttgggccaggttttcactgttaactcagtctggcccagacttgtctctacccgatcatgtgttgttacaacattttcgatacgggttagataaggagtctgccgcaaatctcgatatttcccccggaggatcgttcgcacacaagacaactgccgaaggaagagaactcttagatttgatcttagagaacgattctttcggccaaagcgaagccatcccggagatcgagattatccatgaggatcctctgcacatggagtcgaaacccgactcaactgtcgaatcctcattccagtcgctggagccggaggaagaagaaattcattccccggaaattccattccaattcaggggtgatctttatgaaaattatgagaataccctgaattattccagcgaaaagaaggctcatcccaagaatgagccgttcgaggaggtgatgtttgtatcttcgttcgtttcttctggacctatttcccatcttcatgaaactgaacgactctcatcaccctcgatcaagcctaagccttgtccctctggccctcagaacgtttttcttgtttatcaccaagaaacaacccgattcttgcacgatgcatcagttgtgaaggagaaccttcaggccacggacaagcttgagacatcgactctggaggacgagagaaaacattccacatatgagcatgaaagtttttattttgaaattccccttaattcatgctcgcttaagaaatccccagagtcctgtttgattagtaccacttccctgtttgaggaccacaaccacctttcggttctcatttctaacatgtttagaaggatggttgtggatgcttatatttatcataatactgcaaatctcgtacttgtttgtggcactaatcttgcagagcgatgttccgatggtcaagcttttgaccataaacaaagcactgtcaggagataccctggattatcatgggtaagtttccttaataataaaagcaagaaccagttcttaggataatatgcaccttcgggtattcttggtcactaatcatttcagattgagattaagaacgagggtcatgcaatgcctaagaacacggtagctacatcaactgtacactttggtgatccttggtattggaacacactctataggagaatccgacatcacacacttggttttgatgtcttgcgacacaaaagtccaagtgtgggggggaaggtcgacgagcttttcatgacgagttccatcaactagggccatcttagtttgaagttggtgttagtcctagcttgctaaaaaaagataataaaacaaaggaggagaaaagagagacagaagaaaagaagaagaaaaaatgggagaagaagaaaagagcaagagagctgacgagctgcatttggatcaaagaccgcattatgtgcgtgtctttgaaatatggcgatacacctcgctagtagcaatcatgctgcctactcccagtccctctctcaagctcatgtgccaccttggtttagactttatccactcctagctagctgtgcacaacttctcgctcccgcaacacctacacgcatgtaggcaagaggagatgccctcttcttttctaggtgtttgctgctccactctagttggcac

SEQ ID NO: 41071 - DNA, 2249 bp, Oryza sativa
  unsure (1)..(2249): unsure at all n locations
nnnnnnnnnnnnnnnnnnnnnnnnnnnnnnnnnnnnnnnnnnnnnnnnnnnnnnnnnnnnnttttggtggagctgaaactgtttggctgaactccaacttcaggaggggtggaaccggagctggagctgtgccaaacacgcccgtatgtttaatgacaaattcttaattaccagtactaggatgacaaatcattaaatattctccgaatagaatatattacttggcagcgtagatgaaaaacaaatctcccgtctttttatcttcgcttcctgccctggcaaaaacaatggccgctgaacagaacaagggacaagggcggcgatcttcatctggcgagcaaagcaaagcagattcatctctctctctcccatcgtgactacttttggctggatattgtttgcgttcgttcgttaaccctagcttctcttcgagagctggaagaggctcttcttttaatttcagagccttaggccttgtttagtttgcgaaaattaaatttttagttgtcacattggatatttgaccgaatatcggaagatgtttttatacgaatgaaaaaactaattttataactcatctgaaaaccgcgagacgaatttaaggcctgttcactttgatgctattttcaaccataccattttttaataaagttgtcaaaaaatatccatgtctagtttgttgccaaatttaatcaatacataagaaatcctgctaaaattttgacaatattgccatctggtaaggtttattttgactacaatctgagcagacccttattaagtctaattaatctgtcattagcttatgtgggttactatagtacttatggctaatcatggactaattaggcttaaaagatttgcctcgtgatttccatgcaaactgtgtagttagttttttattttatccatatttaatgctctatatatttgtctaaagatttaatgtgacgtttttaggaaaaaacaatttgggtactaaataaagccttaaccttaatacaagtaacagtttgttttttccccccgaaaagtttggggctcaactgaacccccatgtcccaagttggatctgcccctaccgagccgcttcggaatcggactcggctctccgatctcgaattcccctggctttctcgcctataaaagcaagccacgcgggccgcgaggccgcaacgccggtccatccgaatcactctccgcctttgatccgaggagttcgccgccggtacaccctctcccctccgatcgcccgcaccaatggcggccacggtcgctgccgccagcagccggaagcgcgggttctcagtcgcagacatcctcgacgacccgttccccctcccgtcgcaccacctggcgaagcgcggccggtgctcgtcgtcggccgcctccgcggctgacctcggggtgagtttggagttcgacccgatcgaagtgctgcagctcatcttcccccatgaagatccgcaggtattgcaggattcatccatcgatctttgtttaccttctgttctgttttttctggttgctctgttttttttaagcttcttcaccataggataggagcgctattcgatcacgatgtagatgaaaggattgtgatttatgaatgaatcatcagccgcagaaattagcacgcatctattatttttgtgggattcatgtttgcacttgcacaggcacttaattagtaagtagagggttaagacttaagaatcctgattttactgatgagactttagatgttacatcatattggtattgaatacgattcagcattgatcattgtgtttgatgttgaatatgattcatcattgttcattgtgtttgtatctaatttgatctctgtgccagtttgtctgatactgtattttttttatctctttttgaatttgtagctcctgaagagcttttttgaagcgtccggtaatgtgttggacgctgcaattaggggattcaagcatcgtttgcaatctcatactgatactgagatcacagaggcggcttccggtgatacaggaaacgaggtggtctctcctaaaggtatggtaacatttgttttcctttcattcatgattacccttccagaccaattagttaattttgcggaaatctgaaactctcttttactgatggttgttgcagttgaatctgatttgtcagcgatgaacatcccatccaatgggtctgaatgggctgagctagttgtcaaggagatgtcctctgctctagatttggttgatgccaag

SEQ ID NO: 41072 - DNA, 1824 bp, Oryza sativa
  unsure (1)..(1824): unsure at all n locations
nnnnnnnnnnnnnnnnnnnnnnnnnnnnnnnnnnnnnnnnnnnnnnnnnnnnnnnnnatgccctttgttttaggtgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatccctttgtacagtttctccctctcttattataaaaccagcaaaagctggcttaggtttcaaaataattgcatccctaagtaaacatggcctttgctgcagggcttgactacttgtctccatatggagtaatatactaatcactcgccattctcctgctcgtttaatatggctggtcgtgtatccagctagcttgtgacatggctagctattcctgaacgaataatgcccaatctcaaagcaaatctagtttgacatcctcacatatttttggatagagcatcccaagctggaacagcagtagagatttattggattgaaggacaccatgagacaagccacccgaaggggaaaaaaaagggccttaaatcagcctttttctcattgactggaaaatggggaaagaaaggaataatgcgagaatgtttagagaaaaggaagctacaaatcatcaaataattattcgtttccaagatgatgagctatgatgctggggtttggccagtgcaaaacacatgggaaaattgttgtcacgaggagtaaggaggattgacgtgcaagcatgttacagttacacatgtacagttttttccttacttttagcgtttggatgtataactaaacttccctctattaatataacgccgtcaatctgattagccgtttgaaaaaaaaactcaattcctgaacaaaatatctgaaagttctgagtttaccggtcgatacccttaatcagctggaaatttgaatttagaaatacaaaaacatttgaattgggcgtcattctgatttcaatttttcttttggcatcttctcaagcttgctttctcattgcaaaattataaagctcggtaccccattgcaaagtttgcaaccactgcaaagctgaaacagagaaacatggagcagtatctcttcttggccactctactgatactatctctcgccttcgtcaagctcaggccacgcaacaatggcgagaacccgcctccggggccatggcagctgccggtcatcggcagcctgcaccacctcgccggcgcgcttcctcaccgcgcgctgcgtgaccttgccacccgccacggcgagctcatgctgctccggctcggcgagctccccgtcgtcgtggcgtcgtcgcccgccgcggcgagggaggtgatgaggacccacgacgccgccttcgccacgcggccgcagacagcgacgctccgcgcgctcacccgcgacggcctcggcgtcgcgttcgcgccgcagggggagcactggcgctgcctccgcaagctctgcgtcacggagctcctcggcgcccgccgcgtccgctgcctccgccgcgcccgcgaggccgaggccgccgccctcgtcgcgtcgctgtcgacgacgacgcccgagccggtgaacgtcagctccctcgtcgccaggtacgtgaccgacgccgtggtgcgggcggtggtgggtgaccggatcagtgaccgcgacgcgttcttggagaggctggaggagggcgtcaaggtggccgccgggttca

SEQ ID NO: 41073 - DNA, 8718 bp, Oryza sativa
  unsure (1)..(8718): unsure at all n locations
nnnnnnnnnnnnnnnnnnnnnnnnnnnnnnnnnnnnnnnnnnnnnnnnnnnnnnnnnnnnnnnnnnnnnaatcgacgtttgcactatctttgtcttcaacatggttccttttggggaaaggggatccccaagccaacatttttacttttaaacgggctctgcactggtaaataaaccccaatttggtgaccaaatgccaagggattaccctgcatcatagtatattttcttcgtcgttagcttgcccaattttccacttcgtcgaatgtccggctcatctcgcagggagaagttcgatctgtagcaaaacttgcagacactgcatttccgctctagctgttttcagatagtcttggaacaaaatcttctgttattcctcgttgaaaggcatctttgaccgaaacttgacgactagttgcatgggtgtaaaggggcccgaattaaatcgctaaagtctcgttggttatccatcgatcatgcaagaaggaagttcgcaacccatctccaacgtcgacttcagttagggcttgtagatcaggcagcagtttctacattgaggtccagtgaggcccaagtcgaaaagatgttagaagcggagtatctcaggccctatttgggggagcttgtcccagctgcagcttttcccaaaagctgccccaaacagtccacagcttctgagaatctgtagttacatattctgaaaaatgaactaagaagccagaagctggagagctgggtttcagagcttttccagattcttagaagttggctaccaaacagctgcttctcagaatctaaagctccccaaacaggccctgagtgttctttccagatccattttgtccatgagatctttgagttgtacatagggatgaaaacggagcggatagtttccgtccgctccggataaaaatgaatatggatacctttcggatcggatacggatacctttcggatcgtatgtataaattatactacattttatataaaatgagctaattatatatgttgatatttgtttctattagaagttgaattggttttcgtgttccgagaaaaatttgtttccgtattcgtgtccgatcatattcggttcttattcgtattcgagatagtccgtattcgtttccgtatccggcaaaaaaatatgaaaacgaatatagtatgagcattatccgtccgtatccgctccgttttcatccctagttgtacatactgaataggcgtttaagaaggagcgcttcattctgaatttttaggtttttgatttcgagccctccctgtgcctttggcttgcatactgaatcctaggcaaccaggcattgtgctcccgagcagacatcgtctccagtctagagaaaagcccatcttcgtttgtcaatttcctctatggtttctgggggtaatctgaatgcagacatcgcgtagactgggagactgctaagaatcgcgtttatcagtactagatgttctgcctgcgacaaaagagaggcttcccatccagataagaaaccatctaacttggaaaccagaggttgcaggtcagctgaagatagcttatggacataaagaggaagcccgagataggctatcgacagtttttccagtttgcactgtagcagtcctgacaagatcaactccttgttctgatcgacattcagggtaatcactgtgcttttaacccagtggcattagagaactttagaagggtatccttaaggccttgtttagtttgcgaaaagaaaatttctgggtgtcacatcggatgtttgaccggatgtcggaagaggttttcgggcacgaataaaaaaactaatttcataactcgcctggaaaccgtgggacgaatcttttgagcctaattaatccgtcattagcacacgtgggttactgtagcacttatgactaatcatggaataattagactcaaaagattcgtctcacgatttccatcatagccgtgcaattagttattttatctatatttaatgctccatgcatgttttcaaagattcgatgtgatgtttttagaaaatttttgggaactaaacaaggcctaagtgctgtcagcaaaacggaaagagcaaactctgaaatcgctcacactcgctcactctgaaaattgccggacaacgatagtaacctcaagaagttcggggaaacgtcaagaactgaagaacaaagtagaatttttgtgcagcgcaacctctgctgcttttctgttttcactctatattctcctccaccaaaacggagtttgttacatgcacaactgaacggaacgagcaacccggatcggctactgaccgcgccatcccacgatctgaaaccaggtcattcggcagctaaacaaaactgacaacatgcagaaggaaatagctattctaccgaccggccaaaacaaccttcagccagccactacgttcatgcaaaacagaaatataaaatgctcaagattacaaaatatccaacaatttctccccctaatcttgacgcatcacactggagacaaacccagctttcccctcagctccagaaatcggaccttgccaagaggctttgtcagtatgtctgcaagttgttctgctgaacttgtgtactccacttcgacctcctttctttcaaccctctcacggatgaaatgatatcttgtatcaatgtgtttgcttctatcatgaagtacaggattcttgcagagattgattgcagatttgttgtcaacttttaacatggcacaacagggcttcttcatttgcagttctcccagcaaacgtgctaaccaaatcccctgacaggcagcagttgtagcagcaatatactcagcttcacaagatgataatgcaactattttttgcttctgagactgccatgtgattaagttttctcccagcttaaacaacacccctgttgtactctttctatcatccacatccccagccatatcactatcactatagccaactagccgaggaaatttctcttctccctttctgaacttgagaccaatattcagacttcctgccacatagcgcaaaatatgtttcatggcagcccaatgttcagcacctggattctccatgtatctactaacatatccaacagagtaggatagatcaggccttgtattaaccaaatacctcaggcttcctataatgcttctaaactgtgttgcatcaatgcaatcttctactccttttttcagcttcagtctagcatccataggaacctgacaaggattgcaaccttgcatcccagccttctctaaaattcttcctgcatacccagcttgggacattgtaatgccttcttcagtctgtttaacctccattcccaggtaataggacagtaatccaagatcactcatactaaacatacttctcatctgctccttgaattttgctatttctgtccccaaagctcctgtaatgataagatcatcaacatatacccccaccatgagtctggcattaccttcccctctagtgtacactgcattctctgttgcacttcttacaaaatccagatttgcaagtgtagaatccagctttgcataccaagctcttggcgcctgctttaaaccatatagggccttttttaacttcagtactttgttctccttgtgctcaacaacaaaaccaggtggttggactacatacacctcttcctccaattcaccattgaggaaagctgacttcacatccatgtgatgtatttgccaaccctcatgtgctgccaaagcaaccagcaacctcacagtttccatccttgctactggagcaaatacttcttcataatctatgccttgttgctgaacatacccctttgccaccaatcttgctttgtacttcaatatctcaccttcggcacttctcttgatcttgtaaacccatttgagaccaattgccctatggtcagatggtaagtcacagaggaaccaagtattgttaccttcaatggagctcatctcctcttccatcgccttcatccagcactgctccttctcagcttccttgaaactgaaaggctcctgctccgctatgagacactcgtcgtcgtagtcgaaatcgagcaccggagttgtggtggccagcacattgttcaccgtccgaaaacggggaggagctccatcgctttcaatactggcatcagatggtggtgtacagaactcaacaccggcaggtgagcttgatgtcactggagaccacacgggcgccgcgtcgggcgtggccagcggacttggtgcggtttcagtttcccgtgcgcctccatgttccacaaccacgtcaggaacacgatttccacctagcggagtggaaaaaaactccacagtgaaatcctcctcgcctccagtttgagtgacctccggatcacgccatggccacattgccgcctcatcaaagacgacgtcgcgtgacacataaactcgccgtgacaccggatcatacatccgataggcttttgagccctgctcataaccaatgaacaccattcgtgtgccacgatcatcaagtttcctcaaatttggcttcactgtcttgacgtagccgacacagccaaacaccttcaggtgttcgaccgagggacgtcgcccgtgccacgcttcatatggcgtcacaccatccaggctctttgtgggcgaccgattcaatagatacacagccgccacgactgcctctccccagaaatgtgccggcatccccgccgccttgagcatagagcgagcagcagcgacgatagtcaggtttcgcctcttgacgaccccattttgttgcggcgagtatggagccgtgagctggcgactcacaccccgatcggcacagaactcagtgaactcgacagaggtaaattctcctccccggtcggtgcgcagcgcccgcagttttcggccgctttccatctcgacgccggccttgaactgcttgatcgcagccgctgcctcgtgcttgccggagaggagccgtatccacatgaaacggctcatgtcatcaacaaggagcaggaaatatttcctgccgcctggcgttgccggcgcaatcggcccgcacaggtcgccatgaaccaactcgagcgcatcctgcgccctgaacctggctttgtctgggaacggcactcgtcgctgcttgccggcgaggcacccatcacacagttgatcgacgtggtcaatcacggggagtccacggaccatctccgcttgcgccaatctccggagggcctggaaattgaggtggccgaaacgggcgtgccaacgccacgccgtctcggtgccattcgccgccaaacagatgggcctcgccatgttcaacttcagaatgtacaggaagcttggggagcgctttaccttggcaagcagtagaccatcaggatcacgcagcgtgcagacaccatggtatatgtgagcatcgtagtcacgcgcgtcaagccggcctcctcctcttctgcaacctcatgatccagaatcacctttttctcagtgagatgcacctcatgcacaccaggtgttcgcccgagtgtctcctcaccggcgagagacacccccatgacgtgagccatgagcaaggtcggctcctcctccccctgcgtcaggtttacttcccctcgacgttggcgccgcggcttgcggcactgccttgcaaaatgcccaaactcatcacaattgaaacattttaccttggagtagtcacggctggtgttcccactgttgatcgtctccttccccttcggtgacccaccggccttgccccgacggttgttctgggtgccagagctgcccctgctcttgctgctgccgccggagccttcctgctcctgtttccttgcgcgtgcctgccactgttcctccgtgaggtagagcttgtcgccgccaccttcctcctcatcatcactgtatgagttgaccatcgacagccgcccaacgagctcctcaagggccatcgttttcacgtcgagaagctgctcgagggaaatcgccaccggcttgtacttcttgggcacaacgcgcagcagtttcttgttgatgtgttcgtcttccatgactccacccatgtcgcgaatgtccgcgacgacggcagtgagtcgcatcgcgaactcctccggtgtctctccatccttgaagcgcatcgcctcgaattggcgacggaagccctactccttcgcctcacgcacacggtcgacgccgacccgcattgtcttgatggcgtcccacgccgccttcgccgtgtcatgcttcgccagcccgcgcaacatctcgcgcggcaccgcctgaaggattgccgagagagccgcccgatcgtcgcggtactccgcgtatccgggttcaatcgccgtccacaacccctgcgcctgtaggtttacacgcatcaacaatgcccaatccggataattggtcctcgacagcaccgggaggcgagcagtgtgcccagcatctctcccctgtggcacgagaggaaggttcgcgccgtctgcgccatcccccgcgccgctgccacttgcgcctccgcgcccgctgccgcttccgccgccgccaccgccaccacggcgtccgggcggtgtgtatcgcccgccatcatcagacatcgtctcaggaccgtcgtggtaccgctctgataccaattgtcagcaaaacggaaagagcaaactctgaaatcgctcacactcgctcactctgaaaattgccggacaacgatagtaacctcaagaagttcgggaaacgtcaagaactgaagaacaaagtagaatttttgtgcagcgcaacctctgctgcttttctgttttcactctatattctcctccaccaaaacggagtttgttacatgcacaactgaacggaacgagcaacccggatcggctactgaccgcgccatcccacgatctgaaaccaggtcattcggcagctaaacaaaactgacaacatgcagaaggaaacagctattctaccgaccggccaaaacaaccttcagccagccactacgttcatgcaaaacagaaatataaaatgctcaagattacaaaatatccaacaagtgcttgtacatcctcctcttccactcggtacacagatgattaagtatcatccgtgtaccgtatagtggcgcaagggcgatcctggtagacggcgtgtctgattgcctggttatgctcgagcattctttgtagcacatcggcaaccaaaaaacaggtatggcgacaaaggatctccttaccggagcccctttttacatgagatccatctcccaggcactccattgatcaagacaagattttgaggagcagagtaaactctgaatccattgaatccagatttctgggaatcctgtgacagcaagtatttggaagagacttgaccaagtcaaatgcctttgcaaaatcaagctttataattacagttgggcacttccttttatagcaagcttgaatcaattcagtcgtatagattagattttccgagatgcatcttccatggaggaaaccagtttggtccaagtgaatcatcttcattagagctttttggagcctagtcgcaagaactttggagataaactttagtgagaaattttgcagggagataggtctgtagcaatcgacagtgttttcttttcccggctttcgtgttagaacaatgaaggctctataatcctctcaaggttagccccaaagttgtaaagatcctagccaacctcattacatcctctttgatccagctccaagcagcacggtagaaactaggtccaaatccatctggtcctggcgcactagttgaattcatacctttaattgaggttaggatctcttcttgagtgatctgcagtccttgtccagctagaaggttcgaatcactttcttcgtctgtatatagttgttgtagatcaaattcccaagaaggctggcccagaagttgattgtaataggagtacataagttggaattttccattatggtcagctacctctaccccattatgcttgatcgatcttattcttgattttctaaaatttttagaggcatatgctttgaagaaagcaatattgtcttgtcccagcttcaggtgtttcactcactacgcctcagtggcggatccagaaagaaatagcagtggggtctaagtaaactagatagagttatagtccctctcctatctacatatggtaaaaatttttagtgtgatctttgtgggggctctcatagtcttcacgccagtagtgggggctcgagaccccaccgcccccatgctggatccgcccctgactacgccagatcctcacacctctgacgggatatctatgacgagcaaacgatttggtcactgatgaccgtcactttttttttgaccggaattactgccaggactttgcccagcagtgtaattttataaaactcgaaaaatatttacaaagttacagaagaagaaactgaataaaactataaagcttgtaaccaattaaaaacaatttgctttaagggatccttcattctgcacatatgcaaaagaacttctttcacaaaaagagatctctaggcttggaaggagggctgaatgctcttaaagattaaaccattcctcttcttctaaatgtgccaggctgccaaaaagaaaacctccaggaagcccctttgagcaaacttgagtcttgctagagcaatcatctgaaagaactccaaattatgattccactcaattcctaagtgttgaccgtcacctttgacgggtcatacgggatgtcg

SEQ ID NO: 41074 - DNA, 5011 bp, Oryza sativa
  unsure (1)..(5011): unsure at all n locations
tcaccacccctccggtcgtcgtcggccctccggtcacctacccgacgccgccggtgacatacccgacgccgccggtgacgtacccgacgccgccgacgacgacgccgtgcccgccgccgccgccggcgacgcagaggtgcccggtggactcgctgaagatcggggcgtgcgtggacctgctgggggggctggtgcacgtggggatcggcgacccggtggtgaacaagtgctgcccgctgctggaggggctcgtggagctggaggccgccgtgtgcctctgcaccaccatcaggctcaagctcctcaacatcaacatctacctgcccctcgcgctccagctcctcctcacctgcggcaagaaccctccccccggctacacctgctccatctagttcagccgccattcccctgcctcgccatggatggcgcccaagctcaagctcttgtttgtaagtgtgttactctcttctcccatcgcaaataagcgtcagaaataattttgctatgtgtatctacttgtggatttagaggcaggatttctatccattatttaataaaaaacgtcagaaataattactctctctcgaaaaaaaacagataacttttatacgtgaatcttgaaatggcaaagggtatgtctagattcgtgtgtaaaagtttttttttttgagagaggaggtatatatgttgtctttgatttgatactgatatagtgtgtttttttgatggaatatgcaggttggctactcgatctcggcttattgatgtgttaatgatgagtacgaggtgtattaatttattgttggttttaatttgttagtgtgtggaaacatgagaggatgtcgtctgctagctagctagaggaacggatcaatctgctaacgatagattgatgttcgtattgctgtgttttttttttaatttgtttcaatgtttcagcttaattgcatgcttcctcttcttgattgtgtggtgtgatcaataagacagcaactgttcagaaattgtttccgtcaagatcgtatcctatcaagaaattaattaataatgcctgcagcctgacttaagcgtgtaatcctacatacttccatgtgcggacagtgcatgcaatctgatgtaataatgtgtcggatctaagcataatatgtctgagattaatttaattaacctgttttcttcagacagatttatttgtggttgattttggcactgatattgggagagaacacacgtactccctccgtcccattttaaacgtaactatagatttccgtatctaactttaatcgtcggtcttatttgagaaaatctaaaatctttaaaaaaattaaaaaaaacataagtcacttatagagtactattcatgttttatcatctaataacaacaaaaaatactaattataaaaaaaattttaaataagatggacgatcaaaattgaactcgaaaacttacggttgtgtttaaaatgaaacggacgagtatcactcatagaatagttgtcggagctactccctccgtaaaaaaaacaatcatgagtttaaacctgaacacaatgagttgggttcaggtttaaactcaagattaggttgtgtccagttttaaatttaaaattggggttttttttttctttggaacggaaggagtagctaggagagctagctagcccttggatcgaaaaaatctcacatgcatgacattgtgagctgtgacatattactagcaaggagatctagtatagtcaagtacggtcggatagcgagagaaaactatactgtagagaatactttgacgactgcataggagccggaatgctcgatcgatattctgcattctctggagggtaaccgagaggcatgattggtgcaaaagtgagggcaaagcatgtgcagactccgttggcagtatgccgcccgtgagcgaatactgagcagtaactgagttgatgtgatggacatgtaaccccgtgtcattcttgtcttctgtttgtagtagctctgggctgtgcatgaaacacggcaaatgggcaatggccatatgtgatcttaccttggattttatactgaacagactttgaaaaggctgctcgtgagtgtactggccaatatataaagatagccaactgtgtaaatacaagtggcttgaaatattttgcaactaaatttccatataaaatggtacttggttcttctcacatgatcactagtactcactagtgtgctgcttgcagaaaggcaaggatggaactgcacagttatgagtgcagacatgacacaagtgactaattgagttaaatctatggattactctctgtccccaagagactcaaatcttaagaatgatagacaagcatgtgtgtatacattcatccttacttcttccgtcttaaaaaaaaataaaaaaagataacctaggtggtggtttgacacgagcaacatagcctagatatgtcattgttcatgttgcacaggagaagcatatgttttgcccagtatggaacgattacaccttccaatttccaagagggcatctttgaataatctggtacagtagcgcacaagacacagagaaaagaactcactaatcaaggctacaaggatttcaccaatatggccatcggagagcatctaaagctaaagctatacacacaccaaaatgatctttgcgaacatcagcgagtctcttcatctcttgctatctttcttttaatttatttacctggcggggtttcgatgcggtccttgatgatcttctcaccggatctgccttctcgcccttgctactggtgctaactttgtttggttcagcagtctcaccatcatcttcactatagtcactacctggtttctccttgccaccaccatttttccttgtctttctggaaagggcacctatggcatctctcttttgctttcccctggcaaccctagaagttgctcctcgcttctttgtattcaaattatcagcatcttctggatctgtgtctatttccttcgcatcatcgttctctgccacttgttctgggttagcaatgactactttgctagattgcattccagtcagcttctgcagttgtggcacgtatgctgtagtctaaatagtgagagtacaaatcagagggtagatgcatgaatgttcgtagcactagaaagtgtagtagtactgaagcagataagagcttaccctgccaccagctgttatgaactcaattttctgtcctgcaagacatttaaagtagtgggtaataattaacatgttcgattatacaccatcatatatcagcaaaactacaagcgaacgctttgctcaattttattcaagacaataacgagttcatgataaaacttgaggacaatctcaccattgactttaccaggcttcttgccccatcggtgatggaataaccattccacaggaaagcagtcacaatcagcatcaacttcaacagcatatttcacaacctgaaatatgctttatttcaggcataagttctccgtgattgtacatcagtagaatacactaaaattatttaaaataatgtcaaattacacaacctcttggatgctttggtgtagtgcttcacaactctccctggatagacttgaagcaatctgtaatggatgggttctcgactgaaaaaacaacatgaattcataattaaaatttatgcatttcattcaagctctaataatatttgtattaatacctggtaaagcacctcatctgcaatccaattaccaattcctgatatgaagctctgttcaataaaaaaaaaatcaagtcttctgtttgtataggagatacaaggacctaatcccgtatattgtagaaacaattttgtggagctaaaaactcatattggttttatggtaataaaatcacctgatcgagtagaagagcttttattccaatcttctttctgctcagcgagtccgcaaaactgtcagaagacatcggctcaaagagagcatctggtcctaactcagaaatcgggggtacagtttcgggctgcaaatcgttatttgattagggacatcattagaaaataacatgaaaggaagactctgaagatttagattcaactagtcaaagcacatacatcttcaaacaaccgaactcttgcaaaccgcctcttatcagtgaaggaaaactctaagccatcatcaagctggaacaagttaaatgcattagaaacaaccaacattaaaagagccaacctatgatatcataaaaggacataaacaataagaggagatcaaattttgactaaacaacaatgcctaggcatgcattgcgtgttctattactattcaataaaccttatatagcagaagtaatattgacgtgtttatatgatagcatgttaaccctgagacatggcacgtcttcctttctggctttctggagatcacaaaagcactactgtttgtggcgatttgtcttccgcattttggattagctagtccgctagaggctcagccaaaacatgttttctgagctatatagcctaacaaatcgatcttgtgtcccagctaaacgatgacagttactacctatccatctctctctttataagacccaaccaaagtagtacagtacagtactgatgaacaacaattccatatcccctttagcttataaactgttaattttgatctcacatagcagcaatgtactgaaaaaagatgctgtgacagctaggagatcttacttgaacaaaaaatttggagtacttggagggccactcgtctgtagaactgacaactgatctgcaataattttttgaatcagcatgtagtccattactgtataacaaattccccagcatacaaattacacatgcctcttgtacttggtcacaggaactcccttaatgtagatcgcgcctgccatccctgcaacacacacagcaatttgtcactccaatttaccagtagcaaaaagcaatnnnnnnnnnnnnnnnnnnnnnnnnnnnnnnnnnnnnnnnnnnnnnnnnnnnnnnnnnnnnnnnnn

SEQ ID NO: 41075 - DNA, 803 bp, Oryza sativa
  unsure (1)..(803): unsure at all n locations
annnnnnnnnnnnnnnnnnnnnnnnnnnnnnnnnnnnnnnnnnnnnnnnnnnnnnnnnaagtgacacgatttactcaaaatgaaagaacaataaaaaggtaatacattagaaagttggcatccactacccaatatgagatagttttgaaagaagctcagttcttcgttgataagtgctgaacttcttttgtcctttttattggtctaacaaggttttctcacttgtaatccactccaagcacatttatgttgtagcatagcggtaataccagagacacaacatttccaatctgtacgtcaatccaaattgactgacaaaaataacgtgatgataatataagcagtactcacaactatggatttcaagaagttgtcagcagtcgcactagcttcaggtgtctgagcgatccaagaaggaatcatcacacagtaactccatccggtttgagggttatgtggccatatggtgttccttccctcctgcagatcaataagcataagccgtaagaagcatcaagcaatggaacttttcatggtatcctattgatatggcatcatctttccagcgaaacctagattgagaagttatgtggtcttcatggaagtacattttctttaatacaaggaaacatcttcaaggaacttttccagttgtttgaaaattactgaattttgttaacgaggcatgtgatttacttgacggtgaaaaagaattgactaggactagtaggttaatcttcatttgcgttctaagatcattcatggtaaatgtggtaaagatgttgggaaacaccccaagtgcc

SEQ ID NO: 41076 - DNA, 3552 bp, Oryza sativa
attaaactatgtggtaactttagctttatacacatatatctataaggacctaaattgggtgaggggtgttggggttgtttggaataggcaaatcttggaaggatgtatgtctctttgtcttctagcttgttttgtttattagcaattcgatacaaaatttgagtctttcagtgtgctttagtgcaattctttaaatatgatagatctggtagtctgtggtagaggatttgttttcctgtgttcggtcatgcaacttgccgagcactctgatagtggatacacaatggaatcctagttgtcttcaatcaatttgctattttgcgctcgcccatctaatttgtttgttttgggtgttatagggcacaatatattcatttgtgacaagttgtgttttgcttcatcttatatatttataaacattgttatgaaacaatagcttttttgctgagtggtaacagatctctaaagaattatctgagtggatattcctgttagccataagaatacatgtttgacatattcctcaatttcttattacgtgcaccgatgctgggatataaagggcaaaatcataagatatactgttcattcaggttgtttttctttggtgtctggcatgtctgaactgtatgatgatgtattaatgttaattttagtcctatagtctctaaaatatgcttgtttcatttatttaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaagatgtgtgacctttgcagcattacacttaacaagaatgctgtctttggtgacagcagtgcattggctcctggcggtgtccgcattggtgagtgcattccccttcacagaaaatattatcatgctaatgtagtaacatcttatagtccggatcttgctgattgctatggaattgattcatggttacaaaacacaactctgcaaaatcatgaattaatctgatgcgaattgcttcgctccatgtttcactacagagcctctgtccatagatgatagttatatcgaacacaagtgctactactggacctttctttgcacaagcaagtatctcagacggattctggctggttttcaggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaagacatcgagaacctcaagctggaggtcgagaagttcgccaccttcttcgacatgcccggcttcaccctcgacagcatgaagtacaaggagtaggaaaacaaaaacacacacaaaccatggtcctaccgccgctaatcgtcgaccagctgtgctctcgtggaccgccgtcgtcgtcatcttcttcctcggcacaagctggccctgtgttacggattttgtctgcccatcgagatgataggtttcataaacggctctctcccccaccctgctgctgcctctggtttggttgccaacctcatcccccatcggtttttttcctcctcttgtttctaatttctaggagctgtgccttttggaatcatggaatgtcaagtatttgccaataatcaatccgtttgatttctgcctaccttgtgttttctgtgggattgctaaactatcaaactgtgcgaagctacgaaaaaaagaaatgctggaatttttcagagttgggtacatggatgtgccactgtcgtgcagcgcattgccaatacgccgactgctgtagattgcaacgtgacggtacgcgtcgcgcgttggcggctactagcgtttaattgtgtagggatctctgtgcggcgttaggtctcgccatggaagggaaagggagaaagccattacactagctgtacaggacggtctggcctggcggtgcccacacatgctgtgaggagcgtgtggcaccgctgctgcaaccacaacaacattgatgtgcttttcacgtaacctttttaccttacgtgccgtccttttttagaaaaggaaaactctcataactttattagatcaaagagcagttacatcgctcactaaccgcttaattgaagctactggctcctccaaccaaatagatggtggattaagccaggctgctctagcaagctcgtgagaaactaaattagcctctctaggacagtaaacaagagttaccaatgtagaagcttcagaaagaaccacacattcattatagatcgccgcagctgctgtcgtcgagaaccctccattttgcatcattgtgatgacttcgatacaatctaacttagtgatgattcgatcaacttgttgacctctagctagtaaaattccattcctcaaggcatgaatctccgcagtaatactccatgcgatcatttgccaatgctatgtactctactttatcatcccaaagaacatctcctggcaatggcatctacattcaatttaaccattccctcttatggttgacaccatcccgatctagcaatgcctatattcctcgggttggcttttcaatagtttaggggagtacaccaatagccattgccgccctcgttggttcttgcaccttctcaccatgaaccaattttctcccaccaaatataccagatacctaccaagattagaatctgagcactcacataggcaatcaaacttgctttctcatcacaacataatagatattctagcgatgtcgaacctgcttgtgtcatcttttgtaggggtacactgtactttcaaataaccacgtagaattcatgttgttttctttgagattagatcttcattggtcgagactattgggagaaggattaagggtgctttctagagagaaggttgggaatttctctcctgcacacgtaaaacgtgatgactcattagtacatgattatttaagtattagctataaaagcttgagaaattttataaatacgatttttaaagcaacttgcctatagaatatttttaaaaaatacactaaattaaacggtcgggaaacgtgtacgtgtaaaataagaaaatagaagttgaaaacatgtagttccagggtaccgag

SEQ ID NO: 41077 - DNA, 1135 bp, Oryza sativa
ggccttgtccgggaaggaggagagccacgtcgcgaacctctcctccagctcgcctcgcggtggctccggcaccagtggccccgtggcgagcaccggcttgccatactgcgccgcgatgtagtcgatgtaggggccttccatctcgtggcaggtcctgatgacgagcgcgtcgcaggcgttgtggcaagcgacggagcggtcatgcgtgctcggcatgccgtggaagctggtgaaaatgtgggtgaagtgggccggctggtaggtcggcaccgtggagagcggcgacgacggcgggaacccctcgggcgccgacgcgagctcctcggcggtcgggcgcgcgccgtacaggccgcgcccgtgggccatgaagtacgcgccggagaccgcggggaagatcgagaaccgcgccgacctgacgcgaggacgcctggcagcgtcggcgacccacggcgtgacgaagtcgaagagcacgacgtccgggcggagcctcgcgagcagcgcctccacctgcggccgcgtgccgtcgagggcgagcttgagcagctcggcgccgtccgggtcgacctccgccgtgctctttgtgccctcggggagccccggaacgcgcggcagatgcagtgccacgacggcgacggccgtccgcaggcagcatggtctcgagtctcgacgtgggccacgttggccgccgccgacaggaacgtgacacgcaccccaccgacggcgaggaggctacgggccagctgcgcgaacgggttgatgtggccgaaggcaaggaacgggaacaacactacgtgcaacgtttcgccggcctcgtcgccgccggcggccgtggcatccacaccggccatgcttagttcgggactgcttttcagtgtgaagcatttgtaccccattaccatctatatatacgcggatggcgcatggctaaatcaataattagcacatatcattaacaattttgttgtatttttaaaattaacatgcaagcaatatcaaatcattattttcacattatttaaatatatattatagatattagagaagttatctgtcaattttaggtgaaatgatctttcagaaattaaaccatccataaatatttcttccacttttttgctatccaatgccgtcagcg

SEQ ID NO: 41078 - DNA, 3784 bp, Oryza sativa
  unsure (1)..(3784): unsure at all n locations
nnnnnnnnnnnnnnnnnnnnnnnnnnnnnnnnnnnatggcgcatggctaaatcaataattagcacatatcattaacaattttgttgtatttttaaaattaacatgcaagcaatatcaaatcattattttcacattatttaaatatatattatagatattagagaagttatctgtcaattttaggtgaaatgatctttcagaaattaaaccatccataaatatttcttccacttttttgctatccaatgccgtcagcgcatgttagatatacacaattagcatgtagctatcagtttaggtgaaatgacatactctagtacatatactgtatgaacgccttttgttgctaattattacgtgcagtgataacacagcgtacaaaagtaacgcattgggtcctaaatatgatagggccaaagtatttcagaaagaatcctggttgttcttgtaagagtattagtaacttgcgcatgcaaatgtattttgcagacttatccacatgcgtgtttcccgctatatacctttgcttcaagctaacatcttgcagactcaatatatacaaggcaattcattcgcatttgcagaagaataaagaatcaagcttcattaaaatttcgttcaatcttgaaaagtgaatgttatagataagacatcattaatattttttttggctcggcgagacccaccatatacaagtcttacatgaaatcatacctcacctacggacggtgttccgaataaggaaagagaagcaaagtcctacttgagcacgacaagcaccactcttatcgtatccatacttggttatctaattctacatagacaagaggacacctgagggtataaatacaagacccccagtaggagagacgacacacacgggaggcgaagaaaaaaccaatacggatctaggcaagccacacaatacaatttcaatctcgccgtgtgatattcgaggaggcagaatacactagccgccgaccacatgtgagagttctatgttgctaagctgaccgggactagattaagtcctctccaatattgtactcgtgtgatattgatatataaaaggcaacaccggcttcagccgataggagtagggctattacccattagttacgtggtccgaacctgtataaaagtccccatctcctggctcttttacctcaatctcgcgtataccatgtcactaacaatttccatattctacaaataacggaggggggtatagcccgtccaaaagggcgtgccaagtaaggggatatggtgcttcaagggttcgatgagatggggccaaaaggcgaatcgcgtgaacaaaaaatctttgacgacttcagacctaagagatatgactcgactgaattacacaccacttcaaatcggaatcatcattatcccaatctttatcatgacaccgctgctatggatttccgatgacaaagaatcgacgacttgggttttattacaatatttcgtaaccatcatcgctggttacggtccttaactaccaaatttgaccatcaattcatgcataaattttaccatagtctaccactaaatctagcggtaggggtttattacaaaccacttccacaagtgttggtgaatatttgtatgcgggtgaatacttgtggaaattaagagaaaacgcaagtaagagaaacaatttccagccatgagagaagagtacatgaatcaaagggcccacaccaggaggtgaaccgcctcaacgtcgtccaaacaccccaaaccgtcacgtggacctaccaggcagtgacccagataaaaggcggcgcgagggggcttagccagggttcggtcgaatgaggggtggctcccctctatcacaatttccacatagcatcaattatctctctcctggagacgttggtgcaaggctcacggtgagtaaccgctatagaatgtcggtttgaggacatgctgtggcttgaaaggagttggaggaggaatattctctcaaatcacctccacattataaataggcctccattccttactctcaacacacaccaagatataaatcattgctacattccaaaggtgaagatctacttagctagttcttagagtagggagtaaataagagaatgtctggagaagtgccaggctgggctgtcggcattcttctcctggggaagtgcaaggtttgtcggcactcttctccaaacttgtcttcatataagtaagcattcatgacttctttgttgtatttactcttcttatttaagtaagatattttctcatagttgcggattcattgctctacttaggtagagtactttagtcttaagttggtaccgagattagagtagtaatcaatagcatatacattgtgtctaggctggaggttacatttgtttgttgtgtgctccacgggttgtaggggtaggcggtaggtgatgacaaccctgtccctctttcctaatccttaacattcggatacattatagagttgtaagccagagtcttttaggtaactaaaagattttaagcactaatcatcaaagttaaagggagcatccttagctggcaagctggtgaggggtctagctactaaagaaaaatgattaatgaaccgacaataaaaccccgcatgacccagaaactacggacccctttaacattataggaggtcggagttgttggattaccacaattctaactttgtactcctgtactgctttttcggagactcgatgttcgagcactattcctagttaagcacaaaatccttttcacgaagtggcacttttactagttctgaaccatgaaatgacacttttcctagttaagcaccaagtcctcttcatgacaccgctgcaagactttgtccaggttctccaagcattgatcaaaactctttctatagatggataagtcatccatgatgatttccatgatttcctcaatcatgtcggagaagatagacatcatacaccgttggaacgacacgggtgcattacacaaccgaacgacatccgctggtatgcgtacattccgtaaggacattgtaacatcctcaaattttaaaactaaaatttgactgcatcatgctggcttttgattaatttagtgtgttttaaaaatctatttgattcctaagtggttcaagtattacttctttagaaccctactaatttaccctaattataccctttattccgaaccttactaaatttgagcaaattctctcaaatttcaatctttagattatttccttaatttaccctaatattagtaaggatttgctatactccaaaccatagtgaaacctttccaaattcatagtttaaattcaaatcttctcaaggaaaatattcaaaattgttgaatttcactgttcatcgcacacaaggagctcgatgaaatgcctagcccagctaactcagcccaatctctacccaatcttttgcaaagtctatgttggatccttggggaccacatcccactcaaaaaccatggtttagttggccttctcctccccttctcgcgcgctgcctggcttcctaccttgccgcgcgccgagccgccgcgcgtcggcctcgggacccgtcgcgcgtgcccgattgccttggcgtgtcgtcgcccgtccgacgccctcaggccgccgccgccgcaccaatcttgacgacgacaaagccgggatgacctccgccgcaagaaatcgccgctcgatgccgtgcgttcccgtccaaagccgccgccgagtccgattttgattctacccagggtgaatcgcgccaattcttgccacacggttgaa

SEQ ID NO: 41079 - DNA, 2082 bp, Oryza sativa
tagttaattaattaggtgagtacctattattgtaaaacccgtagtgttgtagaactttaatgtatgcaattaagaaccagttatattgtatgtatcaatatttactgatccagggattgatacattaatcatagtcggatccaagtaatagttctgggacccgacggacatgtaaacattgtcttgctttgatcatcggcatagatgggaatttgatgatttcctagctaatccagcatctcatcaatgaaaggtagcgggaaatggtctttctttgtagctttgttgagctttctgtaatcaatgcacatccttcatcccgtaacaatgcgtcatcgaatcaattcattcttcgagttttgaatgaccgccatgcctcccttcttacgcacaacctgcaccaggctaacccactctctatacggcataaaatatattatcccagcgtgtaggagtttcaagacctattttttcacgacttctctgatcgcactatttagcttctgttgcggctcttgtgcatacgtaggggtaacgccccagggcctgaaaacgtatcatcccgttatagtgcgttgtcggatcaagtcgttcttcaagttttcaatgactgtcatgcctccattcttagtcacagccttgtcgcgcccggaaaaataccttttccagaacactagtgtattaatacccgtcccaggaaaagccgggatacaccaaacaaatatgatacaaaaagtacatatttattatattgataatatttacattattacaaaggcacttcaggcctgacaaacaaaaataaacagcagcggactagcgagcctacgactccatgttcacaggcgctcaactggggtataagccatgactccacctaggacttcttctccaaagcttctcttactgaaggggggaaagatagagcaagaatgagtacaaccacagtacttagcaagccacaccaggagatgcatgattaatgcaagggggtacaaggggataataataggggttaagtttggcagtaaacagcatttaaaagtcacttagttgcccaaagctattttgtaaacacgatcctagagctatacaatattattaatcaaggccgtgaacccacatgaacctgccttaacccaaggcctacgatgatttagaccgaattggcaacctgactaggtcccagctcgtcccaagccaacccaggccaaccattccacattttagttgttaagcagattttaagaattaaaacactaacttgggtacattgctaggcttgcccaaaaccaagggcgcggctattcgaataggttatactctgatcagaggtgtacatctttacccaagacacatctttactccacattccatggccttggaactcgtcgtaaacatgtgacataacccttcacccatcctagccgtgaacaaaagtaccgacccaaccctgcctacggccagtatcctagataggcaggccaggattgagcccctagcaacaggatctagaccgggtgcgccacacacataggggtgagaccacccgcgtactagtctagtgccatggcatctcgactaacgggcaccgacccgtgtagcattcatttgtctagacatctcgattaccaagccgcagctcacgtagccttcatttgcctcagagatatccatcgtctcaacgacttcatccatctctatccgtgtccttttgttcaggactagactgagcaccgagttaagccttacccattagacatatggttagtacggtagtgctttgcaacagaggcccgaagaccggtccttatggtggccgaggtgctcctagcaaaaccatgcacctcgagcccagcctacaaccatttaggagtttgaatagagggggaggtgtgtgttcaattccatcacaagccaaccattccataatgtccaaatgatatgagaactaattaatcagttataaaaccatctagtgtggcataattaatcagcgaagcatctacctaaattcatactagtggaaccattaatacagtacccactagttggggttttgttttcctagggtaagcgagg

SEQ ID NO: 41080 - DNA, 7222 bp, Oryza sativa
  unsure (1)..(7222): unsure at all n locations
taatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatattgtttatattttgggacgaaaggagtaggtgtttttatatcttgcagtaaatatcacggactttaagtgtcttcgcaaatttttccaaagacttataaatcaatactcgtaataaatacagagattacgccagggagctaatcgcgtacaaccgcgcacctacagttgtggccagaaaacgtttcgcgcgcccacgaggcacgtgtttcagttgatactgttggacgtaaacccgtcggcccaacaaccagacaagaaccaatcaaaaccactgcaaaataaagccgattttggtatacgtctcacgacagattttttgcctcaaatcacccgaatttgcttccgtcggatctcttgggcatggtttaatttgacggtcatgatttatccccctaccaccgcggcaccacctagcagtatctttaccgggcacacaatgaacaatacaaataaactgatgagtacgggcaaaaatatgaacaccatggtttaatttacagtgtatttttattaaaattacagtgcatctacatgctatatctactatttttacaaatgtaattttagttataaagcactgtaattttagttataaatgcaacatttaacacttcagatacctggacggtttctcaagcagtgcatttgtactaaaacgacaaatattctagttaccaaaatttacagtgcatttgtacttaaaattacggtgcacttacatgccatatttattgtttttacaaatgtaattttagttataaagcaatgtaattttttgttacaaatgtaacatttaacacttcagatacctggacggtttctcaaacagtgcatttgtactaaaacgacaaatattctagttaccaaaatttacagtgcatttgtattaaaattacagtgcacttacatgccatatctactgtttttacaaatgtaatgttagttataaagcactgtaattttagttataaatacaacatttgtgttaatctctactaaatactactctattaaccaatacaatcacaagctatacctggacggtttctctatatttttttaatggttagatgtaaatataaggagagaaaaaatattttttctcgaaaatcacacgacatatgtctagacagtcccaaataaagcagtagaaagcgccaaacgcctccgaatcagtaccccttccactactactgctcgtgctcgatcggccaaccatggcgtcgggctccaccgatcccctcctcccccgcgccggcgccgcacgccgccgccccgccaccggcggctggaggtccgcgctgttcataatctgtaagcacagctgccaccccagatcgcgtctcctcgatcgaaagctttgcttgaatcgtctccgctggtttttaggggtggaggtggcggagcggttcgcctactacggcgtctcgtccaacctgatcagctacctgaccggccctttcggggagaccaccgcggcggcggcggcggccgtgaacgcgtggtccggcgccgcgtcgatgctgccgctgctcggcgccgccgtcgccgactcgtggctcggccggtaccgcaccatcgtcgcctcctccgtgctctacatcacggtcagttgagtttcagatgctaaccgaacagcaccgtaccctccagccttatccattccgttctcgatctcatcgatgcgttttctttggggattttgttcaacctgctcaattccctccgtacatttgctacttctacattttaacctattgttttatttgttcaacctgctcaattcctccgtacatttcctacttctacagtgatccttgccataatttatcagtttattctaaaaaaatatttattagccatcttgcgcagagttcgatatagtatcaagggttacgcctagtgacctgagtagtattccaaagatcctaagttcaaatcttctatgcagctaattttaaattgggttatttgtggggctaagttttttatttcaatggtcgtatatatctggttggacgtagatgccagttaaaaaatacccttctcttaaaaaaaaaaggatttgagagatctcccacgcaatggcattatccgcacgcggttagttggaagcattttccgtttacgctgcgctgcggatggaaagtgactttacacgcaagtccaagcgaacccgttctgaattgtgatttactgaatttaacaagactttgcgtgcagctgctatcttattacgcccaagtcaaatgggcatggtttttcagttgatattgttgcacgtaaacagcatttcctgacgtcccgggagaagtttcagtttcaattggttaatttaattgtcccttaatttatagcctgggtcgtgtagtttccagtggccggtagtgatcatgctcaacacgttcagtggagtgagaggacgtatcaggcatgtgtttatttgcatactagtctccaaatattgttttctaccaataatagggttgttgctttcaatttagctagtagtctattttcgaaggaacagggtagtagagccagccacatcaataatctttcatgccattgtgtttactgtttagtgataggatcacaccgcgtcttgcagaaaatatttatgtacctgcccattgcaattgaagttcttcagctcagtgtctgtttggaacacattaatttcacatggatcagtgtctgtttagatcccaccctaaaattttacaccctgtcacatcgaacgtttgaacacatgtataaagtattaaatataggataaaaaataactaattgcacaaattgcgactaatttgcaagacaaatctttttagcctaattgctacatgatttgacaatgtacttttacagtaaacatgtgctaatgatgaattaattaggcttaataatttcgtctcgcagtttaccgacattatagatggccatctgggccgcccggcacggcacggcccaagcccggccgtgcctgggccgaggcttgtcgggccggcacggcccgaccgatgcaccgggccgtgccgtgccagcccacgggcggcataaacggcccaggcacggcccaatactagtcgggccgtgccgggccggcccgaaggcacgatgggctattgtgctgcctcacagaaagagtttatatttggtccctcaactctgtgggctgtgtttaaatggctggaaataagtctatttttgatccctcaactctgtgggttgtgtttaaatggctggaaaataagtctattttgtatacctattttcttgggccatgccttatacggttatataagtctattttttgtccctatattttttttatttgatcgggccgtgccgggccggcccaccgtgccgagggtgcagcccaggcacggcccagctatcgggccgggccggcacgggcacgaccctagtcgggccgggccgtgcttgggccgggccaaaattgcgggcttcgtgccaggccgtgggcctcgggccatatggccatctataaccgacatactataattagttttttttattagtgcccaaacaccctatgtgacaccctatataatacctgatgtgatacactaaaactttgcatcccagttcaattcttgtttgaatccggtaaaataccgacgttacaattacggttttgcatgagaaaattcctcggaacaggacctaaatatatttgatctcgcaaactgcgctcacctattcaccatggccaaacaacggcagggactgggcttgctagcgttgtcgtccacgttctcgtcgcctcagagccaacaatgcagctcctccggcgatggccggcaagtttgccggtcttcctccgtgcagagggccttcttctacgtctctctctatttggtggccatcgcccagagcggccacaagccgtgcgtccaggcgttcggcgccgaccagttcgacgcgacggaccccggcgagtcgtcgtcgcggagcaccttcttcaactggtggtacctcgggctctgcgccagcgcgaccgtcacggcggcggtgatgagctacgtgcaggacaacgtcggctggggcctcggcttcggcgtgccgggcatggtgatgctgctcgggctcctggtgttcctgctcgggacgaggacgtaccggttctacgacggcggcggctccggcgcgttctccggcgtcggcgaggccgtcagggcgtggaggaagagccggcggcgaggagaaggcggcggcggcggcggcgccacggttgaggcggagcacggcgagctcgcggaggaggtgagggggatggcgaggctgttcccgatatgggcgacgtgcctgctctacggcgtgctgttcgcgcagccgccgacgctgttcacgaagcaggcggcgacgctggaccggaggatcgggccgtcgtcgtcgttccaggtgccacccgcggcgctgcagagcttccttggcgtcagcatcatcccctgcgtgctgctctacgagcacgtcctggtgcccgcggcgcgcagggccaccggcgtcgccaccgggatcaccatgctgcagcggatcggcgcgggcatcgcgatgtgcgcggtgacgctgctggtcgccgcgctcgtcgagatgaggcggctgagcgcggcgagggacgccgaccccggcgcggcggtgccgatgagcctgtggtggatggtgccgcagtacgtgctgttcggcgcggcggacgtgttcgccatggtcgggatgcaggagttcttctacgaccaggtgcccggcgcgctcaagagcctcggcctcgcgctctacctgagcgtcctcggcgtcggcagcttcatcagcagcttcctcatctcggccatcgacgtcgtcacgaggagggacggcggcaccagctggttcgacgacgacctcaaccggggacatctcgactacttctacctgcttcttgccgcgctcaccgtgctggatcttcttgcttacgtatatttttcgatgtcttatatttacaggagaaaggttgtcgatgttcaatgatccatggatcgatgcacgcaatgcgcttgtatagatgtatattaacctgctgaattcagcatggttataacagtataatggcaatgccaggggtaaaatattggtgtaaaattccctctttacctttattttccttctagttacaaataaagaagtgagaatcgaaattcattgcctgcactcttggtggtccgccctttaaaccgtagtacaagcacatcttctatcccttggattggtccggagataaaaaaaaaccattcagataattatgttgaacaactaatcggcctaatttgaccaatgcatttgtgccctcgccatgtgacagttttagtggtgaaaagttaaaactgcagcgaaccaccaaactaggtgatgattctcgtaaagcatggccatgggcagagcatggtgtcgccacgttcaagcaaataccgaggaacgtgatatagcccgtcttaggggaaaaaagaagtacatatggacaagcaagtccaatggctacaaactaaaaaacacgggcacacaacatgaatcttgattcttggatttgatggcattttcttttctactatctgcgaagtggtgcagcagaatccctcgagttcgtcaatgtcttccctcaagtgtgcttttttaaagttagaacgaacactagcgtggcgcctcctgggagtcatggaccatcggaaaagcctctgaaacattcgtggcaccaatttacttgttactggcatcaaatatgtcctaacatttttatcttgaaactatcttattcccagttcgatgatacgatgaattgctctcgcagcagcaacagaagggatctactagcaggaatgcaggacaacagaagtggtctctgcctctctcaactgagagaacaggatccggcaggaagcataaagcacgaaaagaactcttttggctgaaagctgtgtcccaaacaaattgttcatgggtcaaaagaagtcttaaatcgtggaaagttcagcattagtaagattttaaaaatcgcgtggagactccttcaatcatggcaaagtctcagaaattgatgggataataactgccagtagctcaaggcacacaagcatctgatgttctcgactctcaagccaccacagcataaaacgtgtaaagcactggagctaaacatacactcaaacagggatttggatcctctgatgcctacaaaggcagaggagccggatccctcaaacagacactggagctttatccctttatcccctctcgaaatagtaattcaacaccggataaaaattgccctgatcaaatatactgaagtagtagtagcaccaaaattccatgtccatacaaattctgatccattgcctaacattacgacggatgcannnnnnnnnnnnnnnnnnnnnnnnnnnnnnnnnnnnnnncctactcgatcactcactcactcaccagtgtgaccagttcactcctcgagctctacgaccggctcgggcagcgtgggcagcacggggtagttgcgcgagaagcaggcgtcgcagtagccctccgcctcggcgccgtagatgctgtggagcttgccgagcgagaggaaggcgagcgagtcgctgccgatctcgcggcggacgccctcgagatccatccggttggagatgagctccccctcgctgggcgtgtcgatgccgtacaggcacgagcccaccaccggcgggctcgcgatccgcatgtgcacctcgcgcgcgccggcgtcgcggagcagccgcacgatcttgctcgaggtggtgccgcgcaccagggagtcgtccaccaccaccacgctcttcccgcggatcacgccgtggaccggtgccagcttgagcttcacgcgaggtcgcggatcgcctgcgtcggctggatgaagctgcggccgctgtagtgccaccggatgaggccctgctggaactccagccccgacgcgcgcgcgaacccgagcgcggcgtagaaccccgagtcgggaaccgggatgaccacgtcggcgcccgcggcgggggactcctccgcgagcg

SEQ ID NO: 41081 - DNA, 5217 bp, Oryza sativa
tcacgtgcccgatggcggctggcccggggagcgatgccagccgtgcggggtcaccgaacacgtcggcgacgaggccgagcccggtgaccgacttgagcttcccgtcacccccgacggcgacaatcccggcaccctcctccccgcggtgctgcagcttctgcagcccgaggtagcagagcgacgacgcgtcggggtcccccacgaccccgaccagcccgcactcctcgcgcgggtggtcgtcggactcgtcgtcctcctcgtaggagaacggggtgacccggtcgggcagcagcgccccggccgccggcaaaaggcgcagccggggcagagcgagagaagacggcttggaggaatacctgagctgctgctgctgcttcgacccgtcggcggcggcgtggtggtggtggcggagaagaagaaggcgcgacgttgacgcggcggcggcggcggcggccattggtgagtgggggaaggggagcggcgcgagggattgggggggaatggatgggtttcccctccgagggcgaggtcaaggggcgggatttaaagagggttttgctcgtcgccgtctctccgccgtaggatgcgatgtacggtgctgaatacataccatcggtatccgtatcgtatctcgtacgtgtaccggctgctgttgcgttagaaaaaaaaaaggaattctgagtgcgtagtggccgagctcgaggctcgaggagaatgggccactgatgggtgggccctgctatggtggagtagtagtagccgcctcgagcgctagtggatttgaccaggccgtgtgcaggtcggcatatggcggcggctggtccatttccggtccagggttggggtcccacgtgtgggtactgtgtcggtttcagacttttcagtggacacacacgggtgtgggctgtcatgcgatctcctttttgggctggagttactgtgggctgccatgagacctccttttgggccggagttactgtgggctggataggcggccttgtcggagacagtcacggctcggcccgtcccatttgtttgatggacccgaatactgtcgcatattgctgatttgcagttcccctctggtaaagtgcaagatgacgttgaggaggtggatgcgaagatgcccgtcagcacacaccatcacttttcaccttatcacatcactaaccaccgctaactaaaactctgaaaacacactaaagcatagaaacacataataacactccagtccaaggaatcagtcgttagcacggaggaacaaacaccacgttagcaaatacgggaaaaaaaaccctccagtacagcgaagaagatgaatgacaaaagaaaaaaaaaaggacgcacgagacagcaagatgcagagacgaacacaaagcaccagcaactaataaagcaactactgttaattcatacggagtataccccgaacacgacttgaagagtgacgaccaatcggcattcgagcgaccggctctcacaagtgacaaaaccgggagcaaaaaaaaacaatggaaaaacacaaggcggccacgcgggaggtccatcggccatcgcaattgaagcacggcgatgggggtatctgcaggttgtcccgccccgcagggaggtggggcctacgactacgatgaattgggatctggatcgcggcagaggcggggggagcgcaggaggcggcatgtgagggggcgtgcgtgcgtgcgctgtcgcggtggtggagccgtccgcgagatcgtgccatcggtccttcaccgtggatgctaaccacgctgcatttatatttgctgcgtaaaactcctctctgcttcccggctccctgctacgcgcacccgaccgtgtgattgatattgatactgataagcagtgacatccgtctgtaaaacatacacactccgtcccataaaaaacccaatcttatttacgaacctggacatatacgtgcccaggttaatagctggggtttgtcttttttttttggacatagtagtatttttttcaacaaaatacgtactaacacgtaaaagaaaaacagaatatgtagggtgacaactttcatgtctaccgaaattccaccgagtgtatttaatggtatcgcgtgatctctctttacatgagaacctagccatagtacattctcattttaccgtcatcaccttttctaccctagtgcgtgttgtgcatctaggggtgggcagaataagaccgaaccgaagagaccgagaccgagatcgaaaaattcggtctcaactattgaaagaccgaaatatattcggtttatttggtcatgggccttaattaaccgaattgaccgaaataaccgaattaggctcaatagatctagttggtccaataaacccactaataagaaatcctaggggcaggtgcgtcacagcctcacaggcatcgacgcatcgtttcatccccatccatcctggagcggcgccgtcccgactcccgtctccatcccatccgcatccttcttcgctccatcgtcgggcgccgcttccgcctccaccgccggcgccgcctccagccggcccggcgccgcctctagccagcgtgccttcacctccaccgcctggcatcgcccccagccggcccggcgctggctccaccgccgggcgccgcctccactaattgttgatttgctttgcttttgctgtttttacaaatagttttgttgatttgctttgtttttgctgtttttacggctagttcggtctatgaccaagaccaaaccaaactaaccgaagaccgatttgctcagtcctgagatttgttggagaccgatcggtcttgagattacaaagaccgaattttaaaaagaccgagaaaccgaaccgaatttttcggttagaccaaatacccacccctacgtgcacccgacactattggttcaatggcacacacttccgttaacaaactctatggacaattgtaggttggacatttgaaatgttgagtaaaaattcaagatcaacatatctttaattcaacccaatggcctactccctcaatcccaaaaaaagccaatctcccctcctagtacaacgaatttggatagccctttgtcacatcccctcctaggttgtttttttttttgggatgaacattatttaaaagtctgaactttttttatttaaaagtgttgtggcaggtttgttctaaacaacccggttacctccggcatttccgtccttggtgcccattgtgagtacaccaagcaaaatgtccatgcaaattgaagaataagatactcatttccacctcttcctctcaagttattacacttgtttccccccatttccctccaaccccggacaccccgcacacgtacgaacaggccacaaatcctcaaatatcggacagcgcagggatcgaacgcagaggaaatccaaaatccaaaatccgatcccctcgaaccaaagaattcgaagcgcgcaggcgggcacacgccccaaatgcgccggcggacgacgcgcgccgccgcagaagcagcacggcgccgatgagtcgcgcccctccggacgccgccggcgacctcttcgccgccaacctcaagggctccctcctcgccgtcgcctcctccgcgttcatcggggtcagcttcattgtcaagaagaaggggctccgccgcgccggcgccgccggcccccgcgcaggtccgccggccttatatttttcttggttctcctggtttgcagcctttgggcagcgcctctcgcgttcttttggtttcttgggcgttgttatgaggtcatgtggcgaggaatgtcctaaaggcgccccattttatggccaatctggtgctcttcgtcaacgatgcgctgtaatcattgtttgttcatggtgaatttcaggtgttggaggctatggatacctcttggagcctctctggtgggttggaatgattacaagtaagttcttgctttcttaggttgcttatttcttgaggggctagtgcaaaattattcgaaattcttgataattttttttccgaatttcgtagtgctcattggtgagattgcaaatttcgtggcttacatgttcgcaccggctgttctggttactcccctcggcgctctcagcataattgttaggtacaactgggatgtgttccctttgcttgtaaaatttcctggttagaacccatggtttgaattagttttaatctgtccatgcacatgcgtggtgaatgcgtaatctttgtggagcagtgctgttctagcccatttcatcctgaatgagaagctgcaacggatgggagtgctgggctgcgtgctctgtatagtcggatcaacagtgatcatccttcatgctcctgaagaggagacaccgagctcagtggagcagatttggcacctggcgacacaacctggtatatccttgtagtttccctttgtactttattatcgtcagtcatcacaattgtactttgtattttctgcagcctttctttgctatgtggcctttgcactggtggtctcactgatcttgatggcgcattgtgctccccgctatgggcagaccaacatagcagtgtatataggaatatgctctgtgattggatctctgacggtaagtgatctctatggactatgaaaatgcctttgttgttagcttggtctggtgtttaataggtttgtttatcttatttttgttatgctaggtaatgagcataaaggcagttggtattgcaatcaagcttacaattgagggcataaaccaggctggctatttccaaacttggttatttgcaactgtttcagctatatgcataattatccagttaatttacctgaacaaggtacacctgtagtcattttgtttaggtaacagaaatattgatgttaatttgcatgttcacatcatgataaactttcaggcactggacactttcaataccgcagttgtgtcccccatctattatgcgatgtttacatccctcactattttagcaagtgccataatgttcaaggtatgcaggttttagtaagttccacaaatgccagttagtttaagtccatttactagaacaaaaatttgagaatatgttttatggttccaggattggtctggacagagtataagcagtattgcttctgagatctgggatttcttactgtgctttctggtaccgttgaattgcattctacaagagaatatgatcaaactatttctccaggtaattatttctgagttttagtcaatcaatgc

SEQ ID NO: 41082 - DNA, 2590 bp, Oryza sativa
tcaataccgcagttgtgtcccccatctattatgcgatgtttacatccctcactattttagcaagtgccataatgttcaaggtatgcaggttttagtaagttccacaaatgccagttagtttaagtccatttactagaacaaaaatttgagaatatgttttatggtttccaggattggtctggacagagtataagcagtattgcttctgagatctgtggatttcttactgtgctttctggtaccgttgtattgcattctacaagagaatatgatcaaactatttctccaggtaattatttctgagttttagtcaatcaatgcttggctattcttatatgagaagatgaatatttgttctgtggtacatcatgctgataatattattcatgcaaacataaataagtggttttcccaaagttgaagttatttagtcactgcagtttgagtttccaatctccttttactagccttgtggtaacaaagctggtgtaagttgtggttgttgagagttggtgctttactttagtattaaaatcactaccaatttgataattcctactgaaaattgtttggtttcttttagcagtgaagttactttaatcaaaagtcaatagtattttgcctcaaggagatagacttcgttctgttaacagtagttgtcataggcttactcattgccttcatagttatggatcaagaaagaaatggcctgtggattgaaaagtattaatcaagcctactatttatggtgtcttggcatatctgtccttttcaactgatttaaggcttgcctctagatagttatacaatgctaggaatccctcactttttttagtgcatgttctttaaaaaaaggaaaagtaacggcaatgggatttctccaagatattactagcacttcacaatgtctatgatattataggttacccaatactgttatcatatatatagagtggtactgtaataatttcctgtttttatttttttactacagacctttatactcctcttcccccaatatactggcatatccaagggaacggtgagacggtgaaacaaaaagaggatgattcactctctgctgacttcatcaccgtggtgcgacaagattactttgtctaaagaatagagaccgtcctgaatgctcggtaatctcctcaatatcgtctttcagcagtgacaagaccaaatcaactgcaaattgtaggattgtaggattagctcgtgcatgatcatgctgcatccaagccaacaccctccaaaggagcatcgaagcagcctggcttttttttgcccatttgcacgaaacaaggtcttctgcttgtttatcaaggtggtgtgacatgatctgttatgtgtatctgttcctttgattcgaggagcaagtttatgaggctgctcttgctagtttgacggatgtttttttggcttttagtttttgaggtttgtctgttgatgcatgtatattgtacagtctaaatgaatgtaagaagctagatctaccctctttcggtgaggttgaaaccattcatgtagcctactagcggttgctcaccatattagcgctgcagagtgtgaaactctgctgttacagttcacattggcatagcattgagagtcttggtatttacttacagtgcacattagctctttaagcttttctgctgctgtcctattcaactcctgacatgtaataattactgttcccgtgcaaatattgctgaaacttgaaatggttattgctgctgtgtgctgtccaggaaaagcacaattttgctcatctattctattatatactaaaagtctattaaacttcctacaaacgctcttaaaccgccacatggcatcctacaaacgctcctaagtcgccacatggcatgctaataaataatagaaattcctagaaattctaagaaaaaaacaaaacatctgtccatccgttttcattaaaatcagtggacccaatgtttcaagccgtcagatttatcttaaaaaaaaaagctttccacctccacctccttcctcccacacgtaacatcactttccctttatatgtagtcacgtataataaatatataacaattgatttacacatgtacaggtgtagaatagattagatcaaatcatattaaagtaattaatccctctcttctaatctcatgtgtatttgcgagagataaataaatatatactattcatccggagaaaatatatgtatgtatatatgcatgtacatgagactattatttggaaaaaaaaaaagaaaacatgcatatgtccgtacataaaaaaaaccatattttcctacaaatactcataaaccaccacgtgtactcctaaaaacacttctaaaccgtcatgtggcactctaattaaccggtggacccactattttagatttttcagctattagatttacaattatatagtggacctgatattatacgtcattagatctatttttcaaaaaaaaagaaaaagaaaatagcatcgatcccctcccatcccgcttaagtacatttccatttacgtgaactccatctgtgtacgccctcccctctgttccttttctctcctattttcatgattt

SEQ ID NO: 41083 - DNA, 5821 bp, Oryza sativa
tatatgtatgtatatatgcatgtacatgagactattatttttaaaaaaaaaaagaaaacatgcatatgtccgtacataaaaaaaaccatattttcctacaaatactcataaaccaccacgtgtactcctaaaaacacttctaaaccgtcatgtggcactctaattaaccggtggacccactattttagatttttcagctattagatttacaattatatagtggacctgatattatacgtcattagatctatttttcaaaaaaaaagaaaaagaaaatagcatcgatcccctcccatcccgcttaagtacatttccatttacgtgaactccatctgtgtacgccctcccctctgttccttttctctcctattttcatgattttcatgctattttagttagatggaaattagaatttataataatattttttctaaaaaaataaaactaaatcactgtccttttgtagaaacggacgtatgcctcctccttcgtgttccaaggccggtgtccaccctcctttttttatatattatttaaattcaaactagactgaatatttttaaccattaaattattaaattattattattatatcaaatagatttttaaaccttttgattaacaaaatgcactaaaattagaataatttaagtagtttaattagaaaatacagcacccaaagtattttaaattagatctaatattaaatgtatttataaaaatagataactctaaattatagtgcacattcgatctattttaaaaacagtaatctcctcccatcatcctgtctttcgtaataccactctcctcccactctggctcttgcatcctctcctctccaatgcaattatcgtctcttttattttttttctaactaacataatataaaaatagtcataactattattttatttataattaaacattcattagctatattttgctatataaaagttaaaatatatcatttgaaggtggaccctatcgtttgcatgaacactaaataaacacgaaaattaattgaaaatatgtatcgtgttatactaaatcattgtacacaattaaaatcaattaaatgccctcaagagtgttcgtaagtcaccaactacataattaaagcaaccataagctacatatatggaatactcctatgctttttaaatctgtgaaaccattatttctaaccattagatctatcttatatataaaaaaacaagcgtgtattcatggtacatcacattttaaaaatattactgtgtaattatatttcgtcgttatcgtattcatgttaggttgcgtggagcctctcactcactctatatgaaatgaatgttcaatggatcatctctcaaactacatcaatcattttagtctatataaacctgtcccacccaattcatcctttagtacactatgataatatatatgcaactaaaaaaagaaaaccaacttacttttactgacatgttttctaaagaaaataagtctaccttctttccaaatgatgaagaagattataaataattgcttatagatattacttaaatatgatttaacataaagctaataggttataaacttataaaagcaattaatgccatgaaaacaatttatagagaaatcatgagaggtgttctccggttaatatttcacttttataagtatcttaaacttagcgtacgacacatgcccgcgcgaatgcgcgggctaccttcctagttcaaatttaaaacacataagttttctacagtgatgtgcaattgccatggttttattgtagaactccatataatcgtgtgcacagaacactgataaccatttcattctcctcaaatatgaccagataattgttcagaagctttatttaaccctttcattccactcaattaggaacaaaccaatcaaaaaatttacatcaaactgcttatataagtgcttgtaacctacaacgttattaccaaatttttttctactacaacttatcaaatcagatgctactctacattgtaccatatgagaatgtgttctatctgaatccggttccttcaagggctcctctggtgtcgtcttcccgccatgggcggcagggaaggcaaggaccgggctatcctttacccttcacctccttcttcggctttgccacggccggagtggccaccagcaaagccgcgcggtaacaaggacgtcggttacggggcccttctctccttgcgctccggtgatctggggagtcatccaggaaggcggcggcgatacccgccagatcctcgccgctccggccggatctggcggggacagggacgacgtcgacggcggtggggatggcgatgccggtggggatggtgatgtcggcggggatggcgatgacggtgccggagtttgcggatccggcgacggtgcggcgtccgacagtggaaggatcatgcggcgtcggtggcctgtccatcgcccgatgctgccgcttgtggcgtctgctggcgatggtgatgcaaggaggacagccggattctgctcctctaggtccagatctggcgcgtcctcagtcggaggtcaggtggtgtggagtccggtcgtcgtgcaggtggtgtgaatagtgccgatacctttcggtgtgcagttggcatttgggagcttccgctatggatgctttggttaacagggtctccgaggtgaaaaccttgctccgcttctggtgctagcaacggtgactccctcgagtgccgttctccttctttaaggcgttgcttttggagccctcgtttcaactccacttcaagggaattctccgggtgaaaactttagattcgttaggatcggaagttgccgtcgttctgtcggcgttaccttcttgaaggctttgttttaggagtttcttctctttgttggactactgttctttggttcagtttgtcaatgccgggttttcaccggttttcatgaaattaaccgtgttgttgtaagatttttgggtccagttttccttataaactggatcgactatcttcttctatagtgaaattgcaggagctccctgcatgtcccctcgaaaaaaaagaatgtgtttgaccatgaaaaatctacggaaccctaacttcagacgacccatctacagatatgcaccctgctcaatagagattgcttgcgtccgatctatcgagccccatcaagaacataggcaatggaagcatgcttggctccggcgaaacgaaggacggtccagcgaactctggcgagcgaaacgaagcatgctcatatagtccttttgctcccgccagggcccaagtcttggccttctccttgatcttggtcaccacgtttgccgctaagagttctttgtgcctaaagactctctggttttgttccttcaagacttcccaggccgttaggaggatcagggtacgtaatccttttttcggcacccccttggtggtctctagccctatccaccattcgtgtaccgttgtagctgggccccaactttccggtatgatatgttcacgggaggtccaagccaacaacgttctccaaattctcgtcgtgtaccttcattccatgagaaggtagaagatcgtctctggggtatgcctacaaagcaggcaataggtgttgttcggccatccgtgagttgccagtcagtcagatgtccaattctattttgcaccaccagccaggcaaaaattttacactttttaggtgcccaaggcttccaaatgatcactctatagtttgtactggttgaagttttgtacgccaatgccgccgtgtatttcccgtggtttgtgaggttccaagtgacgtgatctatctcgccgtcggtgagctgcattccttgaattgcattccatacaactgacataatgccactagctgagaggttgaggtcttgtaatggcaaatagttgctttgaagtccatgtgtgtaaatagagccattttttttttgaaaattttgcacagccatagttgacatgaaaaaaacggaaggacgttcaccccagtgcttaaaagagttccccccccccattttattgttgtacagtagaattgtgaatcggagtcagtgcttcattcaacataccattttacatttctttctcaagtatagcatctcaattgataagaaactatttttgacttcaccccagtgcttaaaagagttccccccattttatggttgtacagtagaattgtgaatcggagtcagtgcttcattcaacataccattttacatttatttctcaactgtagcatctcaattgatcagaaactatttttgacttcttttcagtaaataagaaacaaatcagtaggtgaacttacatcaaactgcttacagaaatagtgacattcctgcagttgcagaagtagtaaacaaaaacctactgtccatgcaactgagatgctactgctgaactgcattacaacctgaagactcttttcgaacatatacagaattagggataaaggacttgacaatgtgattgagcacaactgcacaagaaccctattaagtcctaatgatttatctacagacatgaaccctgctcagctcgggagctagctttcctccattgcttgcgtctgatcggttgcatgctagcgagccatcaagaactttgggagaggaagcatgcacggctccggcgcgacgaaggacggtccggcgaacaccgcgtgccgtggcttgctgatctccttgttcgtcgtcagcctcatggtcatggcggcgttgcggtcctcctcgccgtggagcgcgtccgcctgcagccacggcttcttctggatgtcccagcgctcgtcggaggacgcgcggctcgacgacgtacgaccgcacggcgtcgggagcagcgcagggagagcggcggcggccacgaactgcgccgagcgcgccatctctcgcggcgaagcgcgggagccgtgaacgaacgaacgacacagagcccgagcttgcggagaagaaggtgcagttcgttgtgggctcggaatacgacggcccactcggcccagcacgggcccatacaggcccatctagtacgaggagtaaatccacatctcggcggagatccaacggccaggatgggagcaaatatccactacactgttttaattggagcccacccgtttcggctatctcctccactatccccccctcgccatggcagccgcttccttggctccgcccaccgcctccttctcgccggcgccggcgccggggagggttaagcgcggcggcgcctttgctctccaggaggcctcccgggcggttccttctcagggtggctagcgaatcctcctcggttcgtagaccactccaagctcccgattgttttacaaccgctgtttccagtggttcttgtcttgtttctggtttccactctgctgcgtggatttggttcctgtgccggcattggggttggttcgatatctactgtgtggataaatccctagctccggggtccggggtcttgtcccgcttccatttaccctttcttttactaatttgcgtctgtttatggcaattcttggtttggagcaaagctcatttgtgagtagtaccatcctgacatttcgctgctttgatcgtcttatgcttgtatgattagatttctggtgacacgctgctgggattgtatgagaaagagaggttaagccactcgctatatgctaacgaagattacgacaaagagatgttctgggacaacttggatgcggatttgcgctactggaccagatccctgcgcccagtgcaggtatatataaggtgtgctttagtggaatttaacaagcatatgtgcggaatcttgtactagctctaatg

SEQ ID NO: 41084 - DNA, 1327 bp, Oryza sativa
  unsure (1)..(1327): unsure at all n locations
nnnnnnnnnnnnnnnnnnnnnnnnnnnnnnnnnnnnnnnnnnnnnnnnnnnnnnnnnnataagctttgatagatttggaaccaatggatcttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctagctacatgaaatgatttggtaaattttaagtttttaacaatgaagcttgtgactcaaaaatatcgatgcagtatcaactagaatggattaaagaaagacctgaccctccatattcttccatgtagatttactagtatattataagtgacgctcctatatgattcatattaaaaagactagaaatgacgttagagctccaggttgtctcccatcatttaaccattgaagctagcttttataatttcaagcctcacttgcaatctacaatattcacatgatttcattaacccaacctatattttatttctgtaattagttgagaaattttctaatccaacatatatgtccaaataacaggtagcttatggactgaagaggtatcacctaattggttgttcttcatcagcacaacaaaataaaatgccattctaagtgaatgctgttttttattctatcacaaaagtgcaacgttgtctgtttaataattaattaatacaatttacgcttgaaatataacagagaacttgaatggggaaaaaataaggatagcagcatgtcgacctcctgagaccactaaacacttttgacaaagggcatttgtaaataacctgtgaaggcagtcctcaggagaaccgatgctatgttcccagcggatcaaggtgtcctttctttgattagatagttcttgaagttgctttgccgcagcaactgggagtacttgtggctggttcttcaacaaaccacacaagaagcttccttcccacgtttggggctcgagtggtgcattgacactttcaaattcagagtcatcaggctttgcaccagcaactgtagtccgtggacttctggtactgcatttagatttccaattcaacatacttccctgtgttgcaaagttgatagggcagcaattgttatgacaatattctaggcgaaacacacgcacaaatcaatgatgcaacaactagattaaactaatgcagagggcatgaataaatcagactaaattcggtaagaatca

SEQ ID NO: 41085 - DNA, 705 bp, Oryza sativa
ttcgagctcggttcccggaaccaaacccaatggcttcagacaacaatctctttagggatgacggagcgagtatcactgcctcatcaggctctaggaaatctttcatgctttctctgaacagtgcccaactgtgcttctcaatgagattagaagcttcgcatgagcgcagccttgcgcataactccaaggtctttggatcaaagcccatcatgtaactcttcaagtcatgcagatcaacaacagaactcggttttgaggaagatgatatttctgcagaacctccaatggactcttcctgttcttgtttctgggtgctattaaattgtgcattcagaaactgaattggtgggcaaaattcttgtgactgagcaagaatcagctccaaacgatgccttgtagtgacagatttcagaaagtatccgtacattattgaagcagaataaatccgactaaattgcattcttttgattctaagtgttgagcgattgatcttgggaccatttctatgtacccatctgataatactggtcaagtgttccctaattaaacctagcacctcaggtccatgaattgattctagttctgcctcccttggtggccatatttgtagtcttttattgctgataagctttgatagatttgaaaccaatggaacttcaatcttgaaaaatttataaacaatcaaagtgtacatgatatcctcaa

SEQ ID NO: 41086 - DNA, 4012 bp, Oryza sativa
  unsure (1)..(4012): unsure at all n locations
tttcctctgtgactctgtgctgtccaacaagcaattgtcgaacctcatcttgaccttttgcatcacttctgggtttctgatgagttcagccataatccattgcagtgttatggccggtggctcactgcccccaatgaacatgtcctacacgatacaaagccaaaatttcattacttgtaagcatatattcatggaaaatgcaatggcaacaattttttcaatctattatattattaaaacagttttgaagtgaggcatcacgtctgttgtaaatgctagaaacttcctcattaataaaaaaaatgatcttaactacccgattttgttggtttcagattaattataatggtatagtttgactgatatagttgtatacaaaatataattacatctatagaaatataagttaagggttgtatatgaaatttaagcctatagaaatagaatgtaagagttgtatggtacgccatccgtgtatgagtctgtttttaactttgtttgcttttgaaaatacatatccgcatttgagtcatttttaagatcattcacttttgataatacagaaggaatcatataagaaatctgtttaaaaaaactcacatgctaacctgagacgatcggactcctaaccaggggtggatccaggaacaaaaagttgggggactcaacataccgtgtacaccgatataaacacataatctcagtattaaactatgctaaaatgttattaagagacctttagcacctcctatcttatcaaccacgacgaaaaaattttaggaggaactcaggggggtatccatgggtctggtgggtgttgggggactcaagtccccctgcacccatgttggatcctcccctgctcctacctgcagctcatgattttctatatatatatatatatatatatatatatatatatatatatccaagcaaactctcataacgaattttatcttaactaaaccatataacaataataagattaaaatagacttcacccgttacaacgcacgggtattttttctagtatatatagaaataaaatttcagagctatatattatatctaactctacgtgaattatctagattcgtgcaaactgcagagcaataccctagtttaattaattgacatcactgttaaaaaaaacacatgaagtcgcgaaattccattatttgtgtctatttgcaacacttgaaatttatatatgtttgcaacacttgaaattttcttaaacgctttatttatggattcagggtacttactccgatcgttgatctgatgctttctctggatacctccaggtcaccttctctctggatcctgagaagcacgtcgagcaagtcctcgtcgtcttcccgggacgctctgctctcttggtgctcctcgatgatggcgtccaggtaggccgtcattctctcgcggtgccgtttcatccggcgaggcattgtgctgaggagcacggcgaggcgcgatgacgggtacaggttcggcaagctctgctcgccgaacagcttgatcccgcgctccaccatcgccaagaacgtgtccctgtccttgagcccccgcccgatcatggcgcgcgccgacgagtcggcggcgtaggccgacatcagctcgctgaggttcaccgtcgtctgcgccgccgccgacgccaccgcccggagcatccggccagcctccttctcgcggacggaccggaaggaatggacgcgcctggcgctgagaagctcggcggtgcagatcttgcggagctgcctccacgtctcgccgtagggcgcgaagatgaccccctcggatccctccgggaagacgacccggatcatccggttgacggggcgcgccgcgaaggcgacgtcgtgcgtcttcatgacgtcgcgcgcggcgtccgcggaggaggcgacgacgacggggagctcgccgagccggagcagcacgagtgggccgtggcgccgcgcaatgtcgcgcatggcgcggtgcgggagcgccccggctaggtggtggaggtggccgatcaccgggagtgcccatggcgacggtggtagccggccgcaggcgccacgccggcggcgcgacgaacggaggaggaggaaggggaggatgaacagcggcagaagcaagatgaggtggtggagctgtacaacctccgccatggctggtgggttagcttggatcaaatcaaagctcaaacgattttgtatctaagcaatggagtttaaatgtttgcattttgcttgctgttgctgctcaatagctggctgattgttgggccctgtttaggggagccgcagatttcatattttactggttggtaaccaactttagaaaatcgaaactgctaaatgactgtcgacaaatttttaggccgtcgatttcgctttaagatttgtgctgagatattttgctaccggatctaaaccctcttttcataagctagccacatcatcacatgtatatggtaaatttgttcatgttacatctaaattgcatttcagttatatgctagttacattgtagttacactataattacattgtaattatattgtaactatagtgtaactacactataactatattgttatctctatataaattagatataaagttgtatatattattttaatacatatatgtaccagttattattatagtatagttctagtgaaattatatactatagttagatttaaaagttttcccctcaaaaaacactcgacagttttttaagctagtcccttagaaaatttagagatgctgggtttttcagcttttggattcttcattttctgaattctaaaaaaaaaatttgagtaataatatggactgtttgaggaactgaagattctgggtgtatttagatctcaaaatatttggccaaaaatattacatcaaatatttaaacacatgcatggagcattaaatgtccgatctacatccgccgcccaccagtgccgatggctatggtggaggcggagcagatcggatgaggaggcgggctagggctagggagcctccccacgcaaggcaacccaagaggccatcttttctatttttttcttaaatgattctaactacttgatcgcccattggatcgtaatgtttggagaatcgaacgatatatctttcccgagattatttcatgaattcagtagggtgacttttataccttgtactggacgagattagttgaccaacttgttggtaattaaacgaattataagaacaagtgatcaattaactaagactgtagctagcctcgattaatggtcagatcgatctgcatcaactaatggattattttttgaatactccatccaatctgcatcaacaatcttagcctcaattaactaagactgtagctagtctttgtgcatagaacatcgtgatcactaagcatctaagcccccaaagttaatataagaagtacgctgctaatattctcgcatcccccgccaggtgttaactgccaataccctcatttatacaaatccagctaagcaacgtactacacgtgactagcactaggtgcgacaacagtacgtagcaacgtttttctagtttgagaaaatccgcggaacggtcaggggttttatagctagctccataagatgataggctagccggtctagtttcaaagtctaactccttttatttatttgataactagaaaaaaatatttgtgcgttgcaacgggtgaagattattttaataataatattattatacggtttagttaaggtgaaattcgccataggaattcgattggacatattttttttagaaaatcatgagctgcaattaggaatccgatcgtctcaagctagcatgtaatttttttaaatagatttcttatacgactccttctatattttaaaaaataaacgaactttaaaaactgactcaaatacggatatgtattttcaaaagagaacgaacttaaaaccggnnnnnnnnnnnnnnnnnnnnnnnnnnnnnnnnnnnnnnnnnnnnnnnnnnnnnnnnnnnnn

SEQ ID NO: 41087 - DNA, 2437 bp, Oryza sativa
agcaaaagctatctagacatctagacatgtccgcaatttccaaaaaaaattgatactaaatataaaaaatcgtcaatatgtacgtttcatgggtgatagttattgatattataaatattaagttctaatcatattttaaatatattgattaatatttttatttataagttgcttaaattaatagggaattcactagtaaaagacgatttttgcatatggccaaaaaccgatttccgtagtcagctgggtggctcgatgcaccttggtgtctgcgaaaatcaaaatttatatatgagcaaaacaaccgcatgcaaaaataagattttcatgcgaaaataattttagccaaaaaacaaaaattccaaaaatcaaatttgaaacccctagctcctcgattcatccctgagccctagcctgccaccggcagaaaccatagcccgccgctagcccaatccctagctctttgtcgccgccaccaatgctgtcgtcgtgctcacaagccgtagtctgtcgtcgctatagcagtcaacgagcttcgcctcgccaccctaccaccaatgtcaccctctgtcaccggatccgcgccagggaggacggtggagggccggatccttgtgggggagggcggccgccgtcggatcggtgcgggggagcgcagccgccgctagatccgcgtggaggagggccgccgctggatctgccacaaacgtgcagttatcgctgccgacgtagtagttctatatggctccttaattttcgcatgggcgcaccgcacggtggtctcgttggtccatggagaccaagatttacagcccaaagtttttgggcctgcacaggattgggccaacggggcagcactgcggcagattttagtctcggggatgtagtgagtgatttgaggcatcagaattcagagactgggcatgacatgtctgatcgaattcatgtttcagttctgaaactatggaagacgcccagatctgtttttggagtatcttccagcttgcatccgtaattggtgcatatacgctttcacccagtattctcggagaattgttctgcatagcagaacacttaaaaacgtgaccgtttttattgcaaaattttgcaggctgcaatttaaatgtgactagggacaaatccaaaaaaaaatagtgagctagggatttgaataagctagacaatgttaaatttttggcacactttggcgttctcaaattttgactatatatgatggatgtgttcttactaaactagtgtttgtatgagaagaagttttaggaaatgccaaattttagtaaagtgatgatggcaagagtttgtttagtttgttaccttaccaaattttagtaacaaaagaaatggtagggctgaaagtgatggtggcaaagtgaacagaccctatgataaaaaaaaattagtgagggttttatgggagctctcatggttttattgccagtaggagtctcgagcccccaccgtcccacgctagatccgctcttgactgattgaaatttgcaaatctaccatcgatgtggtgactttatttaccaagttgaaatcctaccgaaatatggctgtgtgtattcttggttgatgcatagaccgaaagttatacttccatttgtaataataataataataataatgataataataataataataataataataataataataataataataataataataatgaaaaccgttgtttgggttctcagtccatttgactgtggatgtatgcatgatcaattacattctaccattaaaatatgcaaacctgaacgcttcaagtaatttcttgatgctccatctaccatccactagcaatccctccatttctgccattccattcactaaccaaagtttaggggactccagagttcagagttccttcaaacttcgcgacaaagtttagcggacttatgtcttttttttacgcgttaagatacaaattttatcttgattttttatcactctttttaaactgataaaacaatatatttcatacaaaaactttctatataaatttttttttaaaatatcagataaatctatttttaggttttaaataaaaagctcaattaatcatgagctaatgcatttatcgttttgtatgctcgtacttaatgttcattcatcgcaagttcgaacggaacgtttagacagatctaagatctgtggttagcagctcaaccgaactacatgatcccctgcatgtatcagctagctatttgggctccgcaaattacacacaaggcgatagaaactaccacattaattagaaggaagtataattatgaattgcatatgtagattgatttgttgtatgtattagatagtttttcgaaacattacaaccgtatgaaaaatataagtgcactcgaaaagagtcccaaaccattagaaccgtatggaaaagagacga

SEQ ID NO: 41088 - DNA, 756 bp, Oryza sativa
gcaatcaacacatgtatacttttgttgccttatctctctctctcttcttaatttgttgcatcttacaacgaacgaataagcaacagttgcttcttgtatgtacaagtttcgacatcataacaatcaataaatccttgtcattaaccggacgacacggtaatatctcacacttgatgaccgactcctgcaagctaaacaaacttaaaaattttaaaaaaaaacctcacaaaaacaaaaccactcaaatcaattaattcgatcgtctaccgctgtatatatatgcttcttgtgtactctgctgtatcgaattatcatttggttcatcgatccatggagagaaatgttttcttgtgtgttcgatcgctagcttagctatggcgccgggcagcccatctcgtcgcgtgcctggatgaagacgatggcggcggcgtagtgcgcgagcgcgccggcgatgacgagcgcgtggaagatctggtggctgtggccgcacaggtcgaacatgccggggcgccaccgctccgggacgcgggtgaggtagaacgcggtgccggcgaggtaggacgccgccatggcgccctcgtacgccagcgtcacgttccggcggggctcgtgccagttgacggcgacggcgtgggcggcggggacgacgccggagaggcccatggcgacgaacagcagcgcgcggtgggcgcggtacctcgccgcgctcagcctgggcgacatgagcgcgtacacggtgccaccccggcggcggtg

SEQ ID NO: 41089 - DNA, 3290 bp, Oryza sativa
  unsure (1)..(3290): unsure at all n locations
agtcgtgtcgtaacgggtagacttgatcatcacaatcaccaagtcacaaccaagtcctatgaacacatcaccaaagcttaacatcttgtggtgaagtgaagtggccaacacttaatctaggatttgtcatgaatgggcaccagtaaaaggggacctaattgggcaaggttcatcaggtaaaggtgaaagcaatcagaagccccacccaacactttggcccagctgccatccaaaaagtccaaatcatgcacatctgaacaaacagaaggaaacaggacagtactgaaaagtggagccactcaaagctgcacaatgaatctcctaagcatgtggatctaaccagcccaataatattactgcaatccagtatttttttttcttatcagtaacttctacttctatcacaggaatgaatgatttcaggaaatagaagctttactcacagagaggacatctccaatgttactggagacattttcagcaacctttgagattggcctgcagtcaaatagaagtacaattctcagaaaaaaaaaaagggacagacagtgaacagaatattaagcatgcaaagcacatagacatctgaaataaaaactgcaacttgtcattttccaggttgtatggaattggagtgaatttgttggtgagatttaatttgtcgatacacaagcagctagatttatcgaaactctcatgctatcactcagcataatttgattaacaagaaacaagtaggatgtagaatcctattcagtgccttaaaacgttaaaatattcatctcacagctactgaaaaactaaactatttcgtgctactaattccaggacacattagccaagattttaaccaaacaaattccactgaggctttcacaaactcaccaggagaggtgtccgatgagatcagcaacctgggggaagtactggccaagatgcaggacggtgaggccgaagaacagcacgaacccaagaagatgcctgaacaaacaccaagaacgcccacacgatgagcagcaagaacacagcacacaaagctgaaccagaatcaaattcagaaaaattcaggttgaaatccatacgtccagatgttgatggtctcgttgtgccaggagaagaggctgaggagggcattgaggatgggccactcggagcggtagtagtcgaggatgaactcgttctccttcatgtagtccggcagctcgtggtagctcaccagcctgcactccttcctcttctcctccctcttctgctgcttcctcttcttcttgctccctcctcccttcgccggcgccggcgccgccgccggagcaagctcatcatggtaggcgctctccatggtggccatggctgcctcctctcccataacttcttggcctcttcaagggaaaggtttgtgcagtgcttggctggctagctgtggcacggggttaaaaagggaaagagcctaggacacaggagatggagcagctttcgcaaacaagccaagaaaatggtagctagagtgcagtgctatccaagtcagtttctttaattttcttctcaatgcagcatgcaatatcagcaaataatgccaataaatttgatgctacagcaatgaaatactgaaatggattttttttttgtagaaatggatattgatgagatgatgagatttgtaggtgcaaatggcgtgagattgcgtgtattttgggtgagattatacgctgcgagaacaatggagagggggggttttatttggtatgaggtggaagaggacaaatacaggtagagtaggaggacaaccacatcaatactgttgctaacagggcttggaaaaagatactactactacagtgatgtatttttcttctataaaagtccatgtcaaataccagtgaaatattgattaaatgcctttggacacctaactcaagaatttcgatgtgtctgcattattgctcagcatcaatattgttgaaatcattttttatatagcctgagggtattggtttatagttaacactcttaatagtggtatgtcatcttttacacagtttgacagcagtggtggatgccataatggcgtagccaacaataggttcaatgtaaaatatgtagtatatacgatgataacagagaagaggagaaaagagatggtgcggcagtgcataaaaagggagcataactaggtgtcaaaaaaagtctagcaagttcattatcactttcaccacacaacatatttacgcttacatgcatgtatgactatgtgcatctacgatgtagagagaataaagatataaaaccttttcattacaaaaatatgccccccccctaacattatatttgacgctacacacaaacttatgtcgatattatatgacgtcaaatattaatgataggaggcggtatattttctttcaccaaatagtatagcaagctcattatcactttaaccacaccacgtatttgcacttacatgaatatataattgtgtacattcacggtgtaaagagaccaaggatataacactctcattataaaagtatatttacgctcccttccgttgttatatccttcctccatctcatataaaaccaatggacatactaaaatgtgtcaatattagtactataggttggtttctttgggacggagggagtagtagagggttttttttttcttcaaattgacagcataaagaaagtgctttgaaatagaattaggtagctgttgtttgctccgggtccatttctgaagttttgacccgtctatgttgtaggtgtcagctggccatccatccctccgtcttcccacctgtcacaataaattcttcagcaatgggcactctcgcagtccagcaagaagctgcaggttaattttctctctgtggcgtgcaggcaaccgttgaaaattgaggctctgattgcttcattagagataatgaaagctttctgaattcaacttcagggaggttcagattcagattagttgggaagctcacaaccaacctgagctaacccaatcttgtactgtactcgtactggtatagaatggctgagtttcagactttcagtctgcagtccgagagagatgacttgtctgattggccgattcgtcgtagtacttcaccgttttttgcgccttatgaggaaacgtgcaggtttgcatggaatgattggtgagttagccatgaatgtggcactgaacaggaggggttaccaaagttgacgcaagagaattgctttgnnnnnnnnnnnnnnnnnnnnnnnnnnnnnnnnnnnnnnnnnnnnnnnnnnnnnnnnnnnnnn

SEQ ID NO: 41090 - DNA, 737 bp, Oryza sativa
caagcagaagagtttattccagagagatttgagaatgctggtattaatttcaaaggaacaaactttgagtatatgccatttggagcagggcgacgcatgtgtcctgggatggcgtttggtctagcaacgttagagctcgcacttgcgagtctcttgtaccattttgactggaagctacccgacggggtagagattgacatgaaggagcaaagtggggtcacaacacggcgagtacacgaccttatgcttgttcctatcatccgagtgccattaccagtgtagacgcacgtagctgctatctacgagttattgaaggggaaaatatatagtgcaaacctaaaaactagcataggatccaaaaatagacgtctaagatttgtctacatcacacggagtaaaattttcactccaaattttaaccatgagtaaaagttttactcatggtgatgtatatggataaatcccaaacatccattttttctattgtacggtaattttcaggtttgcactgtatatagagtttgcgctacatatttggatattccccctagtgaagcaccccaacatctttgggcactactgttcatataataagagtttgaacccaaacaattaattatttttggaaccagttcaattggctgtgcaacttacatgtgtaggccccattatgtatttgaatatatagttctatttgctattcatccttatcatttgtttatatatagttttattat

SEQ ID NO: 41091 - DNA, 747 bp, Oryza sativa
ctttgacaatgttttatatttctgatgcttggttacatatacttgatggtcacatcacagtgactcaggaaccactccgcacactaactctctctctctctccattttctttttccctccaacaattggggaaccgctatattcagcaagaaggagcccaaatctagtgtcttcgctcttcatcgggtcgactcctgcctcctccttgactccctgtgtctctgtaagaccgacaccaccgaccttaatggcgaccataatgatagtgtgcatgacgagaggggacgagaaaaaagggtgacccatggaggataacttgagggtgcgattgcacatgcaaaggcggagatgagcaacgatggtggctcatggagaaagagcggtggtggcgatgcgtggagtgatagttgttggtggtacgaggagtttgttgtcgatacgatcgctaatcgagtttgttaatttttgatacgtgggcaactagtcattataaagaaatagctaattttaaagtagtaaaaatattgagataaatgtgagagtactcgtattaactttttgccacttttaagatatggtaattaaaaatttatcactcacagtttatgacacgtagggcctgtttggtacagctccaactcctcaatttaactccaggagttgggtctgggtctgttcattttgtgagagagctccacccagctccactcccagttttggtggagctgaaactgtttggctgagctc

SEQ ID NO: 41092 - DNA, 1507 bp, Oryza sativa
  unsure (1)..(1507): unsure at all n locations
gaccgaacaggaacctttttcgcagatttaaattaaattagccattacgcagcaaagatgcgacattacgcaaaaaagatgtgactttgactagatattgttcaagatgagcagacgtatcacaatcccctgagagcaagtataatagtaggctacaagccggctaaatgctgaggtggaggagagaagagaggagagcgggctgtaaacttacagccgacttgacacaagaaccaagaaactctgtgagagagataagtttgccctgtattaactgtaaagagctaactattatatgggtaagctaagagaagactacacagaaccttatagctaacaggtcgactgtattactagcctttctgataagctgatacggatggccaaccataaaccgataaccaatacccaaaaccaatcgccccaactgtcctaaagttttctggcaacaagtataagttagcatcaacaataacaaactcttcttttagcaaaatcaaaacaaaattaagagcattaaaaattggttagttcacataaagatcaaatcttcaattaattggttagttcacataaagatcaaatcttcaatcttcgccttttggcttatcaactgtggctaaaatttaattttatagttgattttaagggtttttattataatttattttagcacaaatataaaagttttactcataaattattctttaattactgataagcattttacggtttatcagttgtatgcgaaacgatcagactttaaactaaagatggaagatagtgtgaaaagaagttgaagaaaacatggcttaattgttgcagctactacaccaaactacagctgcgttgagtacaactcacattgaccaatgatattaatcaggataaatataggcattttatacgaagtcggagttggcatctgcgttatagttgccacaataactacataaccaccagcaacatatggacatggaaatcaatgctataaacacaagacacgctgtttctcagtaaaaaagaagttagaaactgttatggcagataaacatcaactagatggtagtactaatctttgcccatccaaggacaaacaacaaaaatgcattgatctcaacaaaactttggatatatagaatgaaccatcgtgtcaaacaatacttacacgaaagctaggcagccctcctggagtaaacatagtaaagaagggctgccagggccatatggtccacccagcagtaaacacacaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41093 - DNA, 1494 bp, Oryza sativa
aactcctcccgccaccggaagcactcccccatgattgcgcgcagcgccaggtccgtcatcggcccggtgatctgcctgctgatgttcaccgccgccgcctccgccgtggacgacgccgcggcggcggcgatggcgtcgacgaggcgggcgacctgctcctcccggatggggcggaacgagcgcacccgcttcacgctgagcagctcgagggtgcagatgccgcggagctggcgccacttcttgccgtagggggagaagaggatgccgaccttgtcgccgatggactccctcaccgtgacgctcatggcgcgggtggcgaacgccgcgtcgtgcgtcttgaggacctcgcgcgcggcctccggcgacgacgccaccacgacggggagctcgccgaggcggaggtacatgacgggggcgtcgtgccgccgcgccagctcggccagcgcgcggtgcaccaccaccccgcgcggcctcatcaccgcgaggtggtgcaggctgccgacgaacggcagccgccatggccccggaggcagcctcgtggcgccaccattctcgtcgccacgacgacgacgacgacgacgacatagctcgccgcagatcatggcggcgacaatgatcaataccagcaagttcaacaagctccatgggctcccctgaagcggattactcttcatcaaatccatggcgtttaacaaagcttacagtcacttaatttaccctaatttgaccgcctgcaaaaacgattttttgcagtattgagttgattaacacaatctaagcttgattacgtaggattactatgtgtatcaaactcgtgatgagttagcgttgtgtgtttttgatgcatacgaataacccttccggctgagggtatttataggaggcaagtaagatagctaatggtgaattggtgatgatatcacctgcacaaggcaatatgtagtgttaattgcaggcttcgccgccgcaatcgtcattgagtgtgatagaaataattggcatgaattttcaacatgagaacatggaagaagcatggcatctgtgcctaggtttcatgctgacatctcgctgacgttggcatgatatctaccagaagaaggggccaccgccgctgcaatgagaaggggacctccaccactgcctccttgcggccgccgccgctgtctccttgcagccgccaccgctaccgggagaaggtaccgctgcaaggagaagggggtagccgccgctggagaaggggccactgccgctgcctccttgcgatcgctgccgctgtcagcgcatcgctgccaggagaaggaggaggaggcgggagagggcgagaggggagggggatgcgagtggatggagtgaggagtgagaggagcgagtggatgaggtagagcgaccgatcaagagatgcgagtggataaggacgtcgaccggtcggttttttctaagtagaaccggcacctatatttatattataggtgtcggttcttttaaaaaaaccgg

SEQ ID NO: 41094 - DNA, 1478 bp, Oryza sativa
ctaataaatatgacacataaatctgcaaatataacaataacaaaagatgaatagcacagagaaactgtatattaaaatacatatcggaatgtacaaatgtaattaattgcacagtgagttgaagtagttttgtaataatttaattgttaaggtttgaacataggtaaacattagtgaaccaatatatttggtcgctttatcaagaaataaaaaatcacaagctacttatctagcacctagctagctgcgcgagtctaacggtaacggcactcgaatcacagggacaagcaaaagatcatggagtcgccgtgtggtggcccccctctcctgcgtcatgtctaggtcaccgacttattttgtcagataacttccagtcaaagtgatataagagactcgctagtacgagctctaaattcactagaccaaatgccatcccagggcacatccgtcgtcccgctccaaacggcatatactcaaagttcatccctttgaaattgatatcaacatgctcaaatctctctagtataaactcttctgattggtcccagtacttaggatccctatttatagcccacatattcacgagcactattgttcctttaggcacatcgaaccctagcacttggcaagtagttcgacactctcgtggcagcagtggtggtcttggcgggtgcagccggagcgcctctttgatgaccaagtacatgtaactcaaattgcttaggttttcttctgtgactttgtgctgaccaatgaatactcgttggacctcatcttgtgctttttgcataactcttgggtttctcatgagtttagccataatccattgtagcgtcgtcgctgtcgtctcactgcccccattgaacaagtcctgtgtaccatgaagccaaattttcaggtaactacattttgtggaaaagccatggtaactttttgctaatttgcttggtaaccctgtaaaaaaattatggtgctgaaaaatatcattgtatcaaaaaacaaaattatagtatatatgtgtcattgacgtgtaggttcagtcctcacgcgttattcttactagcataacactactaagttacaacggatttcttttaataaaaatagctcattgtatatattttttgaagcccataacaaattatttttattatctaatatattatatatgattatgttaattttgctgttactttttaggtgcctattgagctagagctcttaggatttgtgggggttaggaaataagcaaaatctctcgtttgtgtgtcctacaaagtggcaggttattactagaaaaaaaatgctcgtacgttgcaacggataaagattatttttatcttattattattatatggtttagttaaggtgaaattcactgtgagaattcgtttcgatatatatttttctagaaaatcataagctgcaattagaaatctggtcatctcaaattagcatgcgagctttttaaaaagact

SEQ ID NO: 41095 - DNA, 3917 bp, Oryza sativa
tattttgtcttcactaattaatctatgtttggtgaggcacaagaacacatgtttgattaattacagtgtaataagtcatatggacacaggagccgagaggcccgagagtagactatgtcaaaacgattgagcagaattacaaccacaactttaattctacatgggaacaaagatggtgcacgtatgatttggttaacatatatggtcgattttgctgcaaagcttgaggataaaatactagctaacaagtcttttctttaaaagaaaactgaaaggggatgtgctctatgtaaagactaagatatcaacactgtaagcagtaaaggttgcacaatcctcgcaatgtctaacaaaatttctgtttgtgtagaatccacagtgtatagacaaagctagcgcgagacaactgatctatttctgaattcattctcagtatctgttagtttaattacaaaccagtttacatactattgcgtttaacaatttttttcttcgatggagaatgggaaaaaaaatgtgccaaatatggtctttatcaatgcggaccatgcatgattcatccgaattttcccagcgtagaggacttatctggctagggagggtacttctgttcactatataaactgggctggaatgttgctacaccatctttcataccaaacctagccattgggcccgagagcacttttcaaatagaaaacacaaaaagccactgtgcacgcggggatctcccgttccacctcatttagtcccacctcggaaaactagctccacacatcgcagcataaatagccggattgcgccccttgctgtcgcgagctcagcagcgcgagcttgtaacccgagcgggggcattaaggtggtgtggacgttgcggtacggctgcgggcctgggtcggcattgctacagatggctcgcccgttccaagttgagtagtgggccggcggggcttgtgcgaaagctctggggccccacggttcctagagtggcaggcatggcgtgaggctggtttcacagagcagcgaatactgcccgcttccaacggtggaaggataacgggccgccgcactgctggcccgcttgggtctcgcatcctactccaacggaccaccacttttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgcatgcctgatgcctggttagcatgcatcatcaaagccccatgcagtccagatttaaaacgaggtgatcaccaactgcgttggagacttggagtctttaaagtgaagagaaaaagcacaaaggccatcacaggacactggttagcagataccagcagccatcaggcaaggcaaagttcctcacaaataatggggcggctaccgaatttgttcatggcattaaagcaaggaaaacatcccgtgaaaagatggacaacttcaacatttctgttcaaacgggcaggcttaggatacagcgacacagagacgttctcaagctcacatattatggatttgtatcacacagcaaggttttaatgaagtccacagatcccatatgggatatcaacacacgcattttagcataacagtatttacgaatctaacaaatatgagtagcctttgacgtgacaatggctcatagcagcttgagaatcatatctgcaaaatgagatacggtggaagttagttaacggggaaaaaggtttaatgaatcaatgcatataggcataggccatttcccatatatggaaagtgcagtgaatatgtaatatgcatgcattaaagaatgcatttagtgaactcaaatttgtggcgtgcatttacgctttaagttagcaagcatgtgaaaatgcgatacagtaaagtttgaagacatttgtatacccttctatgattttgcatgaaaatacaaattggccttgaaagactgcatcgcatagagaaaaggtatgcgtgcaagtcactctatacacactgtctcgataaatgcaacaaagttcactatgtcctgataaatgcaacaaagttttagtaacgttcgtccaagtgttagggcttgtagccattgttaacctccttgtcaaaattttggtaagatggtttgatgccaaattttttttggcaaagatactttaaccttttgtctagccttcccaaagtattggcattgtgaatttttgcaacagaccaaatgagcctataaaagctttgccattaccaatattttggtgtggttgggttgagccttatatggtgtttggaagtaaaatcaccagaaaatgcagtcactccaagatgtagcactaagggggtggtgtttcacataaagggaaggtcgacacaactacaaagggcaccacagcaggatgttatgaaagccagccctttcaacacaaacaagggtaacaatagtaatcaaattacaaataaatggagatgagatttcatcactgaggaactcaacataaaaaatacatcatgaaaaatgttactttatatattcggtgaagagcttgtgctacttacattaacaaatgaacattctgtgagtaggattaaataaacaaactgatagtaggattaaataaacattttgtactaccaatattctgtgagtggcttcctggcatgtaaggtgcagaaaactgcttgcgtactgatttaactgttcaaataccattgagaaggcaacataaaaacacccaaaacctttttatctaaaagctaggccaaaagggtttaacatatttttacatccaaaacatgttgaaca

SEQ ID NO: 41096 - DNA, 2240 bp, Oryza sativa
ttttacatccaaaacatgctgaacattcaagagtaaaaagacaacttttatgtttcagcaggtaaaacaatacaatttacacaaaatgaataggtgttatcatgatatcatctgagcacaccaatgatcactggtctcacttcatacatgctgttaagggtgctcctaagttaaagcagaataatattatccttgttatttgctatcctcctcactttttaggtagtacaagaagagtaaatcattatcaaaatatcaattccgtagtaagtcataatataggactaccgcatgttagctgttaaaaatcctgaaagtcattttatgtcctatcacaattcacaacactacatacctcccaagtaatcagccaacagaagagatgatttgccgcatgtatgatgctatttgatattggaatacacagaaatttccattggtgaaattaaggctgtttggctgcctgggctgcatctgcgccacagacaacagcaacagtgctgcaagcagcaaggaaacagcgggcagcagcagccgcagccacagcccaggtagccgaatggcctgattgttaggtcagtgataacagcatgactcattgttttattggcatccatgttatgcaatgacgatgtcttcagcacagggagcatgacatgaatatgcaacacctcagtaaccctcgccatttgacaggtaagatgtgaggtatggttagtcttatgtttccacaaatcttaaaccatagcagcatagccattatttttcggtgcgcagctgcattcagaaaggccaaagtaggagtataactcaaggaaacagcgtggtcttgtagatactagatacacaccacataaccaccttcacattctccatcaaattgataaaaactaaaacaatatttcacaagtgcaacagaaggtaagtattcatgtatgatgctaggggtggctatgtttatcacctgaagtgaaatccctcagccgcgggccttaagctcagccaggcggcgggagaggtcgtcttcatcaacagccttctccttctccttggcagctggtatggcgtgagcggcggcctgcggcaacccaacggagacctcaaggccgtagtcgtcggcgacttgctgcatgaggctgttgacctcggtctcgggcgtggagagcgaggtggagccggccatggcgccctccatgaactcggcctggacctccatgttgacgaactggcgctcgaagttgtccatggtctcggacatcttctgcaggttccccgtggcgagcgcggagtcgagcgacttgacgatgttggccatggacttgccgatgacctgcatcttcgcctgggtgtcgaggcgcgcgacgacggcgtcgaggcgggaggcgaggcggaggtagttcatgtgctcggtgcgcttgcggatggcgttctcggcgtagatccgcgcgccgtccatgttccccttctcgatcgccttcttcaccttgagcttctgctccttctcctccttctcgcacttgcgcgcctgccgctgcagcgacttggaggtgaacttgaggtcgaagatctgggtcatcagcttctccgggttccccatcgccgccgccgacgagctagccccgatcgtggatttggctagggtttgacgaggaggaagaggaaaggcagatcggattgggggatttgggaacgcgtcgtatttgcgaggagacgagacgcgaattggggatttttattattggggagatgggattcggttccgtttgatttgattcgaggaggagacgaccagtcgaccacgcggtttggtttagtgtacgccttaacggcgaagtaatccccgccgtttgtgtgtcgctgcgtgtggggtcggcgtgtccaactccaaccagtgtcgttggcgtcaccgacgccgtttggataaagcgttttattgtatctctaattttggaataattaattactagaaaatagatgcggccttgccgcacaatgcaccagccaatatgaaatattccatccgttatatattgatcatcaattgactaaaatcaaaaatttcaagttgattattatgtaatgttggtgtagttactacatctaagcatgaaaattgggtttgcatgcatgcatataggtatttgaggtagtaaagctctcttttcttgttgggggggggggagttaaaagtgtgcatgtttccttattcttcaccacacttacttaagtttttttttgtg

SEQ ID NO: 41097 - DNA, 1028 bp, Oryza sativa
cccgccttgtgctttccttcctatcctccatcaacagaatgtataaattttatgtagcactgtaaatatgcatgtttccttttaacatgcactaacatatgcatgacatgcattggccaggacatgtttgcaggtggaagtgaatcaacatcaacaacacttgaatgggccctgtcagagcttgtgaggaaccctcatgtgatgcaaaaggcacaagcagagatacgacatgctttgcaaggcaggactagggtaactgaagatgatttaattaatttaaagtacccaaagaacataatcaaggaaacactacggttacaccctgtagcacctctacttgtcccaaaagagtgtcaggagtcgtgtaaaatcctcggctatgatgttcctaagggaacaatcatgttcgtaaatgcatgggctatcggcagagaccctagatattggaacgatgcagaagtgtttatgccagagcgttttgagaaagttgcagttgatttcagaggcacaaactttgagttcaaaccatttggagcaggacggaggatgtgcccaggaataacatttgcaaatgcaacaatcgaaatggccctcactgctcttctataccacttcgattggcatctccctccaggtgtaacaccggatgggttggacatggaggaggaattcggcatgagcgtttcaaggaaaagggatctttatctacgaccgacactccatatgggacttgaaacaatatgatgaatacacgcgtgttgtcatggaaaatgttgataatagccgaatggtgtatgtacctagtagaaaaaaaatactttctgcaaattatagtacctatacttacaagatgtttgggaggtaggaactcctgagatattcagatattccagagctccgagtgcattagtatagaaattcatgcacgaacacaatatatataaggcgttgctgtcatgtacaagagctgtgttttttaaagataaaagtactgtacgtttccagttgtaatgtaacaaaagtttgca

SEQ ID NO: 41098 - DNA, 1074 bp, Oryza sativa
  unsure (1)..(1074): unsure at all n locations
nnnnnnnnnnnnnnnnnnnnnnnnnnnnnnnnnnnnnnnnnnnnnnnnnnnnnnnnnnnnnnnnnnnnnnnnnntactcatctcgtgctgcctgtagatcataaaatccggcttttagagcatctcaaaacatggaagcatcataattatttccgtgtctttgatggcaaagtttatctcgttagcaaagacgcgatcagcataagtagatggtggcccaagtcgaaaggaagatttatcatcaaaaacttctttcatccatgaaatttcttttgtcagtcttagtgcagcagaatttgcagtctcagagacaaagttttcatcatccataccgtcaccaacatcagcaagtgcaaacctagtggcatcagacgaaaattcctctatggcctgtcgaagggtcctgaaatttcctgtggacttagacatcttctcagaattaagcagaaggtgtctgttgcaacggaatccgcggggccaatgatgttttggaagaagtgttgtgtgattgaagatacagaatgccagatggttctgcataaggtccttacctgaaattcgaagatcgaagggataccagtactcaaactcttgcttcatttttgtcaaaacagtagaggggatgctagtttttggtgccggaccattacagaacacataatcccatacttcatcagtcatttgttctggccttatataagagttgtcagatccataaatgttaccattttgcagtatatgtgcaatggtgtagtaggccatgtacaaagttgaatcagaaagagaatctacaagaaacttctcatcccatggaatccgagtacctagtccaaaagaacatgaacgggcccgtgaagtcagccagttcaatgtgtgctcaaaactattacgggcttcaactgagaatgtattcatcttgtccaagcattctatagccttttgtttccattcagcctcaccatatgttatgagccattgatctgtgagagcaacaacacagtcatcacctgacctggaaatgaccttctcctaaggctcatagtacaaaacagcgggtaccgagctcgaattcgc

SEQ ID NO: 41099 - DNA, 1773 bp, Oryza sativa
  unsure (1)..(1773): unsure at all n locations
atcaagccatcagctgataagcttggtaaagagatacaacagtatggaaatcctccagtgctcccacctgccaacaaaaactcaaaatttgagttgacaaatgatagaatttatggccagaccactgctagtgcccaagataagtacaggagcaagagatctaagtcagtagcaaaatctggctcatacaaatcccagtgggagatcatgaggagctttggcattgctgatggagagattgtggaatttcaaaatcttcatcattggttaagctactttcctccgctggccatggaagatctcgaggattttgggctaagttgtgattggaggcgttcatttataaccactgatatgaatccattttatgatgcttttgtccaatggcagatgagaaagttgaagaaaatgcacaggattgtcaaaggcaagcagtacatgatctactccccattagatcgccaaccttgtcttggccatgatcgggcatcaggtgaagaggtcgagccacaggaatatgtactgattaagatgaaggttattccgccatttccacccaagttgatggtcctggaaggcagaaatgtgtatttggccgcagcaacactcagacctgagacaatatatggtcaaaccgggggcgaagctacaggtaatcatcggggtcagtagaccccaacgatgttttgctaatgtccagtacccctcttattttacaagctatgcccccaatgaagagctaaactagacnccagtgacatccttgagtgttccatcaaagagcaattctatactagtggtacctcatggtacctcctcaagaaccgtaanattgctctccatcaaagctcaactggttactataggaacgagatactagcaagcagcaaatagaaaatgaactagcagttatgattatacaatggcccaatatgcatatacgattgatatttgagcccataaataagatcggaagacactactccacaaattccctggttgcatcatcatattcctcgttgtattgcatcggcatcgcacgtcctgacatcatatttatcatattttattttatttccagcataatggaaggcaaataattagtggttttgataatctttgatgcatttggtgtcttttacagcttgtaaaataatccaataatgtacatgttttaataattttatcgacagaagctgtaataggcaagatgtaacactactacaacaggagttggctttattttaataattttgtctcgtagtatgtagtctctaattacaagctgtaataattatgtagttttatttccgatttactgttggattccaaccagccgtatggcatttttcgcaaaaatttgattaatcttgatcaaattttggtctacttttttttattcaaaaaataattctcgaagaccattcaaaatttcactcggaatctacttttgccctgcgtggaaacatcaaaattgcatggttttcgatcggttttggttgaaaacgtaaatcctgattagtacgaatactgaccgcggtaactatttatcctggcttcgcccctgggtcaaacaaactgttgggtcctccttgatggaaagtatgggccttttgagataaatgaaaccgatgtttttatattgacagcaagagctgcacgtaatcttgcttaccagatgctatccagagttccagaaaagccaacttgcttagttgagctgnnnnnnnnnnnnnnnnnnnnnnnnnnnnnnnnnnnnnnnnnnnnnnnnnn

SEQ ID NO: 41100 - DNA, 1354 bp, Oryza sativa
  unsure (1)..(1354): unsure at all n locations
ctatagggcgaattcgagctcggtacccagtcatgacctgtgagagatcaatcatgaaattaccagattattgtgttacatgactgaagaagacataccttgaaatttaacatgttgaacaacgaaactttgccaccagatgcagaaattagatagcagtcatttttggatagtagactgcaggcagctgcttcttcagggttgccattagcagtgtcattcattagaatgtcactttccggttgccacacttgaggtgggacagatgtggtggactaacaaaaagtagtgatggttttaagaaaacaaccaaacagaactgcgctgttgaaatcaaaataatttagttctcctgtctaaccatgccagcaggattcttgtcattgctctcccatttccacagcttatgaacagcatttgagctgagagctaaaagtcccttcccactttttctataaagcagacagataacctataaagaaaagaaataaaacacaatgcttatcagaattgtataccgatctgaatattctagtgaactgccagaattgtataccgctctgaatacagcttataagttataccactatcgctttgaattctagtgtgctacatcacaaaaatgagaaatcacatccaatgtcaatatcaacaaatatagacgcttgtgaaatatttacatgcaaatatcaacagatactgtgatcttccttgcattaaatagaatgtaaggtcctatgtttcaggttgataacttgatatttcatggtcaacgtactaatacgaaaagatgcacgtgcaaacatcgctgaacatactttgcttgaagatgcttctgtaactggcatacgcagtgctcgaatacggccagagctaacaatgttcgccttccaggcctcatttaccaactccggggttctgctcacatgcatatatgcctgcattttcaatacaattagcaaataatattgaacagcaaacgaacaagaaagtgcagcaaactcagctggccactcatgagttcctggctataactacagtacacacattccaaatggaaccaagggcattcacaatcaggggctgcatggtaaaaaaaacagtggttatttttcctctttctcccagtttcttcatccaacggccaaccaagctcaacagcagcaacggtcttcctgtggcaggacacggcagtagatgggtgtcgaagcatctccacgtcatgaagaaatctgcagtgaaatgaattggcacagaggacagtgatggtggggagacgtcaaccagnnnnnnnnnnnnnnnnnnnnnnnnnnnnnnnnnnnnnnnnnnnnnnnnnnnnnnnnnnnnnnnnnnn

SEQ ID NO: 41101 - DNA, 1083 bp, Oryza sativa
  unsure (1)..(1083): unsure at all n locations
tactataggcgaattcgagctcggtaccaggacagtaagttataaaatatgtagccaatttactacatacctaaaggaacacaaaaataactgtcaagttctattgattgctgaaaaacaatgatatgggtacaaatatcattattttcataatcaatcaatgtaaaatgacaattttaagtcacttatcccacgttttaattgaatgaacaattatgctcatcacactcctacacaaataattttcgcaagcattctttccacatgttcctcaaatgtgcagcctcatagttagtaagtcttttgcctaagacacatgcgccacctttagaaataacttttgtaatgtttttagacataggagtacttaacccttaacccacaaggtagcgttgaaggttttacatatagaagtattttatcggagtacttaacccgtaaaggtagtattgaatcgatctactctcttggctatagaaaaaaaaagggctcattttacatcctaacaacattttattcttttaaatttatgcttctctacaagtcatatttcactttgacacatcaagagacgaaggtaaatgataattaaacgaattcacttagttccacgctttgcacgtataagcctataaggtgtcaatacaaaatcaatagcatatcttataacaatatgattagaagtttcctactaaattacgttgtaagactaatattgactaggtagttttcttaaaaatattgtagggtcctacgtataagaagcgctatctaatatatgtatatttagggaaaaaaatacatttatgagcaatacgagtttctcaagattttttttttaaaaaaacaatgaacaatcaattaaaaagggaaatacctaacattaatttaaacttattttggtagacctgtttttaaacaaaataacaagcatgcccgcgcattcacgcgggctacctttccagtttgctttctagtttgtagtaagtacttcttcccttgatgaaatttggtcgctnnnnnnnnnnnnnnnnnnnnnnnnnnnnnnnnnnnnnnnnnnnnnnnnnnnnnnnnnnnnnnnnn

SEQ ID NO: 41102 - DNA, 1232 bp, Oryza sativa
  unsure (1)..(1232): unsure at all n locations
tgtttgagagtactccaggacaaatttgacactgaagcaagatccttcactcctgatgaagacattattgatgctctggtgaattgctcttttggacaggagctaaacttgaaacaaataaaaaagttaagtgtatgcctttcattaagttcaagaaagatgaagcacagaatgttggttttcaggccctgtaaccaaatcttccttttggtgaaatggagattcttgaagcgaacaaggaacagatcaaaagacagttgggtcttaatcacatagagatattgtcatcctcagatcctctgatgaggctggtgcaaacagagctggttcatatgcttacgtgctcaggaaaaatccaccttctgctggaaaccctattgcaatattcttaagtaaactggagttccagagtcaaacttgaaaatcactcacttggtttcggtaataacagaacactcaggttgctcctaacttgtcttatgcagataccactcatgctgcctttcaaacaaatagtttgctgtgtataaaatttgtcttacagtttgagaaaggcaccaaaaaccctgggggtttaaaatttttaaactgaacctcgtatagaaataaatcattgtctgaacattgtacagaaatgaacctgtgtaataaagtgtcattctatctgaaatttgtaaaggaatgaacctttgttatgtagactntgtttttagttgtatgtagtatgtactgctaatcantgcttcttcagtgccttgtgttcatcgtcccactgttgtttagttattagcagtaaaagttccttatttgagagaatccattatatgccactgattttgtcacacgtctacaatttaccatcgactttatcatgttctataatataccatcgacttttgcttaaattctacgatttaccatcaccatccggttagcctccgttgtactgtacaattttgtccaaataaccgaaatacccctaggacaaaaactttcaaaatttggataacaaattcaaaatatcatattataaatataagattgtaaacatccaaaatttggccaaaaacataaaatcttatattttagaatttttatccaaattttgaaagcttttgccccaagggtattttggtcattttgacaaatttgtacactaacggagactaaccggacagcgatggtaaattgtagaagttaagcaaaagtcaatggcatattatggggatcct

SEQ ID NO: 41103 - DNA, 908 bp, Oryza sativa
  unsure (1)..(908): unsure at all n locations
cacatttgggaggaaattggacaaaccaaataatatgttttgtattcctgccctgctaactaacctggcctgtaccggcctctccctgtccctccagaggaaattggaacgtctgtttagaaatgtgctcatgcttatatgctgtttgtataggtgtatgtatggttgacaggcctgcaagtggcctaatccaattttgatgttcgcctgtacatgtcttatgcatttgtctttggtattagtccctggactgatggtacaatgtactggttgtgaggatcaagggtagggattcccactcatctagctattggcaggtcccttgcatgatgtggtacaggctcttgaggcaaggcaaggttaaaccatagatgtaggtactgctcatgtgaactaaccgtactgtaggaaggcatgctcagctacccgcagggccttagcccatagtagtgtggttaataaaattcttttatatgatttcttttttttagagaaggtattttttacccggcctctatatccaatcggatatatataaccatttaaattaggaacttagcccctcaaacaatacaatctgaaattcgctcctatgaagatttgaactcaagaccttggggtactactcaggtcactgcaaccactaggctacatgccctttctcatgatttcttaagtccgcaagatacctttaaagtcacctacgcattatcattgactttcatgttgattctttataacacaaattttgcagattgaaggacctcaactagtgcagcatggattcaaagatgctattgctaaagttggattagcaaagttggtttctaatctcccagcgnnnnnnnnnnnnnnnnnnnnnnnnnnnnnnnnnnnnnnnnnnnnnnnnnnnnnnnnnnnnnnnnnnn

SEQ ID NO: 41104 - DNA, 1048 bp, Oryza sativa
aatgaatacaatcattgtgaccatctttctttatgcccccacattagtctgaattgaaaaaatgccttatattattcacctacaaacacaagagttgcatgcatgcataaatcacaactacttgcaagagtattgcaaaacatggttactcacaacaatgaactcctaaaaattgctaaattatgtagtggtttactggtttatggatcaaattctatccttggtggttggcaattgtagaacacatgcatgatattctttcgtagtttcttcaaattcatataatcaaaatttgccttttttgtaacatacgcaatatggtcagtgcacaaaatccaggccaggtcagaaaaactggtaactactagttactagttctctccatggattcgaactgtagactctggtcattacactcctttacttgttttcctacatagtgaatactgaataattttctactgtatttcaaatcctctccaataaatcaacgacaaaatatcatcagcacagtgataaacaacaagatggtgagaacttgataaatatgctatgcttaacatcggctatgttgcgatatgcctttttaggtatctatagacctatatgctaccaacagctgaagtgttaaatatgtaacaaacatgcataaagataaaattagacttacaataattgcaggagggatgcagacaaggagagcaattattgagatgtacgcatacaggttggtgctatccatgtcagtctgtgataaagaacagcaacaaagtaaaaaaatgaaacgggagtatcaaaaggaagagtgaatatgcatgcagatcattagaggtaacaagcaaaccatagccttcttggaataaacgctccgtaatgtgaaggagatattagaaatcatggcattaacgaaaccagtccaattgaatgaaagttcagtgagagatgccattgaaacacctgattatttcaaaacagaatatactccaaatgattaccaatgcacagaagtagagatgctatagagacaactagaaagtcctaaaacata

SEQ ID NO: 41105 - DNA, 1241 bp, Oryza sativa
  unsure (1)..(1241): unsure at all n locations
nnnnnnnnnnnnnnnnnnnnnnnnnnnnnnnnnnnnnnnnnnnnnnnnnnnnnnnnnnnnnnnnnnnatgcatgttgtcacatgaaaggaaaaagaaaaggaggcacacatataaagcaaacgtactatggataggggaagtagtcgaagatcttcttgttaaggatgttaaatatcacgttcagaaaatacctacaaaatcatattgtgaattggcaatagctaaaccacattaggcagcaacttctcagttcgctcacctgcaattgtaaattctaaagtgcgctcaggtgagtaagcataccacatgaagaaaaagaaaccggtgacaagagcagggtatctctctgcaaatcccacaggctttgcttccctgtaaagtgtaatagcaatttctcagttcccgaaattgaagttacatatacagggtggtgagaagaattggaattagttcaaatagagaatgatcacttaaaagtttggcacggttcttttgtttaggaggcgttgtccaactagtgaaaaagttaccggattcatagcttgtccctaattgctgcaaacctatgttcctagctcttaactttccattaatgaaagagcatgctagcctattgattcaaaaagaaaatgcatatctacaaatatccactgagaataaagtaactccatcgcctagactctactgtcttaaaaacttgccacaatcagaacctgtgttggaacatatgagaacataacaagaatatcaatgcagaaaaaaaacaaaacagaagatgagaaagcatagaaacttggtgtttgagacacaggaattgttatccatcattccaatggaatatttcccttgacttcagttcatttttattttcctttgggaagtacatgaaagagcaaaacttcaaaggaatctggcctattcatccattccaattgctacaatcggtgaaagaacacttatccgagaggggaaagcactatatgtttgtgtctttgtgatatggcccatttgtccaacaataattataaatgagtggatattttgcagtcacaaataaattggcccaatcatcagatgtattcatgaacaatgccaactttccgtatttgtttctttttaaaagtattcatttttcagtaaaggcctcatgtgctatatagaaattatggttaacactaagttaatnnnnnnnnnnnnnnnnnnnnnnnnnnnnnnnnnnnnnnnnnnnnnnnnnnnnnnn

SEQ ID NO: 41106 - DNA, 6575 bp, Oryza sativa
  unsure (1)..(6575): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatgatagatcagattgatccacagacactttaaaagggtcaaaatttgctggccttatctcagatgagatcttctttatccttcctacgacatcaagaaactggttccatctttcaaccttcttcctcttcatctcttctaggtatggtaatattgcaccgagctcatcccgtaatccacatgctttctgattagactgataaaacaatcaaaaacaaagaactaattactgccttactggtagatcctatttcgctacagcatacttctacctttcaagttggataactaaataatacacattaaatgagcccatctgtgactgtaatcatatactacctccgtctcaagatatagcaaccagtactagatgggatataatctagagggttgtgctccttccggctattgggtgtggcaactccgtggcatgcacaacaatataagtcattagtgcatgattaattaagaattaattattataaactcaaaaattgggtttatttgttttttagaataaatttgtatgcaaaaagtttttgcaaaacacacactgcttaccagttcggaaaatatgctaacggaaaatgatgaagttaccatgcttgaatacaggcgaaaggtagtatacgaagaacatatgaattcatagcctaataataattcgataatatcacaatacaattgtgggtagtgtttttgaatcggagaaacggctaaattctgatgcgccccaaaccattatagtaccataacacagtaaatcgtatcaaccatcaaaacataagctcttaaacgacagaaaacagaagcaaaagtgacagacctgcctgacgtggaccgtcgtctcgccaatggcggagcagatggcggcgagttcagcttcatattgagcgatcgcctgccgcagctgggcgcgggagcggttcgcctggtccaccttcctcctgtacacctccaggcactcctgctcgagctccagcagcatcctgtccctcgcggcctcgggctccccgacctcgtcccagatgacctgcaaccacgagcgatctgaatcagcgagagaccaacaaaacctgtcaccgccatcgcggcaacagcagatcagtcgacagcgaggcgcacctggagctcgtgcatgagggatccgcatatggtcttcatcgggaggaggcgctccttcggattgccgctcctcgtgaggacgataccacgcagcctgcaggggaatcaaacggggagagattgatcggcgtcagaattagggttggcacgatcaaccagcagtaacgcctacggcctcgagttcactcaccagtctcggtggctcggctcgacggagggcgatacgggaggccgaaacgagggcaccgctgcgtcgtcctcggcggcggcggcggcggcggcggcggcggcgtggatttggccggagacggccgcgcgattttgggggaaatgatgagggattgaagagaattgttcgaaacaacttgaaaatgggagggagagggggaaacgattttggatcaccggatttgggcggcacaggctgatagatatactgggccgggctagtcactcttgggccttttattttgaattgggctggagatggaaagttttactgatatgggcctaggctaaacaactcataaagctgttgcagattatgctgagtggtgagtagtgagaaccaaactagtagaagtacatagtggggcagtaaaaagagttaatgaaacaattaaaaataatttataggtaaaaattttgtatctgtattacggtttaaaagctaaggttgagaagttgactataatgaaaaatcctaaaatcaattttacaattaagcacaatcattctgattgcaaattcttccgccggagaagcgaatagccacaaccaaagcatggatatggaaataataaagaaagaattaccaactaaaaacaagaactcaatgatcctatgcttcatggatctgcattataaaggacacatgctttcgaagttccgagtacttttgtgcagcacaatacaatgtcactgcggttccttattaggggtaaaaggagaaaaggaagacaaaaaaacatcgctcatcagaagatgtcacccctgcttgtaatcacgtcctggctacagaacgggcatatagaaaccagaatccaaaaatttaacttgtacagaacttaacaatgaagagatcttatgaagccgactccttggcgatcttctcagctttagcaatgacttcctcaatgcctcccaccatatagaatgactgctcgggaaggtcatcatatttcccatccaaaacaccctgcacatcaacagaaactttagcaaagagcacacaagcaaacatgaatatacattactaataagcataatgaagttctgtaatatcgcgtgtctacaactacagatctagcaaaatgtgttactgaacaaaggattaaaaaagtgtagatggattgtactgtctggtaaaactagtgtattcttgcaggcacatactgattcatcaattataaccccaaaaattgcaaaatactgtaaccgtagtggtactgaactccaaaaactactatgcatattcaattctgacctggaaactgttgacgctctccttcagctccacgtacttcccaggagcacccgtgaaaacttcagccacatggaagggctggctcaagaaacgctggatcttccttgcgcgagcgacggtcaacttgtcatcttcactgagctcgtccatacccaaaattgcaataatatcctgaagattcttgtagttctgaagaaccttttggacaccacgagcagtgttgtagtgatcctcacccaaaacatggggggagagcattctggatgtggagtccagaggatcgacagcagggtaaataccaagctcagagatctgcacagatagcaaattcaagtcataatgaggacattattaacacgatgtattaggtcagttggacaaacctgtcgtgacaacacagtagtagcatcaagatgtgcaaaagtagtagcaggagcaggatccgtcaagtcatcagcaggcacataaatagcttggacagatgtaatggaacccttctttgtagttgtaattcgctcttgaagtcctccaagatcagtagcaagagttggttgatatcccacagcagatggaatacgtccaagaagagcagacacctcagagttcgcctgacatcaagattcaagattaatcaaaaccataacaatgggacttagtagaaacacctacgctacgtatactactagtaattcttttttatgcagagtagaaataccaaaagaagagatgtcttgcataaattacctgagtgaaacggaaaatgttgtcaatgaacaaaagcacatcttgtccttcggcatcacggaaatgttccgcaacagtcaaaccggtcaacccaacacgagcacgagcacccgggggctcattcatttgcccgtagacaagagcacacttgctttcactctgcaaccaaaattgatatataagtagcttgcacatgtgtgcgtcccacagaaaataagatatcaactaaaattacctgtttgtcacctagcttgatgacaccactttcaatcatttccctgtaaagatcannnnnnnnnnnnnnnnnnnnnnnnnnnnnnnnnnnnnnnnnnnnnnnacctggcaaacaaatcatcatcagtcaaatagaacaagtgactgaaatttgaacaatatcacacatgagactatgtatagatgcataccatgggccttagcaacattgttgatcaactccataataaggacagttttgccgactcctgcaccaccaaaaagaccgatctttccacctctttggtagggcgcaagcagatccacaacctataaaattaaaccaatgtacagcaattaggactctaaatcatggttgcaactatttaccattcaaatacttcagataaccacaggatcagagaagggtgggacaattataccttaattccagtaacaagaatttgctgttctgtggcttgctcaacaaaagcaggcgcctcacgatggatgggaaggaagtggttcgttgctacaatagaagtcagcatcaataacaaaacataaataagaactggacacacaaattcttaaataactatgaataatgaagacatggaacatatagtaacttacttatgtcacccttctcatcaattggctcaccaataacattcatgatacgtccaagcgtggccctgccaacaggaacctacaaagaagaataacttccaagtcaaaaacatagtagaacacattatatatgattagtttcaacttccaagacaatgctacagatacaaggttcagcaactctaattataatcagaatttacacgaatgcatcagcagttctctgaattcagtaatgcccattttatgctaaacaattggcaagggtattaaataaacaaaaactggaatggattcctagactatgacgacaattttcattcaagcaaacagtggaaaagttataccaaccaatgcatgttaacctcacaatacgccaatacggaaatgcaacactggtgaacataatgaattctaatagactctagatgaccaccacaaaccaaaaggcagcactttataggggaaaaaaagtcaatttcttcactagcacgaacagaccaccacaaagcagccaacagtctaccgataaaatgaacgaaatggaagggcgatcgctcgccactcagaactgtacacctagatcaaatctgacagcagtagatccacatttcgtcagatctggtcggagacaacacgaaatgaaatgtacgatcgcaaacaaggatgagaagacgggcgggggggcattacagtgattggggagccggtgttgaggacgcgctgaccgcggacaagcccctcagtcccgtccatagcgatggtgcgcaccatgttctcgccaaggtgctgcgccacctcgagcacgaggcggatgttgtggtcgagcacctcgagcgccgtgaggatgggaggcagcccctcgtcaaaccgcacgtcgacgacggcgccgatgacctggcacacctgcccgacggcgccggcgccggtgaactcgtcggtgatcttacctccacccgtggccttccccgtcgcgggcgcgggaggcgccgcctccttcgccgcggcggccgtggcgtacgcggcggcgcggttgaagaggtaccccgatggcgacggtcggtggagcggcccgcgcgggcgcggggcgggcgaggccccgcggagcctggaggcggcgcggacgagggaggagagggcccggcgagtcgccatggccgggagatcgccggagacgcggggcctggatctagggttagacttttttttttttggttgcggcggcctccgcgagaagggaggaggagaggaggggagcggagtgaggaggagagtgggtgcggtgggtgctggagatatcgacgtgtggggggattggcgggtggacccggtctacgggagcccgagaagcgtggaggagcgggggttgtgtggtgcatggtgggctcagttcatggaatggattgcaatttttttggggatccatttggtagcttgatattgcagctggaaatctggaatataatagtgttcctttttttttcttcttttttattttgggctgtcaactgtcatttggcactttttaatggcatttgatttttgctatgttttgatggtgacagaggatttcggtttttattgagtagatgatgacagcagatgattattttgaactattataagttcgaaagtcgaactaaaactttgcgtaatcttcgatcaagccgtcatgtttagctattttctagtccaaattcgtggctaactttggtaacagcatcttgttcgaggcctgtaaccttttcttttttagaaaatcgaggctcgtcactctgtcagcacacaaacgttgaaggaataagttcattttaggtccctctatttgtcgcccagtctgattttcgtccctgaactgcaaaaccggtacgacccgtccccaacttacgaaaaccggacaaacgaggtaccttgacgattttaagggtggttttggctgacgtagcgcctacgtgtccattttgactcggtcttcatttgatgtggtactgacgtggtgcttacgtggcaatccgatctagaaaaataataaaatctgtgggacccacatgtcagtcacataaaataataataaaaaagatgggacccacatgggccccacatgtcagtccaactcacctcacctcttcttcctcctctctccccatctcccatctcttcatctctctctttccaggcgacggcggccgctcctctccctcccacctgcaggcc

SEQ ID NO: 41107 - DNA, 5032 bp, Oryza sativa
ctccctccctcccgtcggccggcttgcgctgcctcctctcccgccggccgccccgacgagctcgcctcctccctcgcggcgatggacaacgcatggccgacggcgcgcgaggcgcctggggcggcggcggccatctctctcttgcgcacgctcgcctagcagtccgccgcccttctccccgatgggcgccggcgggagaagagggatcgaagccacgtgcctctccccgtccctcggccgccgcggccctcctcccgtcgtcctccccctccaccgcgccctcccgttccccccccccggcgccgccgcctctacttcctcgccgccgcggccggggacggccgcgccgatgccctcccctcgtctgagctccgcaagcgccatggcggctctgctgcttctggtggtggtggtggtggtggtgaggacgagaagttccacttgctccgtcgcctcctcgcgcggcccaacgtcgccatcgacgcctacatcgtccccacgtgcctcgcgcgcgccgtcgcccgccgccggccatgcgctgtccattgtcgcgccgcctgctgccgccgtgctggacgccgcccgacgagaggagggagcagagagatggggagagccggagagaggaggaagaagatattggattcggtcaacgacatgtggggcccacgtgggcccaccatatttattttgtgtagctgacatgtgggacccaccatttttaaaatattttttggggctgacatgtgggcccatgatttttattattttaccgagatataattgccacgtcagcgccacaccagcgccacgtgggatggagaccgagtcaaaatggccaaaaatggccaagtaggcgtcacgtcagccaaaaccgctattaaaaccgccgagggatctcgtttgactgatttttgtaagttggggatgggtcgtatacggttttgcggttcaaggatgaaaattagactggcgacaaataaagggaactcaagtgaacttattccaacgttgaaattgctcagtcattgggccgtcatgagcagtgggaaacgtcatcctgcacatgcggcctgcactaccagcccactagttgttgggccatttgaggctttgaacgcagtgtgctcggagaaggaaagctgattagctgagcctttggtattattcaggcccactcgtgtacattgccttcattgttacaagaacaacttcattgttaccaagaacaacttcgaacccgagcagggaggtcagttttctgctatctgttaactagttctatctggtatgcatctgatatatgctaatgatgctatgcaggtaaactgtaactcggatgttctccttcttttgataacaggtaactgtataacagaatgcttgaaacctgatgttcagtaaaccgtcatccagcagctaatcgaactgccgtcagctaacgcattcggttttgctgcaacctcatgacttcacaagtggacttgcattctgcagttatatcttcccaagaatcttggctagcaattgctgcccaagagctttgttacttcttacggaatacggactgcagcttgcaaaacgaaaataaattatacagtacttcaggctgacctactgttacatttctcatttttcacggagggattattcaatgtactgtactagtactagtattctgctaggatttccaagatttgataattggtgactttgttcattttgcataggagtatgactgtatgacaggaccacatgacgcgatgcactgtattttgaagtgtacacggtgacagcattcacgcgttgtagctgcatggctgcatcaggttcagagaaaagcaggccgaggcaataatgaatgtaagacggcttgttagtattcttaatcacatgaatctttttttcaaactcatttgagacttgacatcctccaaaagcttatcagagtcctgttaaacactaattacacatttgatcccattattgagaaaggaagactaccatcaacctggcccctcctaacaaaaaaaaacatcaagcaggccatcttgtcaaggtctcaaggataattattcaaccatgaaatcaagaagatctcaccacttgttgaagtatgtcataggcaccaagtcctcttttgctagcctccaattaccataactagttactacttgtatactagctagtaactgaagaccccatcacctcacaactcaatgattaaaacttagattaccacttgttctaaagtgactgtttttttttctttcaatcacgtttcagtttcatccatactctgtatgagttatatgaccagagcgatgatcacagtgtgaatcgtcacctctttagaattattctgtctctaatgattgtatctgatcttatatatatacactgagtgctatcacaacgacaagagcgtagcattgacttgcagctggaaaatgtgacaaaactgactatctcgcggccgtttcagcaaacaaatggactgaatgctactctattggccatggaaacttgtggaaacgaagcactgaaacgtagacttggcctcagctgcaaaacttcaaggattgagacaaacagaattggatgagcgatcgcgttggtggaatttttctatcttggctgacatcgaaagcatttgggttccccatcaggccgtcgccgactttgtttttgggggcttgatatgattagattaagagaggagttctatccaataggtttttttattagctagtagtattcaattagcttagctgactcctttgctagaggattacaaagtcaaaatgttcagctgtaggaaacacatttgaggagatatgtacagtagcagtgtagcacatttctagaaccagttggttggtggcaatgcaaacaatactacaagatcgacaaagcgatttaattctctcctagtacacgaattaaaatctttgggtatgttttacttttaaactttatctgtagtgtataagaaaaacgaactttaaaaaggaagaaaaaactcacctagaaaattgggaaaacgccaaaacgtaacatctctgctgataaatgccatttctagcaagaaagtatttttttccattgaggtgatgtgcccttgtttcttacattttatcaaaataattataattattttaacaacatggatcaatatatgatatatcattacacaaacacaaaggttaatatttcaaacttttaaaaaatatataactataaatgatagtacatgtattatgcattagctagagtttaatttatttttaaaaaaccttctctagattgaaattaaacggctatgtatttgaagttacctatcactttctatgtcccaaaatataagaagctaaaaatgaatggaacattttctattattacgaattcagttataggtttttatattttgggacggatggagtacataataatctatattattaaattatcttaaaattatttggaaggcgtacaaaagatgatgaccattacctccatggctccatctacagtaaacaactcccgtttctaacgtgtgagttgtgaccaataattcccctcgtcagaaatgttcctttcagcgattgccaccagccgcctgcaggtaccaagattgtcaaatcacctttcagtccccgcgcggcaacgacactagtacaacagcgcaagtatagccggtcagctaggcttgcacagttgtactacattgccgcccgcctcgatcgtcaacctgcagacgcacacgcgcactagcccgtgtcgccggcgctcgcagggcccccccggagacgacatgccatcgcctctatcgctaaagccgtcgtccacctccccggccgtcgctgtcctctcctccccctgcgcgagcaaatcgatcgaaatcacggtggctcatgcgattctctcgtgtgtgaacggcgccaaccgtggcagataccctttgccgagcggaaaagggtgtcaaaatgcggtcgcattttctgcatttccaagcgacccatccaaacaaggactcgcatggagtagctagttctagccccaaaaaaaaaggggcgagatgttagttatagttagtggagggcttttgacttgcagcgtccggccgccggtgtacggaggagaacaagggaacagcctagcgagctatctgctcctacctacatcgtcgtctcgtcaaggttttgtttgttcgctggtcgatggattggaacattcgcgagacccttctttggcatgcgttgaaattgttctctcgaaatggaccgaataatgttcctcgataaaggaccgaattggagtactagcaatgaaatgtatgcacatctgagtacgagaactaattaaacaagcagaatcagaggccaggctttaagcaaattaaactctgcagcgtacaaacacagttaattaagtccatcgtctcgtgatctcgtatgatcagaagaataacacgtgacggcgacgctgctgggcagaacacagacgatacatggtacttatcctcatcttaagcgccttgatctttaatttatatgtgttaacactgattattttttgaaaaaaaggcggatttgtggaatattcagcggccggtatcgacaagcgcaagcgatagatgggtcaagtggggggttttttttttgggtacaaatatgtgaacgattgattgggaaagatcaaccgccattgatactgtcgctacgtggaaatctcaaatctataagcgtagttcgtatgtctatctgcctgcctaactcgaccatacttgcatttctttcacgactagttatagctcgaaattgatcttctacagatatggttggtctggcatgtaatggatgaaatttgccgctacctgttggtgcgtgggtcttgtgttcccaagaagatggctagttttggcgttttattaggttggctcttatctagtgtgagatcggacggtgaacaatagcgggaaacaatgtttaatttagctgaaagtgcgccgggggggggggggggggggggg

SEQ ID NO: 41108 - DNA, 9296 bp, Oryza sativa
taaatattctatccgttctaaaatgtaagtatttttaatatagtgtcaagtcaaccatttttaactttgactattaatagcaaaacaaataaaaagatcaatcatgtaaaattgatgttactagatttattattagacaaactatcataatatgcaactctttttatttaaaacatcttatcttcaaacttataagtggtctgagtatcatatcgaatattgtgtcgtgttccaaaaatgcttatattttaggatgggggagtaagtgaatgacctacaatattttgatgaacttttatgtatatgtattattaacctataatcatttaaaatatagtagtggtggtgatggttctgccaccatcccatctccaacttattctttaggagaaaaagaacatgtggggctaaagagccacatgttaaccaccctcctcaactctccaatatttacttctccatctcaaaatattgtaacttaagataagattttgccctaggacacatcctaatatgagaagaaaaaagatagtgtagactgtagagccaaaaggtccacatgccatagcaaaaatatatagcaactaagagatagtacattaaaaatgatgataataataataggttaatgatagtatattggtgttttaaaagctaataatgctgaaaaatggactcgaacataagttagtgacgcatgcctcaaaatgaaaaggaaaaaaaaacagcaggaacaacatgtcgacatgttcacaagcggtaccaagagtcaagacagaaaaggcagatgctgaacaaagcatccaagtttatcccaaaaaaaacctgtatattgtactagtaatgaatagaagacctatgacatgtacagtcaatgcatgatgcatcaggatatccaataaccgagaccaaaagttacacagaaaattgagaagtttggttcacgccaaaattagaagtttggttgaaattggaacgatgtgatggaaaagttgaaagtttgaagaaaaagtttggaactaaacaaggcctatagaaatagcaaaaatgtttcacgggatgctaaaacaaattaggccctatttagttcacaccaaacttcccccaaactctcaactttccatcacatcacattcaaaactttcatacttaaataaactcccaactttttttctaatttaccaactttccccaaacttctccctaatctcagaaactaaacacagccttaaaaaaaactgagtttgttagcggtacaaaaagctcagatcttcagcttttgaagtcactactctggattgtactagcatccatgaatatatattttctgaaggtaggtccctaactcaacgttatcctggtacggctacagagcgacgtatccgtatctgatacggcaacggatacggatacatatcggatatgttccgatacatattccgtacgtatcccacatattcgcgatttaaaaaaacaaaataaatcgagatatgccagcgatacggccgcgacgtgcctccgtcttcgctcgcatcagggatgcgccgcctcatacgctcccatcctgatggctgtctctcgtgcgtgcccggcgatgccaccagagacgcggctgcagcagcgcgcttggttgccgtgcgcgggccacaacgtcctctccgcgagacggaagagctgccgcggctgggcggtggcgcatctccttcgccgccaacctcggaggccacgaccgttgccgggcatagcggaggccggtggcaggctggccgctggcaacatcaaagcaaggagctttttcattgtttgcttgagtgcctggccgggtaaatccatgctctttgaacatttcttgcttgaatctgttgggcctttcttgtttttcttaggacaaagtactatcgtttttgttagatacaagtgctagtgcatctagcaattctagtggttactggttagtgcggctgctaatgttgatgcaaagtcatcaagagttatatgattgaactattaatatgtagtttttgggatcttaatcgcttgttaatttgaattgcttatagaaaagaaaattgcaaaatattgatatggaatcggctacactaatactagtattatatcgctttttctttataaaagctccttattttttttgtatttttaatatatattaatgtaatttccttaattttttttgtgtgttttcaatatatatatatatatatatatacgtatccccgtatccttgttttttttggaaaatgtcgtatccggaaaatgtcgtatccccgtatcgacgtatcgcgtatccgtatgtatctgagtaacgtagggtcccttttccccgacagctttaagagcttgggtgatagtatgctctgcaagatgctgcttaccttttgttcttgcaataatcctcgggctagtttttattactagtaccagctcagaaagagacaacagcagcgagcgcacacacacggacatggacatggcatgggcggatggtctctctccgacttcgtttccaagggccctgctgcacttgcaccctgcactgcacttgcttgcggttgccggcaatcgacgtgtgtctgtacttgccgtcgtggaatcgtccgatttcacgaccaactcagcatcagcgatgacatgaacagtctgtgtgcatgtgtgatggattgagatcagggtgcacttcgatattgcaagtgcacactaaagaactgcaatgaatctgagcctttcatattttaatctaatggtacatgttcgctgctacgatatatataaattactattattacttgatatagtgaaatggagctacaataatgcattgatttgggcctgctttctcaaatctcaacacgtggtgttacactaacagctgcaccattcgtgtgtgatatatgatcatagtaaaggttactgattttgctttctagtgcatcaaaacatttgaagtcttgattgtgaagctatggatgtttaagttgacacctctgtcatcgatgtaggtgaaattaattatttggaatacactcgtgatcttgaccggtataagtatttctaaggacgttttcaagacagttagacatcgcgaggagttaacaatgtttgcaatctgcgtcagtactggtccaaccgaatgccggttgctgatacatgtgcatatgcttatccgtttggtgagcaataattcttcagttagagcaacaaaccaaagcagagtctgaagacactgttactatgtcttgacacttatctgagctagcaagtgagcagcttttaattctgaaaggagcaagctatccagttaggacactgcatccatgcatttcgttcttgctgtcacatggtccatttctcatgtcaaatcaaagagatacctcaacgaactgataacgcagaagtccacggctctgaaggcactattcgatcaatgcatgtttgtctatttgtccttgacgaatgcattttgccacctacctttgatgccgagatgtgccgctttgagtcaatgtcaaggtactaacaaaatcacaaccctccatatgtaaatgagctacaatgacctactcatcgtaactgctttgtaaaatgcaaaacataagttactgctatgcgtatgaaggaaacacgaacgaggtacaaatatatgttaaacatggactaaaacttaatggaactagctatatttatcataccacatttttcaaaatatattatcaaatcgtttttacacaataaattacctatatttactacgtaattgcactgtctttttataattacgttttttttagaactacacaatacaacgcagacactcacaacacacacgcaccctcacccttatgaacgcacgcacacaaaccctacccctatgagcatctttgaaggctggaccggtaaatcttggagattgacaaagtcaccacagacgcctcgttgttgacgggtaatacacgctatataaagagaactatggttaaaagtaacaatcgcataggggaagagtgattaagaacaagtaaaaaaaatgtggtgccatatttttaaccaaaactgaaacttgatccctcgcaagacaatgtcaagcaacgaaattaaagatttgcttgacaaaccagatagatgtacaccttggaagtgaatcctctgccattaccgttgtgtagtagatgccgcttataacctaggttgaattatataggatttttcgactcaattgtcttaaaagaccaaaatgaaaaaatgcaacgttataaggggaccttgcctgttgttttctccacaaatggtttatttgtaaaataagttattttggggtttgttttcaaatgtaaataaaagtttgttttttataaaaaaaatccatattcatctactttccaaataaaactacagtggaggattgcactggctttttcccatcctttggccttgttctacttggcttttgccggattttctcatgccgaccacgaagacctggaaaatgtgtggatccctggcgtacactaagctagtaaaatccaacaaggtaagtactgttaacatgttattattgatggttttaatttgcctagacattgataaacccacaatgagcaaagttagagagacttttttttggagtaattagttagagagacttttaactagaggtctcctctgatcatatgtatagagcccatcacgagcatgacaattgtcaaggaagcttcttcgaaaccgatcctccctccatttccagggtcaactaggctcgtccttgtcgtgcacttgaagtcttcaatcactttacaaagagacactatccatgccccaagtgagactacccaaataaacaatgacacccaattaccatgtgatccacggcccataggccccctaggccatacgatcaggatcaacttgccaccgggcaaaaatcaaaaacaaaatgagaggaaaaaaaatactcctacgtgtaacgtgacagaaaaccgtccacacgcctctcctccccattggccctcgaaaaccggaacgggtcaagtccatgacactgtgcgtgcgcgccgcacgagaactggtccatgtctcgcacacgttgttcttctgaacctcttgtgcctcacctaacatttcgtctcgtcagatttgtcactgtgacactgtacatgtgaagtgacttcggctcggcgagagggagacagacaggggcgtatcgttttcgggacgcgctaacttgtccggtgtaccggagagccaagccaacggatggatcgcgtacgaactgacaagcgtaatcgctggagaatttggatcagtgcagatacatctatggattaatttacatgtaataatcgatcactcataatacacgagaaaacgccagctagagaatgggccactcgaagaagagaaaaaaattgaaaaaaaaaagagagcaagaattatgctagtagcaagtggcgacgcatcgatcgatcgccgttgcgttcgcagctacgcaagaattcaatggaggttttagcgtgtcctcctatgtcagggtgttgcagagaccctgtggcttggcgtaggcgtggtcggaggccgcccacatctccgccatgttcgggaagtagcacgccgagagctccaaggtggccttgctgtccggcgccgcgccggcgaagccgctgaacagctcggcgtaagggaacagcggctcgccggccgtgagctcgccgaggaacacgtcgtcgagggacaaggcgtcggacgcccagccgccgtcgccgtccgccgtgacggtggccggtggtggcacgggcgcgaggtcggtcggggatgccgccgccgccgccgcgggtggtgcgtcgaagcggatgaactgctgctgcggcggcgtcgtcggtggcgggtacatggtggtggtggtggtggcggcggcggcgaagcaggcgtcgccgctcgagctggtgacggacgaggaggccggcgagagcgccggcgccatcgctgacgacgtgcattggctcggcgccgaggcggcggcgcgcggctgcacggcgcccatggctttcttcttgagcttggtgttccagtagttcttgacgtcgttgtcagtccggccggggagcttcgacgcgatgatggaccacctggcaacgcacgcaaacagagtcagttcaagaactcagaacaggatcagtgaaagaaaaaagaaatattcatctccggcttaaatcatcacctgcttccaatcgagttgtagagcgagcagatgatgtggtcctcctgctcggtgtagccgccgtgcttgatgtccggcctcaggtagttgagccaccggagcctgcagctcttgccgcagcggttgagccctgaatcacacaagagaacacgcagacatcagaattcacatacaaacatggcgtttcatcaccggctagcatcgacgacgacgagcagtgcactaataccgacctgctttctgcgggagcgcgatccagttgccgccgatgccgtggctctggacgtagctccgcagctgctcgtcctcctccggcgaccacggcccccgcttcacgctcgccttgtcgcagcacggcgcgcgccccattttttttgcacaatcctcctcaccacccgcggcctccctcgcagtcgcagcaaccaaccaagcgatcgatcgatcgatctcgagcagaagacgatatgcgcgtcaccggctcgtgtctactccaagcacagggacggcagcgaccgagaccgaccgatgcaatgcaacccgcgacgggttgatttatagcggccttacgcgacggggagagagagggatggattgcctttcgcggttgggccccagccgccagagcggcacggcgttgcattctctcgtctcgcgaaagggagtttgtagtacaattttgcgccataggccgtgtttatttcccttcaaactttaaaaaattccgtcacatcaaatatttgaatttaaactttaaaaaattccgtcacatcaaatatttgaatacatatatgaagcattaaatatggaaaaaaaccaattgcacagtttgcatgtaaattgcgaaacgaatcttttgagtctaattacgccatgatttgacaatgtgatgctacagtaaacatttgctaatgaaggattaattaaacttaataaattcacctcacagtttatatgtgaaatctgtaatttattttgttattagtctacctttaatactttaaatatatattatgtatgtctgtatacttttaaaaattttttgtcacactaaccaactaaacgtggccatagtaacatcctgcctgcattattcctcctcccctaccgtcgagccgtccctatcgtgtgtgctagctctccattttgtcgtctcgcgtgtgtgcgagtgttatattagccctttcatttatttatcctagtactatttgttttaggatagcagcaattttgcctttgaccagacgagttagccatgctttcacacacgaagaagcctcaacgtgtattgatgatcctgggcagggtcaatccctttgtgttcactgcatatcattgtttccctttggcgttaagtacgtggaaaaggaggtgtcatgcatcggagcacttctctccgtgtttcgattctctcaaaagtgtgcgtccaaacgctagccgaaggagaaaagctgagccggcccggccggaatcggcgaactcatcgtcgtcaatagaaaaatggaagcaaagtttttgccagaatataatgggaaagcctaccagccatcaacaagttgctgcttggctcattggctgcattggcagttgtcaggtttgtcaaactcttgacatatttgtttctgctcgacgccttttccatattattctgacatgctaaagaggggcacattagtttttttttttttgggtgatgctttcggtttcgtcctatgtacgggttgtgtggtccaagcttagagtcgagaagtgtatgcaattatgcaagcatgaatcatcatgagacacaaagagtgattaaacaaactaacaaattataggagttctaaattcgaatgcttttgattagtgtgtctgggacagccttagttttgcggttacgcgagccccatgtttttgacatcaccatcacatggtagtatggcaaaacacactaaactactcgtagggctactctttttttagtctctcctgataagtcccatctttttctttaacttctctaatgacaagtcatgatcagtcataattcaagacgagaggaaattcctcgattgatatggagtgtttgtcgcatcccttatatgccacccagtgacgtcgagataaatctccaaatattaagtgaaaaataatcattctgggtagtgtcatactgtcatcatgtcctcatgggatgaactaatgagctaatgatcagtgcaacaaggaaatgcaaattatatctataaaaaaagcagcaagcaaggaatgcaaactatctatactccttataaaagttataagggagaactcttttttcgaagaaaaaggacatgtggtgttagacgctgcacatatcgaccactcccatgagaaagaaaaaaaagggagagtgtgagactaaaaaaatccacaagtcaggaacaaatatctacatcaattgaattaaaagattataataatagattaatgatattttctttaattaattaaaatcgtgttgcaacatacgggcattctggtagtttctcaaaaaaaaaaggaatgcaaactacggcccacatggaaagctcaaaatgcacgcaaattggtccaaaccggcccaatccagtggcatcgagagaaggaaaaagtacaccgaaggtccctcaacttgtcatcgagttacaaaatcgtcctccaaccgcaaaaccggatacaacgcatcctccaacttacaaaaccagggcaaactaggtccctcggcggttttgacctcagttttttccgacgtagcagctgactcagcgtggaacccacatgtcagcgtggaacccacatgtcaggatgccacgtcatctctctctttcccctcttctctctcagctttcacctcgtctgggtgggcaggccggccgacgggttggggaggaagccgacggggcgaggcgggagaggaggaggttcggcggccggtgggcaggcgggtcggcggcggcaggcaggcgacaggcggagcggaggcggcctccccacgccatggacgacgacggcgatgacggccttgctatccccatcccgctccccgtcggcgccatccgcctccgct

SEQ ID NO: 41109 - DNA, 27634 bp, Oryza sativa
  unsure (1)..(27634): unsure at all n locations
tgtcgctccggtgcccggacccgtcctgctcggtcgccggcgaaacaaacaacaaaactctcgcatatcaaatttggcacgagctctcgcatagccgctgaaaatttacaagcacaaagatactatccggcaatccaggccatagatgacgacgattaatttatgagcagattaagaaccaattaaacagtacacgaagaaacggggagagaattcgaagaacgatgaaagcgaacaagtccctagaccatgcggctagctgggcaagggcgccggcagctggaacggctccggcagccggacctcgcctcctgctgcgatcgaccggctgcagccgaagcagctccagcaagccatcaccccaaccccttcccttccttcccaacccgccggccgacctgcccacccagacgaggagaaacctgagagagaagaggcgacgggcggagcggcagcctcgccgtcgcgtgcctccacgctcgcccacgccgtcgccttcggcctgccctcccgcgtggcagccgccgccgccgcctcctctccgccacgacgctcgcatccgccgccatcgcctctccgccgcagctaccgcctccgccctctccgccacgacactcgcacgcctgctgccgcctctccgccacaacgctggtccgctgccttccccttctctcgtgtctcagccgccacgttgccgccgccgcatcgcccgccggccgtcggacctctcaccctggcaaccccctccccaccgccggccgccctgctgatgacgttgcatcctaacaagtcgagacgaaaggaggggacaggaaaggaagggagaggctggccgacgtggcatcctgacatatggggcccacgtgggttccacgctgagtcagccgccatgtcagctaaaaccgggatcagtatgcactggttttataagttgggggatgcgttgtatccggttttgtggttgggggacgattttgtaactcgatgccaagttgagggaccttcggtgtacttttttcctcgagagaattttgcatcccaaggaaattcaaattcaggcccatatagaaagcccaaatgcaacccaagttcatccaaatcggcccattccaatctaaccgggccggttggtgcggcccacatgacgggatcgccaccggccggccaggctgtagcctctctgaccttcggctcgtcatctccccctttcaccgtgcgctgcttcggtttgctcgggcggagaaaggaagggcagcgtcgcggttgcttgcttcctcccgaatcctcgcctcgatctcgctcgcgggcgggcggagggatcgtgatcgggatcgggatcgggggcgcgcgaagatgagcgtgatcgacatcctcacgcgggtggactccatctgcaagaagtacgacaagtacgacgtcgagaggctcaacggcgccaacgtcgccggcgaggaccccttcgcccgcctctacggctccatcgacgccgacatcaacgaatgcgtcgaggtctggatgcgaattcccttcctcctctctgtctccgcgtccgatttggtggttggctggctcctcccctcgatctgaatctggggggcactttgtttcagaaagcggaggcggcgaagcaggagaagaaccgcgccacggtggtcgcgctcaacgcggagatccggcgaaccaaggccaagctcgtcgaggaggacctgcccaagctgcagcgcctcgcgctgaagaaggttactgatctatacactcccccttcttagtttgggtgaatcatgctagatctgcggatactgtggcccgaggactcggtctctccttgttttagtgtagtactcgtagtagcttccaccttaccgcggatggtggatgtctaaatttaggatgactgtaaggaggctctcgtcgttgaggaagtgatttgcatgggccatttgatgttgatggaatggaatttaggattggtggactatgtttgattttttggggggaaatttggggtttcgactgtctgggactagacttttctaaattttactatgaacgagtcaagacttttcattggattgctagaatgaacactaatcgggtgaaactggggtctagatagtctcacagaggaactcaccacatagtcgtgtggttacacattgtattctgtaattggcgtcaaatatgctgtgcacaatccatatgaggtctcttcatcgtttcagtagcctgtgtttattaaagactagatttatttattttaattaggctattgggtaaaggtgatgcagttgatgttaagccttccaatattttctgttgacccagaacttaatgtactctacattttaacttgacattgccatagtgttaactttgtaagattgttgttcccttgctaaagatttctgtccacgccacctgcatgtttgcactaggcaatgtgatgtccttgacactctttcttcatacatgcctgtgttggttatactatatttttaaaacatgcttttacattattcaattatatgatatctataaattgtacataacagtttttcacctagaattttgaagaattggttttcaatattttgttgcaacttgcaacaggtcaaagggctcacaaaagaggaactcgcgacccgtagtgatctggttgctgccttacccgatagaatacaatcaataccagatggtagttcaagtgcaaagaaaaatgggacttggggcgcctcaggatcccgtactggtggagccattaagtttgacacttctggttagtaagcatcattcaacatatcacatgtgtgttctgtatattgatatacaaaatatgcatattttttttctttaaagatgtgtccaacttctacttcccctacgcatcggttgttctagattgcagtaagctgtacattttgcatttgtcggttcattttataagtatcctgcatgtgtatgaggtcgcgtttccaatttatgaaggaatcctaatattaggttcatgcttccatatgcacatgtgcttttttacgacgtcatttttggtaccgcaccatcatcaatgtcacgtgccaacttctactttttagtacactatgttagtgtatattttgattaggtaactcttgtttctatatcagtatgacagtgttgaaatatacaaccatcagattgacagagttttgatcaaccatgcgtgccatcatgcctaaagttgtttgagcaatggttttctgtttcttttctcatcatttcgggcatgctcctgttggatgctcttgttggtcctcttgaaggagtcatgagctgactgattaaccatgcgtgcagtcatgcctaaagttgtttgagcaatggtttttctgtttcttttctcatcatttcgggcatgatcctgttagatgcttttgttggtcctcttgaaggagccatgagctgacctactttcccgcttgccacatacagatggcaactttgatgatgagtactttaagggaacagaagaatcaaatcagtttcgtcgggaatatgagatgcgcaaaatgaaacaggtaatatattaattccccgaacacgcttttcttccttttcatttttggctactgctggaagtgggatttcttatgtaaggtgacctgtgtatggaattgaaattctgcaggatgaaggtttggatattatcggtgaagggctggaaactctgaaaaacatggcatctgatatgaatgaggttggttgctgtgcttcatcttgagttatacaatactatacgatgcaatggttatatgaaacatagttaccatgctcaatttttgtgatcatcaggaactggataggcaagttcccttgatggatgaaatggacgagaaggttggttctccaatagccatggattcctcttctgcaattgtgcaatatccagcaatgcttagtttatttatctcttatttatatggtgtactgatgaatgtaggtggatagagccaacacagatttgaagaataccaacgtcagactaaaagagaccgttcttcaggtaacacctagcactaacttcccttggcatgcttggttgattgcttgagttaaatacttattcgcttctcctcgtgaactgttatcagctgagatctagtcgcaacttctgcattgatatcgtcctgctctgtgttattcttggtattgcggcttatctttacaagtaagtgtttttgtttccagacaagcttcaataccgaagtaaacaatcttctcgacattctctctttacacgacataagaccattcccacattcttaattatatttcttgcatattttcttttagtcatactagtgaggtagcttgttactatagttgttagaccatttgctaatatttctccacgctttcgtgttgcagtgttctaaaaaagtgagaccggactgtgccatggatctattttccacgtcttccggtgatggatggatgagtttcgacgtgtccacgagctgttccctttatttttatctcatctgtgtaatagtagtatggtgttcttccgggacttgcgaacatccttgttgaaagttgaaacagtgagcattgtgcgtgcgaaaacctgacgtcttctgtacatctgcgagtttaattcttagcaagagcgtatcaaacattctgttatgaactatgtaaaccttctcatgtatattcattgcatcagttctttggttgtgccatcacgttttgtgttttgaagtgttactataacacacatagaaaaaacttctcttcatggaattcattcataagaggatagaaatcgaaccaaaatcaaaggcagttaattcaccaaaatttaccaaacttgttttattactcttccaaaattcatgtgaaatctctccaattctagtatgcgtttgatcctactgttacaatcgcgggagctggatttaccaaaccgtttgagatggccctactgttacaatcgcgggagcaagggaggtgctgggtttaccaaaccgtttaggatggacctattgttacaatcgccggaccgagagaggtgcagggtttaccaaaccgtttggggggtttatagtttgatggttaccgcggtaaccacgtgattatcatgaaaatcacacggttaccagtttaccacaagtgatatcataattttaaaaactgataagattatcgcatgtaataactacgagaatagtacggttttggttttgtaaaccctgggaggcgtactaaaattggggaatctcgtgaagtctctcctccctctcagttttcccgttcgtctccaaacctgcgagaggcggctccctcccgccatcccgatttggcttcccgccccaattcccgccgccgcataaaccctccacaaaagggctcctccgccctcgcctctccctccccatctcgcctcgccgctctccaacccatcgccgcggccgcgcgcgattcctcgcctccgcggcgagcctctcctctcttcctccgcccggcggcgttggcgttggcggcggcggcggcgatgagcgcggtgaacataaccaacgtggcggtgctggacaaccccaccgccttcctcaatcccttccagttcgagatctcctacgagtgcctcatccccctcgacgacggtaaggcctgcctccccttacctcctcctcctcctcctggttccgttggcgcgtggcggcgtgctagggtttcgtgtggttgggggtgttcgttgggtgccgtctcgattcggcgatgctgggctttgggccgtgttggtttcgttgtcgttagcatgtaaagtccggaagttggggagtgatgcatgactctaccatgggttccattttttccaccacaaccagataaattttgtgatgtgggtggtaatatatcatgttgatttcattcatggtgaatgatagcgttttgtgtaattggcaggctaatagcgaatgctgcacacactctagcatgtttcttatgcattggccagcttgacaaatcagaggaatcacttgtttcttttttgttcgaaagaagaagaatgtgggataataactaggaacttagtatgaaattaagagataatcaaaatatttttgcccggcatttaatcataggcgaaactaaggaattacttgtttcttttttcttagaaagaagaatatgtgatactaactaggaactcagcatcaaattgagaaagaagtaaaatatttctgccgagcatttaatcatagtcttgtctctttttccactgagagaagaattatatgggatactaactaggaacttagtatcaaattaagaaagaagtaaaatatttctgctgagcatttaatcataggcaaaatggtgagcaccgagagcagggctcgaacgcaggtcacatggatataaggcaagatctttgccattgagctatgtgccagttctcaaggaaccacttgtttcatttatcatcttttgattcatgaccaaattagtcgatgggttgatgaaagactaatatttctcgtagaaggcaccttgctagttgcttggccacagcttgcagaagtgcgccgagacagaagttgatgctctttgttttgttagcttctcctttgccttagttagggatcagttcaagttgcaaaattaattgtcacggagttctctagtattggtattatgttggatatgttctttgttcctcatggcagtatgttatgatatcgaatctagcctaccagtttatagattgatcttgttagtgtctgttgtcaggatgtttggtgctaccccttttcaatatgcgataatagactagtagtgtagctgacacactttacgcaaatgtcacagacaaatttatgcccatcaattgaatgcgcagtaaaacaacgaattgggaatttttttaagaagaaagacccaagtttctcagattgactccatggtttcagaaaagaggttatcctacatatgtgtaggatgaatgatcccttcagataattggtttttgattggttacaaaccttgtaatttcagttcccatgtttgtttgtaaatatttataaatattttcctaataaagaaaaaactactgggcaaggcctggtagctgactgtgaatttatacttttcctctattgtttttgttgagggcttagtcaattgcagaaaaaaaaatgatattttgcctgtcacaacctggagttttcgtcccannnnnnnnnnnnnnnnnnnnnnnnttcatcgattctggtagattgttctactgtattaactatccttctgcaagacatcatctagtgtcctggtgtgtctgagattctacaacattcgattgagatcattctgtcttgattgtgtgttattggtgttgatcattatcaagggaccttgaagtgttcagagatgtttctcttttgtgcaatgatagacaggaaatgtgctgcttttcttctctagcctctactctattggttctggtttgttgataattgcacaaagtaacatgcgtgttggacagtggcaagatatgctatatgtgcttttaatttgcctatttcatttcttgagggtatgtgatgataaaaaggtttgttgatttaccttttagatctggagtggaagcttatatatgttggatctgctgaagatgaaaattatgaccaacaattagagagtgtgcttgttggccccgtcaatgttgggacctaccgttttgtactccaggtaaatttggttttgctatactaaaatactaatattttgattccaatatctttatagtgcacaatggatccagaaaccctaccacactttcgttccttgtttattttttctgcttcaattaagccttaaactcagattacagaactattaaattttgcatctcaaaattgatgtgccattaccattttaggctgacccaccggatccctcaaagatccgtgaagaagacataatcggcgtcactgtgctgctattgacatgttcctacatgggacaggagttcatgagagtaggttactatgtgaacaatgattatgacgatgagcaactgagggaggaacccccggcaaagcttctaatagacagggtgcagaggaacattctggctgacaagccccgagtcaccaagttcccaatcaacttccatcctgaacccagtacgagcgcagggcagcagcagcaggagccacagacagcttcgccggaaaaccacacaggcggtgaaggaagtaagcccgctgctgatcaatgatcagagtggggatgctaacattttgatgcccgtgccttttaggatatcttgtgatgctgtgagagtggtgattatgcttcttcattctcctaggtttgtcattggtgtctcgtcttttggaaggcaaattgttccctagttcctggtggttgctgaaaactgtatgttctcttgaaatctgccaatctggttaagagtacttgcgcaagttctgtttcatcaaatgctggatgcttcttttgtctagactatagttgttgagtattatgtgtttaggggtatattagtaatttcctatctctattgtactcatatatgccctttgggctaacacaatagcaactgttcattctccaatttcccctaaattgtgacatggtatcagagcaagagcaagggatcaaaccctaacgtcgatccggagtccacgccggcacgccggtggcagctcgccaccggcgagcccatccaatccgtgcacatcctcgtcagcttcgtcgtccaccaccgtcgagccgtcaatcgtggcagccaatcgtttcgtcgttcgtccacaagcagcaagcagatccagtcagcacaagcaacaagcagcatcaagcaatcaaatccacaagcaagcagcggatgcatgaacaagcattcagatccagttcttcgtcaccacgtcagtcgtagccaggccgtactcgtcgcggatcttgtcgtcgcgtctcgccgtggctcgtcgttgtcgccgcattcccattggccggtcgcggcgctctcttcatcgccgccagcgccgtcctcctcccatgtcagtcgtccagctttccgtccgccgcctgcgcgcgtgaccatctgcatcgtcgccgcacaggtcaaggtcctggtcctcttggtctagcctgctctgttctctctgcttctccacatagatgcttggagactggttactggacttaacagcaacaagccatcgtcttccctaatatcaagtagcagcgacagcaatttgcaagtgtcatgcagatccaccttgttccatattcaaacatcaacaaatagcagtagagaagcccatatcgagttatgcttccctcatcatgcagccggcctctgctcttgccggatttgtgaagccatccatagtctcaactatcttgattgttgaattgttccatcaacagatctattttgtgtttgctatgcttgcttactgctgccatcaacaagtcaattaatatcctttggtcttgcaaacatatcattgtgcttcagtttgagataggcaacagaaaaccaaggcacagccctgtgcatgtccttttgattttgatattgcttcttgtcatctgcatcaattgttctcttatgtcttttgctagtatcctaagtcatttgctagtatatcaatgtcatctacaaatcaatttcctatgtttcctatcaagtccatcaaagtccatcggttcgtcgaagtcatgcttgtcaatcattatcactatctcgctcgctccatgtcgaagttagccttctatcatcaccagaagctccacgtcggagctgatctttgtcatatcaccagctccccatcggagttgacatcatcatcaatcattgaagggccgaagaacagtttgtgaaggtccttcatctcgtcatcatcaccgtctctgaatcagtgaagagccaaagaacagtttgtgaaggcttttggtactaagggctgaagaacagtttgtgaaggctcgaggtctacttcattgaggataggatggttttctcttcttctaattcattcaagagcaatgcttcgacaacatcttcaaacatggactttgtatttatagtagtgtgtcatttatcttgtgtttagtttcaaatgcaatgctattgtatacacattgcatttgagcaggggtgttgagtattatgtgtttaggggtatattagtaatttcctatctctattgtactcatatatgccctttgggctaacacaatagcaactgttcattctccaatttcccctaaattgtgacaatagggtatgatccggaaacaataggccaagagaacccattattagtcatgggtcctgtgtttgtggtctagattactgtaactaaccggaatccttttgcgcacttctgcaagttaaatggtatgatccgtaagcgggatgcttgttcagcctcaattttcatgatttggcttgcgaaatgagatagttctgaatgtctgatgcagtgtaacagctgatgtattgtggtgtctgaaatcagatgctacattagtatatcctgtgtatttggtgtatctacttgtgccggtggtctttgaatcgagtgtctgtttagttcctagcaactgcagcttctcacaaaagcttcagtttccctaaacagtccataaacagtccatattattacctagtagattctaaaaatctatggctgtagaatttaaaaagtaaactagaaaccatattttgaaaaagcctagcttctctaaatctcagattcttagaattttaagttctcataaacaagtctaagctgtgtggcaccagcattcgaagtctcacaccatggtctctttgtctggagaagtgaaaaaggttcggtgtttcgcccgcctgcgccgctaccttatccggttatcgctataaataaaccatctgaagcatgaggcgattctgacgctgcgttggtttggatcggcacgcctgctcggacgcggtagcaatgccgatcacgctgccgcagtgagtcagcgcgcgcactcgcatgccgtcttttcggcaaaccgacgtcttggcgacagcgaccatcggctgcaggctgtttcctcgagaattcctgatggcaccgccggtggatgcaggcttctgcattgccgcatcagacattcagatctgccaaatttgtcacataggttttcagttttctatagatctttgaacttcaaattgcgtgtgctgtaactcacagtagaaccctgcaaaaaacattgccatatgcatatagtcgacgccgaactactactacttgagttctctctgtcctcacatataaaaatcgacagcatcttcagctggttccatgaagaagacgacgcataatgtgttgcataattgcaagaagccatgagcaggcactgtacaaatcccagtgtgttacaggttggaaagctttggcctgtagtctgtagcagagcccctagttttcctctcccgggccaagacatccactgcacacagatcaacaagcgatgtgacggtgaagtgataacaggaggccggaaaaggcaagaacttttgattaactgacggaagtgccaatccaaaagaggacccggcaaacatctctgccagtatcgcctgtacttgttcactgatccactgtagctgttctattcgattcgattcagattttattataaactcctccatgattcgtgatgcatatcattgcgtggggtattttccgtgctactctgtctgtctcagtgcagagtatttggtttagctgtcagaggatcatcatagtgtgttaagcttcggttgttaacgtgggtactctggtgccgggacagaacgaccaccatgtcagctgggtggggtgggtacatactagcacatagagactgaatcagtttgatcttttctagtagcctgtttataattatcttggcaagaatgcaatatactatgaagagatgtatgctaggaaaacaccaccagggtagggtggtagagttctttttttcttttgaaggaaaggtgaaaactttgacattttcaatggtaaacaatgtatccgtcgttagcgatgtgtccgtaataacttcatcaatctcaaagatatgctaggtgtaggatatgtgtatgtacgtttataaaaaacatatgtgcgcttgtactgtgtttctaaaaaataaaaagcctcaacaagattcgctcaccaatgctaacatgcctttcttgaattggaggattttcatagtatttatagaggattcaatttcttgggatttttattcctatggtatacttcggattgaaacaatggaactttgaatatcctatgaatttggttgtttcaattccaaagaaaaataagtatgagctcaaactcttgtatgcattatattcctttctctatctagtctctcccctatccaaacaaatttcctgaaaagtttatattcctatgtttgattcgtattctcgtgacctaaaattctgcagacaagagcatagcattctattagtatgtttttttctttctctgttttataaatcttactctctttatttatgttttataaaccttactctcttcgtttcagattataagttgttttgactttggttacaatcaaaccgctttaaatttatctaagtttgtagaaaaaagtagtaacattttcaacccaatacaaataaactatgaaaatgtatttaattatagatttaataaaattaatctagtgttataaatattattatattgtttatacaaacttaattaaatttaaagtaatttgatttagagtaaagtaaaaataatttataatataaaacagagcgagtatttcaaagcattcctaaaatattcacagtgtagttgttttatttagccagtatttttttttgagggggggatgctcactcgtataaaactttgcattctacttttaacccgcagtataaaattaggacgccacatttgacactttgacataacaaccttcccataactcctgttttaacccgccgctgatcgcgagagtcctttcccattaaaacccccccgcccaccagcgccgagacacagacaccaaagccgtctctgagaagaagagagggagagagagagagagagagagagctcggtcggtggaggcgacgacgacgacgcgcgcactgcggccgccatggaggagagaatacctctgctctcgaaacgattcccggcggacggcaccgccggagtgggaggagggagggaggaggagggcggagataggtggtggagcgggctggcgcgggaggcaggaaaggtggggtccatggcgctgcccatggccgcgatgagcgtggcgcagaacgccgtgcaggtggcgtccaacatgatggtggggcacctccccggcgtcctcccgctctccgcctccgccatcgccacctccctcgccagcgtctccggcttcagcctcctcgtacgtcgtcatcgcatatcctgatttccccactcgttcacgcgtcctcgatttgcttatatccatatttgttgcctgcgtgatttggtctcattggattaactgtttagcactttagccagagaggcacgtttcacggtttcagatattgttcaatgtggcgttcaaatttagcagtaggaggacaggcaaaaagtttagccgtacaagcggctggttagtttggaagggggattttgattggaacagtgcctaaaatttttgctggaatactgtttgaacatttggcgtgttccaaacattctgaaataaatcatggatatagcatagtaagtagcagattttttttttttgggtatacaagtagcagtttgcaaacctacaaaatttaaaatcaacgttctcctaaatatagagataaataacaagttacactactagtctactactccacgctgaatgcttttctaggatgaattttaaattgcctgcacagatggtgagctagtcaattgtcacgatttcaactagctttcagaatctgcgaagtgtgtacagcctagaggactacttcgatactctggcgaaatattctgtaggattttttttttttacttttctcttcagttgtacacggattgcctttttagtttgtgatcttaattttgaaaccacccataatttgaattttgaacttgtaaaacaggttggaatggcaagtggattagaaactctctgcggtcaagcttatggggcaaaacagtatgacaagttaggagtgcaaacctacagagcaatagtcacactaacagtagtcacaattcccatctcacttctatgggtattcataggcaaactcttgaccctaataggtcaggaccccgtgatctcacatgaagctggaagatacatagtgtggttgattccaggactcttcgcatacgcggtctgccagcctctcacaaaatttctgcagtctcagagtctaatatttcccatgctctggtcctccattgcaactctgctcctgcacatccctctgtcttggctgttggtgttcaagaccagcatgggatttactggagctgctttagcaattagcatatcttactggttgaatacattcatgctcgctgcatacatcagattctcatgttcttgtaaggtgactcgctcgcctcctacaatcgaggcattcagaggagtcggtttgtttctgcgaatagcactaccatctgcactaatgttatggtaattacagtagcttcagaatctccttgttttatatgtaagtatttcttatttcctgttaaaaaattcccacttattggattaatggattttcttctattattttgtagttttgaatggtggtcatttgagatccttgttctcctgtcaggacttctacccaacccagagcttgaaagttcagttctttccatatggtaagaaaataagagtcctcaatgtcgcacttaacaatatattctcttatagctgcaccttttgttattttataagcactccatttatgcagcttgacgactacctctttgatgtatactataccatatggtcttggaggcgctgcaaggtagaagccaaaccactactgtgaatgattattttttctcagagaataatcatgtgttaacagccttgtgaattttgttttaatgaacagcactcgagtagcaaatgagttaggcgctgggaatcctgaaggagctcgatcggctgttcaccttgtaatgtctattgctgggacagaggcagttcttgttactgggatgctgtttgcagcacagcgcatcttgggctatgcttacagcagtgatgaggaggttgtcacatatttcacctcaatggttccttttgtgtgcatctcagttgctgctgatagcctacaaggagttttatcaggttacatttcctaacatttgatttatctgttaattattcattcccttcaaaagaatggaaaaaatggagtattcagctatgcctgaagttttcgaaaatttgatctaactggccttgcctctctcttatttcattttttttatataactggttcttatagttttggggccattacatttacaccattcagtatctttagcctgttagcccaacggtatcttttaccccttagtttgattgcttaattcaatgtgtgcgctgttgtcaaatctctaccaagacctcaggtagcaagttaatttcagtcactccggtatcgtaaagacataccaggtaacttgccgcttcttgtttttcctttgttcaatgaaactaatgctattttgtgttgtggaggccgacattgttactcggggagttacctgtttgttccttcaaacatgtgctcttacgtgaacatggatatggtggtgtttacaatcaacacgcatctatcagcgatgtcgtcttaagtgtggactccacttcactaagtatgcaattacacctttcccctggctagtggtagactggtagtgtggcactggtgtttgcttcacaggtctatttcattgtttgtgcttctgagcagttgtggacatgccaaaaacaatgaactgaacttgcgaaaacacacatctcattcagctccagcacggaaacatactattgtttctcctctctagaagattatatcaagatagatgcaccacacgtcattgcttaacactgacagatattacttgttatcaggtattgctcggggttgcggatggcagcacctgggagcctatgtaaacctcggttcattctacctggttggcattccggtagccctacttcttggctttggtttcaagatggaaggcaaagggctttggctgggcatcgcctgtggttccgtattacaattcttgcttctcgccgtcattgcattcttcagcaactggcaaaagatggtttgtttctttatctgaaactccaagccttctccccaacatcatcaaatcttgatcactcgaaaactgaatcatgtttctcccgcctactgacctgatgctgcttctgcaggccgagaaagcgagggagagaattttcggcgagacaccgtcagagaagcaacatttggtgcttgatgcaacgaattcggtctgattctgcatcctgatccgttgacgcgaactgaagcggatgatcggatcatgtggaggagactggctcctctggatgtgtagggaatctgctgaagaagtaaagcagtgtgcatagttgtactgttgcatttgttggatccgggagaatgtatcaagaactctatgtgaaatgtatgatggcgatatgtatgtacgagatcgaggttccgaatacttccagcctatagaagtatagataaattttccactcttcgtggacagaaagaataaaaggctaatcttctctcggaaaatgaggctaacctcttctgaatgacttatcataacttcgccaaataccaaaaaaggctttttttttttacatcatacagcgtaattacatatttacatgtaattgatgcatgatcaggcattccaaggatcacactccttttggcaaattatcttgatgtttattaccattagcagactattgctttggagatatttaaccatttgccacatttagatgtggcaattaactttttgccattggacccacatgtcatagacacgtgtggatccacatgtcattgagataggggtggcaaatagttatttgctaaatctaaaagtggcaaatagttaaaagccccgttgctttgtccccagtaacaagattaaatcatctgtaagttaaattaatcgaagaggaaactttcgtttcaccttgaaatgcatgtgccctctcagaccatggcgtctttgctagttcctcggtctccttcagggcttgttcgattaatccccaagatagttcctttgccttcttcatgacttgggcctggtttagttccaaactttttcttcaaacttccaacttttccatcacatcaaaatttacctacacacacaaactttcaactttttcatcacatcggtccaattttaatcaaacatctaattttgaagtgaactaaacacacccttgttcggttaatccccaggagggagggtgatactgatgatcaagtcagtagactgctatctgcttggagcagcaaacttcttcaggaattcgcctcttcatgcattctgcagcccattgtgaaagtgaaagccacacggcagctgccactcttagccgacctggcgtgacaatttcttctctttgcttttggctcatggctagagttcactacacaaaagacattagacactcctactacccccccgcaaaaaaaaaaaaaagacactcctactacccacaccctttttatttagacattacacactcctactacccacaccctttttatttgagaaatttgaggattcagcatacagccctacagggatcagtcattgtcattttaggggttcctgaattccatacttgaaaatatagtccacaacattcatcagttcactatatggtagtttcaaaaaagaaacacataaatggattatctatgtccatatgacccatatcataccgtcatgtgaggtcatttcacaaatgcagaggataaaaacttgaacgccacagcgtgcatctagctcagtagcttcagtaacattacaaaaatgagatacatatacagccggtgaagccaaccaaaaaagatagtactccaggctcaaggtcacactccagctctgcaccctgttgatctcatttttcaacagaaattattccatgtttcttgttagtgacagagaattcatcgaccgaacaagaaacacatgatggcaccatcggattggccagtgtgttgtaagatcattgggctttcaaaatgccaattgacaggatattaacactggcaccccaatccgcatcaaccatcaaaccatgagaaagcacagttaaaaactgtgaacagaacctgcactcggcaaagacagcagattcaaaacttgcacacgtgcactaaaattacacgaagaatgcagcacaaggttaacttccaagtagtgcatagaagtatatgccagcaaaaacaaaaaatcagtctggcaacttcccgataaaattccctaatgcatttactgacaagtgacaactgacccaagaggttatattaactcaatttcctaaacgcctcttcggcatgacataataacaacttcacagctttacaaaatagctattttcaaacccaatgcttctcctgcatgacagattcgcaatttcaaaagtttacaagaccactttcacatcctaattcgtactaactccgtcccaaaatataggggattttgcgcatgtaactatcggggattttgcccaaaatatattttgggacaaaggtactacagtacatcattcttgcatgtaactgatgcacatttacagcattctgaggacatttcacaaagtaaatctccgattattactatacatcatcgatttatccacagtaaccatgtcaatcattcgtgcatttaagttgaatctaaaatcgaagaggaaatctgcatctaaccttgaaaattgaaatgaggatgctgatcagtccatgacgaccttggcaccaacagccttcatcttatcgatgattgtccgagcctcctccttcgagacaccacccttgatcacagcgggtgccttctccactagctccttcgcctccttcagacccaggtcggtgaatgaccggatctccttgatcaccttgatcttgctcgccgcatcgaacgcctccaagcgcagctcgaacaccgtcttctcagccgccgccgccccaccggccttctccccggcggcgcccgcggcacccgcgccgccgccgccgccgaggcccgcggcggagttgaggatggcgatggggggagcggggacgtcgaggcggcggaggaggagggcggagagagcggcggactcggcgagggtgagggaggagacgtcctcgacgaggcgccagacgcggtcggagggcggtgggcgggacggggcggtggggtcgaaggtggaggcgtcgtagtcagtggggagcttgcggacgtcgatgagctcctccgcggcggcggcggagaaggaggcccaggagaggctgccgtggcggaggaggcggaggcggtggccggagcggaggagcgaggcggccatggcggcgaccggcgaggctagggttctctggtgtcagtgtgttcgacgcggtgcgggagctgaggttttggactgaagaggcctcgtttttagaaatttcagatctgaagaagcccactttggcccagaaagggcccatttatatatcttttgatgggctgggcggctactctgcaagctaaaaaaaactgaatgccattttggtgtacaaattatttcactcttgtcttctcaaagtaaaaagttggcgaataatagtttgagataaaactgaagataacattgtgctggaagtgaaaataataataataataatgtattaataaacgtttggatcgtgctacactgataggaagatgaacaatgctcattgtcggatcaatcacgacagttgcaaatccctggggaaagaatcaacatatcagtcatcgatttgacaaaaatatcatcgcagctcattctggattaaagtttaaacactactacagcagtggcaccaacatttgtgctgtgtcatgactcagcaatcagtcggaaaaaatcatgtatcagctgctatccctctgaatgaacaccttgttgattgaacacacctcatatctgaaccactaaatccatctgcctatcgatttcaaacagactccacgagcagtgccaaccaaatttggatagacagatacgacatcaaacggctgagatcacgatccaaatgctaaaccactggctgatccatccaaatccgctaaaaaccttcaaataattgtcatcatcctcagaaaaaaaataagatacggtgggacaatcggggttccaaggaatcttcttccactgtagcatcgatagcacccacctcgtggtccatttccagccgcgatttggtcccgatcgatcacgctgtcgaccggtgagagcgtgcaatggatctccgaaccaaccaaccatatgcaaatcaggttccttgcttgcattatcagctcatcgccacaattccaattccatttcatgcataaggtacgcgtggtccaattaatccccgattcatgcgctgtatgcaaatcacatctaagagcattcccaacccaatgactaagatgatgtctatagcattaaataagttgccacataggaaaaaaaataatgtgacaagtgaataaatgaggaaagataagtaaaccatgtcttgcatgagacatggtttctacacaacatccaagatatcatgtgagataagtagcattaaattgaagtatataatagtggtgtttgcattggaatagtagtgtctagtactagtttttttttatgatgtggagtttatggaaaccatgtctattgttatggattaggactgtcctaagtctggtttctttaagtttttgcagctcggggcccgaggagaggattgccaggtttgacctttgggaagcttaacaatggtagatgctgatgagatatggctaatcatctcgatctgtttagtaatctagggttggttcattgctggatggcactttggtacaggaggagaagaagaatcttttggaagaatcggatgccaaagcatagaggaatatactgctgcgagatttttattacagtactacatgtgttgccgaaggattgggattggagcctttttgtgacgtgttcgtgtttggtgtggtttatcacatctgtctgcttgatctactctctttataaacattagcaatttcagcatttggaatctattcataaatataagtatttctaagtgcaaatcaagtttctattcataaaccaaggacgggaaggagtagcgatgtagtagtagagtcgtgaaaacaatatcctgtgtttgagaggagggaaaagcagtagattaaggtcatatttgattcagcttagatattataatctagattattaggagtaagctgaaacaaacaagcagattattatactagattactataatctataatctcctctagaggagctttttctagattattgagtggctaaagatccactaccattaaatgtctctaataatgcagagaaacaaacaactcgtagattattttatatcagcttattataatccagtttagagtaatctgacttaataatctagattacaataattttaaactgaaacaaacaggacctaaaaatatttaggtgagcgattattgttgattaattgaaagtatagtcattttaaatttaaaaacaggttaatgtatttcttttaaaaaataacttatctatattttaaaaacacaacatttaacaactaaggaaacatgcgcgtggaaaacagtcgctttccgttattctctcattctaacgaacgcacgaacactctcagtaatagtgagatcaatgaatcgtatatgtgcatctttcgtgtgcgcgcacccaaaaaaaaaaaaaactctgtaccacgtacagtcaacttgcatatcgcgaacagggaactcgccccgtaaggtgagtccgttcagtgtaccctcgccgccgtatcagcagcagcagcacatcgtcctcctcgtccattcgtccgtcctgttacgctgatttccgctgcgagcgccggtgatgaggtgacgacggtgtgacaccatttgactcaaacagcctctcctcgggcctcgtgccggtcaaatggcacggccggctccaagccggacatgccgccccgcccgcccgcgccacccgtggccgtcgcctgcgtcgcgcgggcttgggcgcgacgcccaagccaacacgtgccgatcgggacaggggccgcacgtacggcccggatcgctccggacgcggatcgtacagccagcgccgcggttgtcgccaccaccgtgtcctcctctccttatctgctagtactacgactacccgcggctaaccgagaaaacgaacaagcggaatcgaacaaattgagctcaccgtcgtcatagtagcttttacctaacgcttactctatttttttttcttctttaacaaggaccccatggcaattgcagtgtaggtagactggtgccgtcatttatccctgcccatgtatctagaccggatcgtttctacaaacaaatggtgtgctagatacggtcgaaaatgatcaaaaaaaaaaagagatacggtcgaaacctgcttaaattcggcaactgtttgctaaaaaatctgttcggcatgccgtatatgagtatttggtgcattttgggcgaatttttttcaaaaaatgtaaatgaaactcacgtgacatgcaccatcggagatacgcaaggagtttacatatttttttgtatgcattaattcggttctctaatatattttctacaaatttctttcttccaattttagtgctccctcaaaccgttcagttcatcgagtttaatgagatatctgaaatttatcttctcactagggctcatatttaaacaagatcaatttaacttataaacatttgggagtgttcggcaggccagctgccacagctgcggctgcgcacagcgaggatggcactgttcatgccggctacgccgcagccacaaaaataatagccgaacaggtcttttatattcaatataaacatttaaaggatatgaagctttgctaaacagagcaattataagccgccataatgcagaagctaccacaccaagacatccgtgtgtcaccagccacgtgacacggcgatgaatgggattttggatacaagacgcaaaaatacaacaaaggtagttggaactcggcgacgaaatccaccgtaccccgggttttgccagcccaggaacccccgcccgggaccctctgccagccagccccgttacaggtgcggtggccacccgcccacacgacggaccagcccaacaacgccgcggcgcctgcgcctcctctcggtctcgcggagtcggtggcgccgcggccgctgcggcgttgggcggcgcgcgcgcccccgaaggccgaagcgttacgtggaggccgcacgcacgccgaccccccctcccctcgtctccgtcgtcgtcatcatccactctcctctcccctggttttaaagaagacgagaccgccacttcttcgtctcatccaacccaagtacccaacccgcgtcgtcatcgtcgtcttcctacttcctcctcctccccaccccacgcacgcgcgtgcggcgccgatcgcggccgacgccgagatttccgcgtgcgcgtggagatagggcacacccgttctctctctccctctctcgggctctgaagtaatccttcgcttctgcttctttcttcttctgcatgtcctgtctgtccccctcgtctcgtctcgtctcgtctcgtctcttgctttcgcctctcctgacctgaccgcgacaatccgtggtggttatatcgcgcaggcgcttcgcttggtttggcgtgttgtttggctgccgcggcagttttctcctgtcacatatcgcagagggttctggaagtgggaacatggaggcgaagcagaggacgaggcatcgcgacggagaggagaggaggctcgtagcggcggcggatggcggcgccgaggagtacgacccatggacggcgtggctctacaagccgcacaccatctcggtgctcctcgtcggtgcttgccttctaatgtaagtgctcttccacgattaaatttcacaaattcgtttttatttttttttctcgctttgctgcctctgcctgtgacttaagggctaaggctgtaaatttcttggtgggagaactggaaaaaaaggccttgttgtgttggggcaaagtacaattcaacagatgccagggcttctgcctatcaggtgcatcaacagtgtcagagttgaaagcagggcatgtagtactcattgtgatttttttactttctctgaaagaaaaaggtgaaatttttgggtcgggaaatttagtgattttgtgccagcaagttgaggtttctgaatgattgaacgaacatgaaagcatggcagtctggttcagcaaggctagcaaacaaccgagcgtacgagtggctgaggagaatcggaatcatgttcaagaatctcgtgcgaaagcttccctagaacaatcattttttcccatatcatttttagcaggtgcaaattacatgggaagtacattcctctcgtcccttttttttaactgtagaaacggctcaccaagaactttattgttgctattgcttcatgaaaggattaagcatataactttgtgtctgaaacaaccattagctaggctaggctgttgagtggttggttgtgaacttgctggggcgttctccttttcactttctcgtggtgctgtctgatttcatgttcaatcatgttcccgtttcagttgggcaagtggagcgcttgatccagagggtgcttcttatcacagtagtgcgacatctattaagaggtaatgaccgaaaaccttttttttttactttactggaaagtgatgcaatcatctaagggaactctggttacttctctactttgattgtgtcttttggacttgagctgttctcctctcaccactgcacaatgattgggagagagtgacactgactcatattttctcactgacactctccaggggtgtctgggctatgattgcagtcttccttgcttactgcactctccaagcaccttcaacgtgagttagcccccctcttcttatatgtatttcaaacattggaactatgttagtgcagtggctgtcgttgtcaggcatttttctttaagtagggaaattgaaggttttctgcttcaaagaggtgacccacgtgttactgtatgagtgagaccatatagtggccaattctcttgaaagtgtagggcttattattcgtcaggttgtttttaatggtgacacaaaaattaccttgagggacccaataccaatgccattctcatgctgtttttgtacttgctacttttgtcttctttatctccttgggttcataacaatttgagaacctgtaaatctactgtgcatctctaatatttttgcatgatgatgattcaatgttctggcaatattgtcacaggatacttattaggccccatcctgctgtctggcgcctggtgcacggactggctgtcgtttaccttgtcgctctagcctttcttcttttccaggttagttgttactattgaaaaattcatacatcgataaagtaggacaaaaaatgccctttcaataatatcccatgcacgtaaaatgttagaaaatggcgggagatgtctattattcatagggttattttgggaagttcttacaggagcgtgaagtggcaagtatttgtgaaagaaaaaacttgagatccaagcaaatgcaaattgtcttgtcaaaaaaaaaagttggaagtcttgtatccaaactatttgattatcaaaattcagtataaatggcattttttcaagactcttgagcgaggggcctcaactacgtagagatatgctacatcttggatatcttgtactgtaataattcttatttctttctcgttttccagaaccgcgatgatgctcgccagttcatgaaacacctttaccctgatcttggagttggtaatatctttacatcgaaaggatttacactggaaattaaatattgtagaagaaatggtgctgacaaacatttctgtacactaatgcagaattgccggagagatcttatggagctgactgccgtctgtatgttccggaaaaccctaaaaacaagttcataaatatttatgtatgatttttcatttgaaccttcctatttcatgctctggtttttgttattattgtagttattatcattgttattaccccatcatatttgacggtttgatatacatataggagacattatttgacgaatttgtggttgcccatattttgggttggtggggtaaagccgtaatgatacgaaaccagcttcttctttgggtcctctcgattggtttcgagctaatggaggttagatatggttactcaaccttttgttatcttttacttgttatctctaacaaggtattgtgcttattatgaccttttgcagcttacattcagacatatgttgccaaactttaatgagtgctggtgggatagtattattttggatatcttgatctgcaactggtttggtaggacaatcggagacagctgactttcatgttgtatacattcagtgacattgatgatacattttttacatctaaagttattagtaaaacaaagttaggcagattaaaataatatagtgtttttgggtttgcatattttatacagtttgtttggatctaactcttatcaactgaacatgataatatagaaaatgaatagcgatgtgatgtatctgagagttttaagaagaaaacttagacctgatgcacatgcatactgctgacattaaacacttactgtttatgaagtaatataatttatcttcttctatcagttcatgggttgaaagcaatctttctatttcagtaaccagttattgaaagagtacctgcatatgcacgttagggtcaaaagtgacaagtaaatgtgaatggaggaagaacaaatctgccatataagcctcactcttagcagtaggctatggagtgttttatgtgttcagcttcatctaaatattttggctgaaatgctaatattcttattcaggtatatgggcggggatgcacacagtccgttactttgacggtaaaacatatgagtgggttggactgagccgacagccaagcatcatgggcaaggtatgttaccaaacaaacaaattgtttcttatttgcaaataggttagtacctttttttaggactgttcttttaatcttcattcatcatggcccttaggcctagattttttttttgtacctgctgaattttcctgggctattgtgctttttgtaagaatttcctcatcgattctttcttgagttacgacttacaagagcctcttgctactgcttagtccatgggagc

SEQ ID NO: 41110 - DNA, 8770 bp, Oryza sativa
tgcggttcgttcaagtgttgttcctgtgcgttgttttcatgacagtggagctcaacacattttttcttaaattttgcctctggattcctccaaggaatcctttggttgtgtacagattaatcctatggtggttgattgctattccaaccatccgtgagtacaactcctacttgcaaaacaggttatcccaatttccctgcacgcccaatagcattgcacattttttacaattttacttaatggcttgctaatatatattttttcatggtcacaccagcaaaccggtgaagaaggttggggctttttgctggctctctctagctatatgcattgtagagcttcttatatgtatgaagtttggacatggtgagttactctcttctgacatcatcatcacttgtgaaataattgatctgatttgaaaaattaccttatggtcgcttgattttctcgtgatatatactactccctccggttctataataattaacgttttggacaaagttaaggtcaaacttttataactttgaccatcaataactttaaaaatatttagtttaaagaaactagaacaacatatatagatttgtctttcaaaacactataataaaagtaaacatgtatttatttattgtatatattataatagaaaaataagatcaaaggtatattttgtagaccgtgtcattgtctaaaacatcaattaaaatgaaaccggagggagtagtatatatttggaacattaaatgttaagagtgcctaacttttttgtaatctggatagggctgtttcatgatcccatgcctacttggttgatcatcttttggagttcggtgggggtagcactagtggttttcttgcttgcatggtcttggaggaatcacctgaaatatcagagaaagcggctataatggattaatttttcggaagattttcgactctggacccccttcaaacttgtttcttcttcttgataggatgtacatatgtgatgggtgatgatgtaacttaaatgtgatgggtaattatgtaactttaaatcctaggataaagcaattttcagctacatttcacattatgttttacaatagccaattgttgcctcgcaagagggatggctaatttcagattaataagtgaaatattaccatgacgtgattttgctcctgtgatttttatcgactctttccgtttcatatcaataagttattttaacttttttcaagttaaaacacaagtttaactacattatttataaagaaatatagcaatatttttaacacaaaacaaacatattaaaaaaatatattaaatattagctttaataaaaatgttatagatattattcaatatttgaatatgcttggatatttttcaagtaaaagccggaatttatatttcattataaaaaatctaaaacatacaaaagcgggggtgctacctgatctttccctgttttaccttttttccatcggtttcttttccttggtcgaatctaaagtagtgaaaaaactaaagtttttcaccaccacaatgcgccacgtcaccagaaaaacatggaccgtccgattcttcgttccgtggttagcaaccgtccgatctcaatagataaaatatcaagattcctttaagaagttgctttttaaaaaataggcccttccacgtccctgccctattggggaaagaataatttcctttcgttctactcgcgtccggagaggcggatagtcggagacagcgcgcgtccccctcgccgccgcgtcctcctcaagtctccggtgccatctctccgtgcctcctcccatcgttgctgccaccgcgtctcctcccaatcccctccgtctcctccccattcacagattgcggcacaccactaggtataaagagatcacagcatcaccggtcagcccatcccaaatccggccagcgctaacccctcgtcgccagccatcacaaagaggcgccctggttccacgcggcggtggcggcggcgaaagccatgaaactcaaatggaaccattgaggtcagtgccatgtagactcacagcagtggcggcggctgcccatggagctcgatggggtcgtagtagtggtccgtgtagatgcggctgtggcccatgtagagcatgctccggcgaccccatagatgcttaggccttctagctgtgcgccaccacatccttattcttctctctgcagaggccatgtcaggattgctccaagcatgcatgccaggatcttcgctatgctttggccgatgcacacaaggtgctcgatgaaaagtttacttgagattggtctgctatttgatcagtccgtgggaactccccagctagctagctagctagcttaaacttgcgattaatttaactcaagcaatgaagcgaataagcgatgcattcatccgtcagttgatgatggcttttggtatgtagcttttgaacttaatgtgctttggttttatggctgtgtttagttcaacgctaaaattgaaagtaaaaattagaacgatgtgatggaaaagttgaaagtttgtgtgtgtagaaaagttcgatatgacggaaaagttggaagtttaaagaaaaagttggaatctaaacaagacctatattatatttttgttctcttctgttggtgtgtcctaacattattgtcttccctcattaactaaataattaatactggagtatcattttaaataagagaatagtgatgaacacttatcaattatggtctagaaggagaaggcactgaaattttctgtaactgatatacatcttcaaggaagaagcaccaaccttttctacgattgataaaacgtatgattgtttgtcacatgataaagtaactcacagaatgccaatttacctattttactacattgtcagattccatatgcgcatgtacagcatcacaatgattcatttgatgctcatattcggttttagaaatattggtaaattttcttttagaataactcctatgactctaattggtctttatatttcacatatttcattttgctgctgaaagctagattgaattgaagagctgcaaatacagaaatccgtatggatatacatcggatttgtttactcttttatcatactccaaacccaacctaattcatttttgttaactctgcgaagtgcacatggtaggataacttaggttcatacacttttgaagtcagaaatattttgtacatcactttgttagattttactactctctgtcagtatatgagtcagttcctctcatcaccaagcagagatgatttataggtattgtttccaatttcgtactgataacagtacttgcgattattacttaagataggcgagagagatacttccaacctatgcagcggtggttctaacaattatttattaagttctatggtattgtcaattttcaaatttaaagtagaatttcataccatatattttgactcatgtatacaaggttttcatacgggtatttaatgtcgcgcaacgtgcgactaagtggctagtccagctgtgacggggaatcacggtcgtattccagcacgaatcttaacttcaatcgaacggcccacatcgacgcaatgtcaggagggccaaccggccaagcccaacttcccccaaaagccctaacgaaataaacccttccgcccccgccgccgccgccgccgcctcgccgcggctcgcatccctcttcctctccctctcttcttcgccggcgcgacgcgacgaggcggtagctgcctgccatgccgaggagaggtggagcggcgaagaagccggcgggcggcggcgagctgtcccgcttcctgcagtcgcacctccagaccatcaacgacaccttccaggtttggcacccgagtctctctatcccgatggggtcatagcacggctctaagcctccaatcccacggtaactcacggcgcggcggcgtgcttatttactttgggttctcagatgatggcggaggcggctcccggcggcttggagcggacggagtggtctgaggtcgtcaagctcggcgagcaagtctccaggcaggccactgttggtaggtctaagaacgaacgatttctctccccacgtttcgtgcgctcagttgatcggactatacacctacttaatttagcgtcggtaggtttagattgtttaatttcagcggaaagaatcgcttggatagaaaaaactgttggggaaatcaaggtgttagtttattattccgcccaattaagcttggcaaggaattaatgtagcagcattaggttatagttcagctgctgtatatcatcatatagcagggaaatgttatttgcattggccatttgtttctttctagtggttagggtagcaaatgcaatatccaaccaatgtggtgtcgcgatatactgataccgtttctgtgatgatgtaaccttagctttgtcactgttcgctgatgtctgtttttcaatacagctggaatggtctggagtggtgatttgcctgatgtagaaacactcaaggagaacatcgtcgcatatttcaacatcctgcagggtttccttttgggttgccacggcagcacagttggcgcaggacccacacttcacaaatccatctgtagctctgcaaagaatgttgttgactccagcttctcattgttcaatcaagctgtttctgcttatggtaagtaaaaacctttctcaaggatcttcctttgtctgaagctcccttttgtcttcgtaactattaggagtagataactaaatagtcattcagaattaactaatgtatgcggacaaccctcataactaaatttgatgatctaatttccttacgactaaagtgagaaggacaaatttaccattttctgctttttattttccttatggtggtcacgatgtaatgcataagtggataagcagtaagaaacctgaatagtaatgcagtatgcaagaggatgttactagcattcacagcttttttgtgacgtgcagaatcacgcagtcctgaccggaaaacaactatacctcaggtgacaggaactgtatgggaagcatgtcttgctctcaacaaggtaccaacaaccaactgtgttgccataggacgagccatgactcagataggtgtgtatctgaaggatattctccgagagatgaaagaactaccaattggtgattctaatggcactgctgaaaaatcttctaatggagctgtggacaccacaagttgttctgatagagatggatcgtcaagtgaccttgagttagatgaggacttcactgaagaggaggttgctgttgccaaattggttgtcactgtggcttccgatgcgcttgttgtggtgaaagaaacaattcgtttcattacttgtttgcttaagatctcaggtaaccgaagtggagctaatgaggaaaaagttgagacaatggaacaattgttgagctgttgcagacaggctgctgaccagattaacgacctcggggcgtctgtgtacccaccacaagacttatctgagatgaaatcctcagtgaaaagattgtatggtggcgccaatgcaatgcggagggaaatcaggagccttggtggctcacctgagggtgcctttgtagcccttgaaagatttgagaagtccctgggagctctagaagtggagatagctgatgatgtagcaaacgagatggaaaatcttaccattagctcgtcctgattgctggaacttgaaagatttgccatacctatatgataatatgtcctcttgttcgagctataagcttttgttgttcaactaaaacgatgaatatgtataatcctttccagtgtgagatcaaatgcttattgcttagcctgctttgctgttcctttctttttgcatctgggtgaaggcaatgtctttgtcaaatgccacaagactgacgacatttcactccattcattataaaactgacgatattgacaagttcttttatcatacgccacaaggctgtcacactattctatttattctgctcagatatttccactgttctgtttgattaaacgtaacatcgaatatatttttaataatatatttattttgtgctgataatgttacacattccctttcattcatgttagatttgaggcaagagttcatcaacacatttcctattatcttgcacaaatacgataacctcaccaattggcaaaatggatgcaaaattgtaaccaggaaaaggaaaagatgcaaaattgcaaccaggaaaagaaaaagatttaagtttgaattgttggcgcccttccagaaaggagggacacctcaaaaaaatagcgtatgctgctatatgtggagcgcacacggtattctttagtaaaaggcgaaagaatagttcgctttgtgctcaccacgcagctgcgtgatttcacctattccatagcactccctctttatagcagctctcacctcgtcatccgcaacaactccccgaggtggtactaatccctcgcaccccaccactacctctcccggctcccgccgcttcaggcccatccggactttggcccaagccgcatcgtatccgttgggcaaactcactcggcccgtgcaagcatatcatccccgaacggctcgtggccacgcgacgcgagtgaggaggtggccagccagccgcgcgcggcgcgcgtgccgccgtttttccgacgaaacgcgcgtggcgcgttcggcgcggcgtgcggtggggggtgaccacccaccggccagcgaaaaacggtggtgatcgctcgctgtggcgccgcacgcctgcacgcaccggctggccaccagccacgtccacgtaccgaagagaagaaggcagaagccgccgcgccggcccggcccggccgctagccaccagccatcgcgctcgggcgcgtgcgcgtgcgcgcgcgcgcggggccctggacgccgcacgcgccgctggcgtgtcgcgcggcggggcggcagcgtgtcggggtcgcgggttgagtacccaatgattgcgcgtattatacttggcgcttccccaatcctcgcgtaggctgtggctgtggctgccttttccttcgccggtgcgccgtcgattaatccgacgttgatcgatacattccatttccccatattcccaccactatcactttgcttgtaggagaatggaatggagcaaattaaggtttctttttccaaggcaaaaaagaaaagcgatcgagacgagcttgtgcatgccagcgtgttacgtgcccatgacgtatgtcgtcgagcgtggtggacactggacaggagcatgcagcaagcagcccatgcacgctacgctgacacgaccaattttgttcaaaaccgatcggaattcggcgccggttaatttgaaattgagctcgagaatgttcacgttctcgattaggctgacacgcaatgaggccgtgatgataaagttggtgggctgggcggagccgatcttgggcgtggcagacaagtatgatgagccctttcgatggctagattttgccgatcatgagaagcacattttatctgctccgttctgcgttcgacgttgtatcctgtctggtactacacaactgtgcttgctcttgttcgatttgtctcaaaattcatactactgcttgcactgtaaagtgatcgcctaccgttgatcagattgacgcgagtgaagaacacgtcgacacgccagagtactactggcagtggcgagcactggcaagccggcttcctaagagagaatctatcaattttgaccgctggatgaagctttttgtcgttgatggggacgtctccttcgccatacgcgataccggaagctttgcaaattggagttactactaccaagagcttggagctacatacagatatgacaagaaaacagattacatgcatgctaatgtgacagtaatactgctcccacggcaaatgccagcatcaggatgcattcgatctgcttaataatttgctagtaaggtaatcgctggtagtgatttcaaattttcaatatcatctgctgaaaggtaattaagataagagtatgaattacgtatgaattatcattgtgcgcttacgagattatacacaggtaaagttgctttgtagataggcgtgatagacagatcaagcagcgccatactggcaatgctgacgtggcgcatgcgtgctcgtattgctttcttttacgcaggggaattgaacaagtccagccaacctatgcccgtctttctttccttccatgctgcttaacacatgctgacattgtgatatatgcccatgctgccatgaagccctgctggcctgctgtgctgatggctgaatcctccatactctgtttagctggtaactcgttcctgcttactcctgtgttattcacaggtgatttggcaggtggcacttggccaatcttattattctcaaaccgacagttttgcccaatgatgactgaaccacgtacgcggcacttacaaaagctgagataaatcaaacaaatactaagggaaaatctagaaccttcttaaatctgaactaaaacggagaaaaacccgagccttataaatatgaataactatcttactcttcttcggtcgttccaataccttactagtgagaaatactcaggggtcttccggctagctccacagggtggtgggctagacgacctggattcgaagcatcaccctttctaattatttgatgttagatcattccctaatattcgtgtcttctccaatacccaactagctcgatgatatgattatctactaaatatctgtatgtatttgccatcttact

SEQ ID NO: 41111 - DNA, 5324 bp, Oryza sativa
atcatctttagtcccggttcgaatgctgtcagggcctgtcaggcccccccgggatctttagtcccggttggaggacaccaaccgggactaaagatcttaactttagtcctggttggtaataccaaccggatcccggtgatctttagccccggttggtactaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttatcatactacatttgcacctatgttttacacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaaaaattatttggtgtaatattttatgatttttgtatgaataaagatatcttataattattgtatgactgtcattattgtaagaataattatttgtgtacggttttttttgactcatgtagatggatcagcaatggatgtacgctgaccggtggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggttaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctattcgtaaccatcaacgattggcctgcacttagcaacctatccggacagtccaacaaggggtacaaggcttgcactcactgtatggatgaaacagaaagtacgtatcttaaccactgtaggaaggttgtatacatgggtcatcgtcgattccttgcagcaaaccacccggtacggaagaaaggcaagcacttcgaacataaggccgaccaccgtacgaagcctaaacatcgcagtgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcatgtaatgatctgaagcatatggaacaacgcggcgaccttcacccggaaccaaaggaaaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataagggctatccatccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatatgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaatggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcatattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaaggcagagggcctgatgagcctaagcgtcaagtggttctcccaggcaaaagaaaaatcgtcggagttgaggacatgactgacgaggattacgatcagttggatgggcaaccccctttcacggtgacgattgaccctagcatcctcctatcaaatgaagacaccccttactcacgcagcgatcaccaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacgtgtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactacctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatattattcatatatatgctaagtatatatgattattggaatttttattaattatatttgcttattacgatttatccacttaatttattacagacaaaaataatttttcgaaataattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccaggactaaagatatctttagtcccggttgttgagaacaaccgggagtaaagatccgggggtatatatattcccggtgcgccctcgtcttcttcaccaacacttagacgttttcggccgatcgatctctctcggcctctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatctcgatctctctccgtcgcgccgcccgccac

SEQ ID NO: 41112 - DNA, 20296 bp, Oryza sativa
ccgccgttaatgaacgagaacgagaacgatcgaacgaacgagagcgagaacaaacacgtcaacgtacgttgccgcgacaacgtgaacgagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatgtgtgtgtgtgtgtgtgtgtgtgtgtgtgtgtgtgtgtgtgtgtgtgtgtgtgtgtgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggaagacaccaaactttgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaagagtcggatgaggagcaagagagataccggggcgaagattgcagacctagagttccgagtatcgagctacgaactcaacatgcaagaggaggtggcaagaaaggttgatgaacgcatggccgcacatcggtcccatgatccctagccgaccattcctcctgcaatggtgagcccgtcaggaaaccgtagcagctgcgcctcaacggggcaggtagaatcacagagcatggacgccatgcaaacacaggacgaatcgacctgtcccgttgatgacatcactcagcggacaccatgtgagctacatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaagcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaaggccccccccagctccaccacctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttagagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactccctttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttgctgtcttcctacataccaaatttcattcccgtacgaacttgctaagtgtttcatatgtaatgcatcccatgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggttcgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactatgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatgtatgcatatatatgtattgaaacatatatatgcatggtttatatatatatatatatatatatatatatatatatatatatatatatatatatatatatatatatatataaaccatgcagcaacagggccatgcaaaaaaaaaaaggtcagcttgatctttactcccggttatttcacccgggactaaagatagcgatctttagtcccggattggtactcccggtttggaaaccgggactaaagggggttacgaaccgggactacaaagggtttctccaccagtggtatatgcaattgactaatggacatataagataaatacatgacgggtcatatagtaggggcgctgattttctataatattccctgcaatgatatgtcttcctacaatgacacgttgtaaacaagaaaaaaaggaaaaatgaacgtaagaatttttacaattctttcggaaatgagttgtttatgaatgaaatcgagatatttcaacgaaatcgaatggggccctggtttggtgaagcagctatactagattgctttcctgtgtttcaggactgcactcttattcattcctgtcttgtgctgtatctagctagggccaattaatagagtatttttcttgaggtaattagtggattatatggattcatttactgttcaactaggggtagtacatgcccattgtttcattgagacatgcacagaggcaccattcgagaggcgttttccctccaatgcattacatgaaagtcatcaacaatccataaacaatcatatgcttctcttcttatcatggggagaatcctattctaaaccaacatggcacttttgtgcatcaaacattaacaaagcaaaggaaggctataaagtaatccaatatacatacactggtaagaaacaccaggaccgtttctctgagcggctaaacgcgcatgttacctctactttgcatgctactccagcatgcagtagaaaaagggggaaaaggatagtgaaagaagaaaaggagtgaagcttccatgcctaggtgagctgataagtgacatgcacatggaaggagttgttaagtccaggcctaagcatgctttaacaaaccctaatcccccactaataagatagattaacgctgctaccattgacaagccaatgagttatccttaattaagcgatcactgtctgcacaaaaggtgcatcatggattacttattgttagctccatgcatgcagctagcgagctacgcaagttagttatgctgctgagaggagttcacgtttaccatcctgttagggtattagggtgagtgatccacccactcaccataaacaaatttacacataaaaatttacagaagtaaatcagaagcaacagtcacacttgcaatttaagtcaaaaaagcaaaaagggcatgttcttataaacgttatcatcacttttgacctacaaacctgccaactttacaaatactctgaatgtaagtcgattgaacgagttacatatgtcaaatttggttagctctatttctagtgaagaacaactgaacaagttcagaagacaatgcataagtagtttgatgacaccgaagcacctgtatctgttcctgctactgctagtactccatattttagtcgaattctttgaccagtttgataatcatagtgtcttttctgcgtgccataatttgctttcctcattcatcaatcattctgatcgtgcacctccctcctctcatggacaggaaagtatattttccttcatcacaagaaaagcaaagcagagaggagagaggaggaggcagctcgacagtgcagtcaaacagaaagcccattcgatccctttctccactgtcctcctctccaatgtaaggtccatttctccctgctccaaaatacaaatgtacacatgcttgctgctgcatggtccagaaggtttgcacacatttataaacattattggtccagtttaatttactgctaattcacttgtttatcagccccaacatgcctcggaagccgtgcaagtgcgttttgcagtcccccacaaacatgcctcccattctctgtccccataaggccacaaccattgttaaaaccatcaactttctccacctcttcagtcttcatcctttatatataagcaaacaactctttcttcttctactcctcatcactgtccctctcctgcttgcttctttctgctccagctaagctcttcctctctggaagaacagctttgcaatcttgctatctctcataagctcaaatggagctcagtggtagctgtagaagtattgtctggccaatgtgtggaggagatacaggtgaggagcctgaagggaagcctcacagataggcttgggagagtgtccgtttgctcccactgctagctaagctctctgcttgctccatgagctgagcatgaggaggaggaagatgcagatggtgtgagcttgtggggaattgaggcttcatggtccgagatatatatatctctctctaggtatctcaaattagtagctacttactaattagtcttcctagttagattatttcttttccttttctttagtttcttcttcttcttcttccttgtttttccttttttggtttcttgagaagctctaagatgaggggcttcttggctagaggcttggggttctacctggtttcagatcttgatgccttcatggtcttctaagtaatgcaataaacactagtgttggaggtagcctcaagcttggaatgaatcgagttacaattcattgtaatgcatctataatctctgtgtttttgcatatgttatctgctgctgcaacttaacactccagtgtgcttttatgctgctcttgatgacgtggtacgagtaatatacaatcatgtggtaatttgattgatttatttattttttgcaagaagaccataccaaatttctttcagaaaaacaaaattcgtctgcagaaatgcagaagcatgtggataacgctctacacttgcggacaaaagtgatagtattagttttaatccttcaaacaattctaatgaaaatctatgctaacaggtgtacagcattaggctgaaaaatgcagttgtacagcatcaaatgcagcgaaatgcaggttttgtagtcgggacaaaagctgtgaagtctttctggtcgccaccagttttaggttgctaatcccagagggagtaaagtattcaacgtgacagagcaattgagagcgagagaaagtacaccagagagagcttaaaaatttgttactcctacagtttggtcacagtacagcaaggcgtcagaaccgttaaagttctctgaagtctgaagcgccccaacggtgaagtgagtggagtacatgcaatctctgcatcatcatcaaatgcgtgcaacgcaatccatctctgcacccaaaacgcaccgatgcttcggtagatcacgcacactgccgttacactgttacgcgagagccttgtgtaggagcagcaaactagactggcaacatagaggcagattcagagagtcagtactggtactacgagtaggagtagcttaggctaggcaggggcgctgggaggcaaaggcaaacgcagcgtgggagtagagtagagagggctgtggggtggcgtgccgttgtcctggcttgcctcaatgcctcccctccgagctctggctgttaaaatggtgcagggaatattcagcggctgctgcgcaggcagtggtcgtcgaatgcatgcactgcagcgccctgtgctgtgttgtgctctcgtatggccccctggctcctgcatccatcctctctcctctagctctagccctcctgccctgcgctgcctgcctgcctgcctgccgctttcgcttttgcctttagctgctgtgacaccactccgcctctctctcgcccgcccggttttgctggtggtggtggagcggtggatgcgagcgagcgagcgcaacaacagcgagccagccaagctagccactgatctcgttatcctcgtcctgttgctatcttgtgtggcgttttggacgattctggatacggggttttcaccccctccgaaaccaagggggccatggccgtggaattgtcatttgtgtcaatcacggcgcattccttggcagccattgttgtacggaatttctatttaaatccttcatagtaggtaggattagggatttttttacatagagatttcggtgtgtatcggcgattgtttccgttttgtgttgttcggaaacaaatcgaatcgatgctaccccgttttaaaatatactaccatttcatgttttaagactttctagcactgtttatatttatatagatgttaatgaatctagacgcacatatatatctagattcatcgatatatatgtaaatgtgggtaatgttaaaaagtcttataatatgaaacggaggaagtaacaattattctaatttgtttcagtatataataatttgtttacatctttattcgattctggttttgttttgttttaaaaaaacggtagcctcgatttgaccatttttccgacagtgtcttcgtcccgacagggctggcattccacagacaacccggcgcgacgacgaggcgatcgaatcgatggatcgtgcggtgacaagcgttcgtccgtggggttggattttagcgtttccctttgtcgagtttccatggatgcgtgcgtgatcttgacatgttgatcgacgccgcgggctgccaaagccaaagctggtgtgtagatgtgccgatcgatgaggaaacccatagcatatggcatggacggcggatcgacggatggattgacgtttgacaccactaactcacggagcgacgggtagtacagtacagtaggggcctcctcctcctccccgattcttcttcgtgatccgtgcacagtgcacgatgccctgcacgacgctacgcgacgatcccctcaagacacgcatcgctctgaacacgtctcatgtagctgcgtggcactgtgcatacatacgactacgtcttaccatatggaaacgaatcaacgatcgacttcgctgtgcgtgaggtggcatcaatagtacttgtagtagtgctgcatgcgatgcatgacagaggcgcatcagggagagacgtgcagggtgtagcgtagtgtatgcactgtacatgcgacaaggagtagcagtacatcgccaaaaacctgcgatcagaaaggacgctagtatcacaattttgatgtcgttcgtaccggctctcaaatttgaacgtacactgatgccctgacggagaatatcagaaattgtatgcagcaatagtagaaaatttgcattcacttcctgtagaaaaaaagtatttcctttcatgttacttatcatctcatggatcgtcctttcagtaatacactactccttgaaaaaaacatctcggcgtaccaaaaatttaaacttaaaattttgatatctcgagttattaagtaacaagaggtattaagttttactgcataataaaatatgtggtatctctcttggtattttttcaaagaaggtggaattaacactgatagtacagtacaaagacatgaagtatgatgcactccatgcatgcccgcccggagttgctggcagtgtactccaattaatcccatctcttttccccgatggtccaagatcaacaaagacacgctctgtgcaatgggccagcctctcgtggggacaaagtgcaaagtagctgaagacagtttgatatagattcttcagttcagtcccgggtgtgcacggcagtagtactagatatcctagtagtagtagaaagatcatgcgtgcttgcatgcatgggtgcagatcagatcagagcaaggccaaattaacacccaacgcacgcagggggagtcaatggttttcctgagcaccagggcaaagccattaagaggaacaggagcgaaaccgcagctgagttgcaacaaatgcgtagcagcagcagcagatcgtgcatgggcatgcaacgcggcctccggcctcggcatctcgggtctcagttgagctagcagacgagcaacagctggccgctaaagctcacggaaacgaaggcttttacgttattacagaagtttgcaggaacatgaagtggatagtagctttgacttggcagaccgtggagtacccatgcagttgtgcacaaggctcttgtacatgccacgagcacgtgaattgttacgagaaggaaatgtgttttggggttccattataatgcgtgatgaggacaaggcattgatgggtggtggcgctgcgtaaagcgggtgccgtaccctgctgcgagcaacgagtaaaaaaaaaagaggcagaggcagaggcaggcagcaaggatgggacgccggagtcagtagtggcaggcggacaagacgtgagatccgggagatgctgctgccgctgcctccgcgctcacagtcacagtagtggtgtgccgcgcgacgggacgggacgtgacaccgcgcgcgctgcgccgttgcgcgcggcggcggcggcgtcgcctccgtagccatacgcgcgcgcgtgcgtgcgtgcggctgcgccgtgccacccgcgcagaattgatgggtgggtcggcggctgcggctcaccccgtcggggcgtagagtattgggcatgcgaccgcgaccggcacgcgcgctcgcgtttcggcggggtgcgtgatgcgtcggcgtgcagttacgagtttgcctaccgctgcggcgcacgtaccgcgcgcgtggctcgcttcatgggagtgggactcgccgtgagaccgcgagttcgtgtcgatgcatacggcctcttctcttcacaatgcgcgtgagagacgcacgcagaaatgcgggagtagtagtttgtttgatgcaactttgcagctcttcgtcagtgaacatacatgaagtttaattttgaaattagttccaaccaagtcgttgtagtatagtggtgagtattcccgcctgtcacgcgggtgacccgggttcgatccccggcaacggcgtaatccttttttccccagttgatttgcttcaattgccattgtctgcccttcttttttcccacttgatttacttcaattgccattatctgccaatatcggattttcccccctttttttggtttacttcaattgctaatatgagctgatttgcttcaattgccattatctgccaatatcgattttttttttctttttttggtttacttcaattgctaatatgagttgatttgcttcaattgccattatctgccaatattggattttttttctctttttttggttcgcttcaattgccaatatggaacgatgaatgcttgttttctgatttgcttcaatgaccaaattatggaatgctgaatgtccgttcagtttagcaaagaactcatcaggcatatacagtctactagctacgatcatccacctgaatgcctgcacacacagcagtggtcaatgcaacaaagacgacattttcttgtcttttcattacaacattttatactcctgctgctgctctagattcaattctgacatttattttgccaggcaaaagggacgcataacaccaacacgcacgtaaaagaacaacagcccacgcgcggttcgcattctcgtccatctgagacaatcaaacgatctttttaaataatacattttctcagtctcagacaccaacggcgacgcagaaacaatttcttctatacctggtattccaaaaaaaagaaaaaaaaagttctatgcgactatgcctaagcaatctagatatgacactattaccaaaataaataaaagaagaaaaaaatgcattatctacatggaccaggcaacagtcagcaaaagctgagcgaattgtaagtctacctcctgagagaacaaagcatggaactttggcacaaaaccaatgcaccatctcctgctcacgccattgcatactccttccaagtggatctccatgttgccatgcaactccgttgctaccacaaactgtagggaagtgtcgtcgtcgccaccgtatttgccatcgaaaagctcaatgtcatcagctatgcggcctgaccgagctgtgcagcgcaaatcaatgcctccgggaggcagcctgagcggctggagctcaacagtggcctcgacgcctttcagaatcctggcgagcttcaggcgcatcattggagtagagcggttgccacaaggtagaatggacagctcattgactctggaccaatcgtgccgatatatactaggatgctctactactccttggatcagctcacggtaactgtcaatgccattacctgttctctttatcttcaggttgaactcgagcaagatttcaggattggtatgaatggctctccgagggctcaatgttggcagccgcaaaacaccctgcagagtaaagcaatatggccacatagagatttcattatttccgcttagagaagaagtcctgaaaagaaatgtggaagagatggagtgcatacatgtcgtgatacgacggtgaaagggtggcctatttctctgttgaaaatgtaattgcgccgtccatcacgtaagtccctaatcgcgacgaatccggatatgtcgagtttgcaggaatgaagagaatcagctacaatgatctcgagggtgtaaacttgcaagatgctgctgggtgcacaagtacaccactccaaacaaacaagtctaggatgcagattcctcttaggttgcaactttgctggattcaaagaattacttaattagcctggattatgatatgcaacatatgaaaaatacaaatcaggccaaagcaaacaataaccagtactcagacctttgtcttacagaaaagaatgtatgatttggagaaaaagtctgacacaagtgaatctgtctagttatttgaattgcaaagttggctccttagcgaagccccaagcggtaaccaaattcctcatgtgacataacacatggcctgatggttaaggaaaagtgcccttttcattttttgagtgttataatatatgttcttttccccctctataacactacatcaaggttggcacactgataactattgcttgcaatgaacacaaaagaaagccgcctattcatatggtaaactggctactactgctgattaacatgtgtagcctttctacctatattataaggattggtaggagttttctatgtgaccacaatccattttgctatatagagtatggtgattaagtccagtaccaatatatactgtattagtcctactgatcagtgatcaccacttttctacccaagataacaagaaatcagtatatatgtgtaaatattagtgctcatggagaagcagttcagattgatataagatgtgcacttacattccgatttgtcggacaaggtccagtagtataataacaccgcatatggctcatccgttgggagctctgcttttgtagtgctcctgctgcctgggttacacatgaaataattcgaacccctccttggttcctgcactggttgtatgattggctccatgaccagcttaagctgctccttgcgccactcttccctcttctgaatttcctcctcagttggaaacttgggtacatatggctctgaaaccttcgcccaatcagattcctcaggagattcaaacaacaagctgtactcgccttctccttcccctccccctgatagtgtcccaggtagagataacgcattaagcctcaactcctcgttttcttgctgcttctgctgatacagaagtccctgatcttcctctgcttctaatgcaaagatggcactgagtccaaaatcatgttcttgccagtctatccttgcggcatttagccggcaaagcttcctattgagctgaagaagcaaacatgaacatgatattgggttgttatcatcaaccttccattctagaacttggtgtgtccagttatctgctgaggtgaaggatgggaatgcacagctgttgtcatcatctccgcaatggatgctcaccgtgattccactccacccagtaagaacaacgccgtcgttgagccatattgctagattgtccactaggaacttgaaactaaaaatctgatccacctgcggtgacatcgacaccattgccacaggtctcaatgcgactgtcttgcctctttgttctgtgaagccatccatctttgggtccaaatagccttccacaaatcccactgcttgaagctccatcgtcgtcaatggcagaacgaacctgtcatagcaggcaagcctccagcgcatgtcgcgaggacattcttgttccacgaagctgcagcgaacttccccattggtgcccactgatagttcgaaccttcggtgcatcgcttcatcaggcgattcccactttatgtccccatggcctagaggaatgtaggcaagaggcttcatctccagctcctccctttccctgtccaactcttcttgcttcctcctctcctgctcttgcttctcgtgaagtatcatctcttcttgctcctcttgctcatacatctggtagagattcctggccagatcctccaatgcggccgtgatgttgatgaattcatggccgaccctagcatacagcttctcctccgtccatttggaggggatacggaaccatcgctcggagaaggcgatggtgactgttgagccgtcggggggcagaacgaacagcttgtcatggaggcgcaccgcgagtcttgcgatccacatgttggtagtgagggcaaggcggtcgcctccggcgccgggaagccgcctgatgacggcgaccaccctcaccggcggggagcccgccgccacgacggccgcgaccatctcggccttgcgggacagcccggactgcgatgtgctgaggcggaagcaggagagggcgcccacctggccgccgtcatcttccagctctaggcaacacccgtcggcggcgaggcgggcgaggcggagggggaacccgccctctcgctcggcgcagaagcgacgggtctccctgtgcgaccacaatgcctgccctctcttggaggagagcttgatcctgaaaagccgatggcaatggcgcggcggcgcggcgtccctctccttgccgtagattggtctagcgtactgccactcgtggagcaccgggtcgcccccctcgaacatgtcgaacggggcgaacagctgatccaatagacgcagatgaatctcctcctcttcctccttttgatgagccgctttctcttccagaaagatgggggatgaacaagcctccatggcttgtcgcccgcgtgtctgctactaccattgaatccgtctccgtcgccgcctccgccgccgacacgatcatatggaattgtttttcagaatctaaagcaaaattagccgccgccgccgcggctgcgatcttgacactgtcgtttgcgtcgccgccgcaaaaccctagaggcctagccgcgctttcggtcaataaattggtcgccacggatctctgtattgttggtcaggttcgctccgattcggaagaagtcttcaaagttttagacctcctcctcctcttgatcagccgcttcgtctttgaggccaatggaggtggcggagaagctctcatgggttggcacgcgcgggcggactatcatcttctccatcgcgccggccgccgcaatgccggcgctggggacgacgccgcgtcgaaccctagccgcttgccgcgcgcggcttctgttaatgcttaatgccagcgcggaatctccggcggatttcggagggagtttgtatcgattcacgtaatcgatcggagtctggactctggactagaagctgatcatcctgttcactggaacggttcgagtgtctcgttttctctcgggcctggtttagagcatgcccaacagattacttattctattccctatccttaaattaaagaaattttaaccaaaattctcatccaacagattccctaaccaacatcccaataatccaggttcccatattcgtatatgtcgttactcatttgcagggaaccattttttcttcccaatcgtggtcgtcgctgcctcgcgcgcgtagggggaaaattgttcccgcgctccttttctcgccctcctcgccagtcgccagcaacaaaattcctcttcctcccaggcgtcggcagcggctttccaggcggtgaagcaacggccaaccccttcctcgtaggcgtcgtcgactgagttccacgcggagatgcagcggtcgtccccttcctctcggtcgcaggggtcggcgtcggtgttgctccaggcagcgatgcagcggccatgcccttcctctcaggtgcaggcgccggcgttgctccaagcggcgatgcagccgccgtcctcttcctcgcaggcgtcggcgtcggcgttgttccagggggcgcccgcacgtcgaccaccgcctcctcgatttggggccgacggccctctgcgccccgcaccgccgcctcgccgtcgtctcggtctgcctcatcctcaacctccctactccggtgtgcaggcgacaaagtccatggagggacatgctccatgggagacactgaatcccctcttacacgaagctcctggcgtcgatttctccatagcttattctgtgagtgatgaagaattcctccataggagcaatttcggtaaagctatccctgattcgttcgatgtttagattaattttcagagtgttgcagcctgatctgatgtccattctgtgactgacttccccggcttgaaattcaggaattgctacggcttctctttggtgttccgttttttaacaaatcgcagcagtcaggacactggttgactggctggtgatgatggcgctaggtcacggcggcgcaggtccggggaggaagaagtcgatcagcgctggtgcgggagggagaagacgtgcacaagtaccgaactgggccccaccttgcttacgtggcaaactaacaaatgacagggaattgatttttaggcatctcttggaggagggggtcattgttgggcccaatttttattttggtattcctaattcagattttttgggaatcaaatattgggtgattgttgggcatgctcttagttcccaaatttttcttcaaacttttaactttttcatcacatcaaaatttttctacacacataaactttcaattttttttctttaaacttccaattttagttaaactttcaattttagcgtggaactaaacacagcctcggatgtactccaatattggaagaattctctagttactcctcctaaaatataagtattgttttaaatttgatatactcttcgagatgctactttgaacaataacatttatcttcgagatttgaacctcaaaccacgctcatttctcacggttgacctcgtcgagcagctagtcgccttgtgggaagcggtccggaatgtgcacttagacactggagaaccggatcagattgcctggaagttcacaagcaacgagcgctacacggcctcctcggcctaccatgcgcaatgttgtggggcgccgagcacaaacttcaactccttgatttggaaagcctgggcaccggggaaatgcaaatttcatgcttggcttatcatccagaatagagtctggacatcaggtcgcttgcgattagggggtggcaaaataacggttgttgctctttttactgccgcgaggctaagacggcactgcacctcgttgccacttgtagatataccaagatgatttggcaccttgtctctgcatgggtgggctatcaacagctggagccgactgaatgggaggaaacccagtctgtcaaacaatagtgggagagcctcgcaaacactcctagtgtcccaagaagggggcttcgatcgctcatcctattagtcgtctgggaaatctggaaagagagaaatcggcggatctttgatcataaagaggtggcaacgagttttctgctaacgagaatcaaagaggaggttagcctttggactttagcaggggccaaacggttgcgtgagttaatcccgcattctgtatagtgtacatctatagtgcttctctttttccctttgtcccttggggttatattttctcatgttcaattcaatgaaaaggcactcgtgttgttttccgttaaaaaaaataacatttataaaagtaaggtgtttatataaaaaaaagttgcatatattatgatagtttgtttaaatctagtaacaccaattttacatgattgatctttttaatttttttactatcaatagtcaaaattaaaaatgttaaacctgtcactattctaaaaatgcttatattttggagcggagaaagtattatgtgcggccagcagccaaggacaaagacaaagcatgttgcaattcttgagtaaagggaaaggagcaaataatgttagattcagagctctatccatgatctgcaaaaaaatatatcaaaatcgtccatataaatcaacaaattgatagccttgctaggtgggaaaagaagggatagccctgtaatatgaagctctgaacttgatcttgacttcttgctcctgtagatttagctgaaacaaaccaaaaatcatgcactggactactggagtaaaaaggtactactagtagccaccataattatcggcgaaagggatgtttagtttttcagcttagctcagaaaattatgaatatcccgaaacgaagatgtaactgaaatcaggagctaaaactgatttgttttccctagctgatgaaagatttggtttcatccattgagatccggagctattttttttttcaggctagcatgtcttcctttctcaagccatcatggaaaccacctcactggtcactgcaaagccagcagggagccaactcttctagcttaaggtattgtacaactctatattgtactcccgatattgaacagtgcaaaatgttgagctcagtgaatacccaattttattcacatatatacatatactgatattgaacagtgcaaaatgttgagctcagtgcttcacttgtttttttttttggcaatattgctgtgtatgaaatctgtgttcaattttgctgtggtccattttggcaataatacacatactcaaggcactataacctcaaggaattcatggagcaactgccatctgaactgcacatgtatcagttttaatcaacaagaatga

SEQ ID NO: 41113 - DNA, 32316 bp, Oryza sativa
  unsure (1)..(32316): unsure at all n locations
tcttcactggctcttgttccatatatgccgatttgcaatttgcaaccaacaatacagacagactacagacaaaatatatgatttcttccaattattccaattgacattacagacacaattccaatttgtcatacttacacaacacaaatttgtcaagctcacaagattctactatacaccatccagaatttctaccaaaaaatttggcactacacaaacacttaaatttgcatgctcacatggcaaatttctaccaaaaaatggatttttttttccgaactgtacagtgcggaagccctattgaccagaactccagaagttaacgcctcgaaccattgcatttgcatgttggatgttagaagttcaggttcagattctgaagttcagtttcactgtagctttgctgggacatctgaagagtctacatattcaggaaaaagaaagttcattactccaaggtgaatcaagattcagtacttgagtaactcaattgagtaactccgaggtgaatcaagattcagaacttgagtagtaatccttgtatgcaaagattacaccatgaactattagctgcaactctgatgatttactgctcaaactgcaaaaaatcagcttgctctcagaaacgcggcagcatgagttacaaggacctttgcacattccctgcaatatccaaacaatcacattcctttttttcctgaaaacatgcagtcattgagaagttcagaattcaaattcatgaaaacagaagttcagaacttcgagatcagggaaggttcagaacgcacataagcagcatggtgctcagggtgcattcacacagcagagtgcaattccatggcacacctgctgcatggacaaaactgcggagagcgatcaatctagttctcttgtcaacaacacatcgaataaaatatgtcaaaccaaaaataacagggaagaatgaagctagaattttatattgctttttatatccaccaaatggttatttacaaaagaaaggaacaaatgtgacttcccttcgacaatgaaatgaccaaataagccaaaaggtaacttgaacaaatgtgacttcacatggcaagtgattgatatccgaaatggatagtaggatttggatttgaacccgacaagttcacaacaatgctccaaatgaagttttaccattctttccatagctaaaagaaatttaatgtaaaccagttaactgcaaaaacctcaaatagcagagttttagtttagaggaaggaatgatccatatattatttggaacggcaccattagaaaactaccattgatcttttcatttgtcaggaatggtcctgttgctaggaacttgcaaaatagctgataaaagaatatggcagagcaaattttgtgcattcagaattcagaaatatgcttggcaactaatagccagatgtagcactaaaatcacaacatgccaccaataactcatattagtaaaaacccaaaagatggccatattgtaaaataatgaggcatgagaaaggttgaatctggatagcaacagaaaacctaccttttattttaaagaaacctagcattgtcttctccttcaacatatttccaaaacagattatagccaaaaaaaggcacgccacaaaaaacacagggacatttggtacagggcttaatatgtagcatgcatgatttaatggaatgccatggctttagaataaatatctacatgaaagaaattgcagaagaacaaacatagatatatcatatatgaaaggaagagtagtcatattagtacaccaaaaagatgaccatcttgtaaaataatgagccatgagaaaggttgaatctggataagaatagaaagcctaccttttatttaaagaaacctacaattttcttctcctccaacatatttccacaccagattgtagcaaaaaaaaaaacgccacaaaaaacacagggacatttagtacagggtaagtaatatatacatgatttaacggaatgccatggctttagaataaatatcacacgaaagaagccgcagaagaacaaagatagatatatcatatatgaaaggaagagtagagaaagaaacggaatgacctgaatttttttttttgtaatatctgagtatccccaaccattttcagtgaataagtgtaaaaggtactacattctgtccataggacacactgaagtctgaaatttcataaaaaatgttcacctgcaatataagtatttgcccaatagatgcctcttatcactggtttctaatgtttaggtgtaaatggttgcctacttatactaattcaagtgagattaccttcacaccaccgagctgacaatgttaaaaaggtgaattttggcaagtccttggccactataaagactgcactcttctccttcgccgatgcctgcacacagcaacaaaaaactaatgcgaaatagcatatatgtccccttaaactggccctcagatgtttgttacacctacaaaagcagaaacttgatattgtcacatgctcacaggcatagcaacagtgtgagagacaattattacagtaaaataatcagtgagagagagagagagagagagatgtaattttaccatctatatttcatcttgctccagattcttatccaatcctcagaagaacttgtgaacttcaggagtttttttttttggtctaaatgtaaagctaatctggatgtgattgtagaagatgttatctaaatgactacatccagtcagaaccatatcgcaactggtttgcagcattaggggtgtcctaaaaaaagatgttctgattttcctatcatctgaatgttcagccacatcatcggtagccactaaattttataaaacaatttgttttataaaatgttctatgcttgaacaatatagatacgaaacagtatatagcatctagtatcatagattacatagctagaagaaaacacactgcataacgttgtgcagtttcacgcaggcattatctacatggaccaggcaatagtcagcaagagctgagcaaattggaagtctacctcctgagagaacaaagcatggaactttggcacaaaatcaatgcaccatctctggctcacaccattacatactgcttccaagtggatctccatgttgccatgcagctccgttgccaccacaaactgtagggaggtgtcgtcaccaccgtatttgccatcaaaaagctcaatgtcatcagctatacggcctgaccgagctgtgcatcgcaaatcaatgcctccaggaggcagcctgagcagctggagctcaacagtggcctcgacgcctttcgaaatcacggcgagcttcaggcgcatcattggagtagagttgttgccacaaggtacaatggacagctcattgactctggaccaatcgcgccgatatatactaggatgttctactactccttggatcagatcatggtaactgtgaatgccattacctgttctcttcatcttcaggttgaactcgagcaagattttaggattggtatgaatggctctccgagggctcaatgttggcagctgcaaaacaccctgcagagtaaagcaatatgcccatatagagctttcatcatttccgcttagagaataagttgtgaaaagatatgtggaagagatggagtgcatacatgttgtgatacgacagtgaaagggtggtccatttctctgttgaaaatgtaattgcgccgtccatcacgtaagtccctaatcgcaacgaaaccggatatgtcgagtttgcaggaatgaagagaatcagctacaatgatctcgagggcgtaaacttgcaacatgctgctgggtgaacaagtacaccactccaaacaaacaagtctaggatacaccttcctcttaggtttcaactttgctggattcaaagagttacttaattagcctggattacaaatcgggccaaagcaaacaataactagtatccagaactttgtcttagagaaaagaatgcatgatttggagaagaagtcttacacacgtgcatctgtttagttatttgaactgcaaagttaaggctccttagcgaagccccaagcagtaactgaattcctcaagttataaaatacacggagagatggttaaggaaaagtgcccgtttcattttttgagtgctaaaatatatgtctttctcccctatctacatcaatgttcgcacagtggcaattattacttgcaatgaagacaaaagaaagttgcctgtccacttagtaaaccagcgactactgctgattaagatatgttgtatttttatctatgttacatgaattggtaggaattttctatgtaagcactctatcatgctagttaatttcagtaccaatatgtattggtcctactaatgaccatttttttacccagtataacaacaaatcagcaaatatgtgtaaatattagtgctcatggaaatgcaattcagatgaatatagatgtgtacttacattctgatttgtcggacaaggtccagtagtatagtaacactgagtatggttcatgcattgggagctctgcttccctggtgctcctgctgcgtggctcagacatgaaataatttataccccttctcggttcctgcactggccgtatgatcggcgccatgaccagcttaagctgctccttgcgccactcctccctcttcctaatttcttcttcagttggaaactttggtacatatggttctgaaaccttcacccaatcagattcgccaggagattcaaacaataagctgtactcagcttctccttcccctcccactgatggttccccagatagggataactcattaagcctaaagtcctggttttctagctgttcttggtgatacagaagaccctgcacttcctctgcttctaatgcaaagattgcactgagtcccaaatcatgtcttctctttctgtcattgcggcatttagccggcaaagcttcctattgagctgaacaagcaaacttgaacacgatattgggttgttatcatcgaccctccattctagaatttggtgtgtccagctctctgctgaggtgcagggcaggaatgtgcagttgtcgtcatcatctccgctatggatgcccaccgtgattccactccacccagtaagaatgatgccatcgttgagccgtattggtacattgtctactaggaacttgaaactcaaaatctgatccacctgtgtgtgttcttgcggcaacaccgatagcattgccacaggtctcaacgtctctatatagcttctttgttctgtgaagccaatggtctctgggtccgaatagccttccacaaatcctactacttgaagcttcatcgtcgtcaatggcagaataaacctgccatcgcaggcaagcctccggcgcatgacgcgaggacattcctgctccacaaagttgcagcgaacctccccatcagtgcccattgatagtttgaaccttcggtgcatcgcttcacaaggcgattcccactgcatctccccatggcctagagggatgcaggcaagaggcatcatctccagctcctccctttccctgttcagctcttcttgcttcctcttctcctgctcttgtttctcctgaagcaccatctttttttgctcctcttgttcatacatctggtagagagtcctggccagatcctccaatgcggccgtaatgttgatgaaatcatggccgaccctagcatacaacttctcctccgtccaattggaggggacacggaaccatcgctcggagaaggcaatggtgacagttgagccgtcggggggcaggacgaagagcttgtcatggaggcgcaccacaaggcttgccatcctcatgttggacacgatggcgaggcggtcgcctccggcgaccggaaaccgcctaatgacggccacaaccctcaccggcacagaatcagcggcggcgagggctacgacctcctccctcctgctccaaggccatggcctggactcgaaacaggagagcgcgcccacccggccaccgtcctcttccagctccaggcgaggggacccgtcggcggcgaggcgggcgaagcggagggggaatccgccggcgcgctcggcggagaagcgaggggtctccttgcgcgaccacatggcctgccctctcttgacggagagcttcatcgtgaacagcaggtggcaacgacgcggcggcggcggcggcggcgtggggtgtctcgtcttgggtcgagcacattgccactcctccagctccggatcgcccgcttcccacggattgaacggcgcgagcagctgctccaattgacgaagatgaatctcctcctcatcctgcttttcgtgagatgatttctcgttcagatcgatggggatgtacaagctttcacgggcacgcacgtcggctgcctccattgcgtatgccggctgccgccgacacgatcgtatatggaacaatttttcagaggcgaatacgtcgaccggaaaatacctcgccgccgccgccgcggcgatcctgacactgtcgtcgcgtgcgccgccggcagccagaaaatctgggggttaataaatcagatgcatatacgcgcgttttctgttaataaaacagatgcctgcacggggattaggcaggttcgtgccggttcgggagaggagagagaaagcggcgagattggttcgacttctccgaggagttcttcggaaggggagtatgagaaaaaaaaaaaggtttactatgtgtcatatgccattataaattccgtttggaaatactacctccatcccaaaatatttgatgccgttgacttttttaaaaatgtttgaccgttcatcttatttaaaaaatttaagtaattgttaattctttttctatcatttgatttattgttaaatatacttttatgtatacatatagttttacacatatcacaaaagtttttgaataaaacaaatggtcaaacatgtttaaaaaagtcaacggtgtcaaacatttagtgaaggagggagtatgtcactgcagtttacgtgattgaaatcatactacattttaatagatgtttgagattacatcattgatgcaatttctaaatattttagaccaaaatagccttgtcttcttcctccatcaattatttatgtcctctctctaacctttcacctctagctacggtcggtcgtcgtccctatgcgacgcgtcgcacgcctccgctccacaataggctcatgcagcaagcggccacgacgctggaagagctgttatagggcacaaccgttggcggagatagaggggaccggtgatgccttcaaatccgatggcccgaccttgttgctgcagggacctcatgcctagagcttcgtcaccacacgacttggcgtcgttggagcaacaagcctgcggtgcacaggaagatcagcaccggttgcgatcctcgccatcgacattggctctagcactgtgaccagttatagcccgtggacgctgcaaccgctgctctcttccagctacacgagctcgctggaagagaggagagagggagaggaagaaggggatggatggagaaaaatggataatttggtcctaaaaatttgaaaaatgtaatgaatgagtaagtagtggtatatttcgaatatgtgtgaaatttcaatggcattgttctaatttcacaaacaataatagtatattttaaaacgggtaaatttataatgtcatagatccaattaagagagagagaaagtaggaaataacgcaattttccttcaatccaaagaaaatagtggaatcccatgaatgaacaaatatcagggcccctttaatttggaggaaaaacatagaaattttagaggatttcaatcatataggaaaatttcctatgaagctctttgaaacaaatgattgaatcatatccaatcctttgaaattcctatggaatgaacaatcctatagagatttttggaggaaatttagcaagagctccaacctcttgctaactttcctttgagtctatctctctcatccaattcctgtgtttttcctgtggttcaatcaaacggtcattcctgtgtttttcctgtgttttgcaatcctctgttttaaacttatattcctatcaaaattctacgtttttcctattcctacgttgtctccatcctgcgattcaaaggggccctcagaatgtgcactacctgcctctccggtcctttcaccccaatatctctttcctcctgaataaacgcctgatatgtttcgatcaagtgtttctgttggtatagccgctgattggccttgaatggactcgtgagctgtgcttattgtgactgaactctggagacttggagttgacccccaatttgttcatcggatgtgcatggaacatggggctactctactcattgcacgtccatccccaattccccatggatcaagcaaggaactactgctattatttcattgcagatcatgcagccagaccaccaccatattggcgctgatcgtttctgctggttgttgcagccagcaagctgggcatcctgttgcagcggtagaaaatgaacttgcattaggctggctgcagccagcaataccgatcagcgccattgattgcgggcgatatgactacaagaaaatatcgctgatcctctctctcacacacacatgtatccgaagatgttaccgtgaatcagaagtcatagggccgtttaaattagtgtcattttaaatcataccaatatttagtaaaattaaaaaaaatatagttgcatttagtttatgtactccttccgtttcacaatgtaagtcattctaatatttttcacattcatattgatgctaatgaatctaaacatatatatctatctagattcattaacatcattatgaatatgggaaatgctagaatgacttacattgtgaaacggaggaagtaccaaatagtgatagtgcataagaaattttggcacaacatatttttattctatactatcaaagtttgaaaattataccaagtaactaaaagttaaaatttgaaagattgatcttgacaattatctgaattgaacaggcacatacccactcaggaaacatctaggctctcacgccgtctcacggtccccacctgtcggcgaccgagcgatggaaggagcagcgagacggacggcacgggggcccgtcagggtggtccgtgcccaccgccacccgtgacgtttgctcgccatcgattgtgccggcggccgcaccgcccggctcggccggacacgtgtacgaccctccccgcgccgtgcggcctctgccactccccatcggacggtcggcctcgctccgcccgtgaccgtgtctttcgaattaaaggggggggcttccgccgaccgggcccgtccccccctgcccgtgctgatgggccggggctccgattaaaggaccatatttgcacataccaccctacactttctcgaaaattgtagtgctcgtactagtactggtttcttttgttgttctcattgagcattagcatgtgattattggctaatctctccttgtaaaccaaggatctgatgaagctttgaaaaagatccagatttgcagctggttttctaatcaacatggacatcgtaaggcgtgcacagctcttctataatgatcatgtccgtactactaccacatgtttaaaaattgtgttccacaagagacaccaaaggaaccattccttgcggtccagacccgatggcgattaaagtattaaaccaagaaaattaaaccggtcagtgaacctagcatgtcttttggcttcattgtttggcttattcgtggaaatatttgtaaactagaagtaatttattaataaaacttttatatacgtgttctcaggggcataaaagtaaagactgaaaactaaactttgataagaaaacctcaaaaccaggtttaaatttaaggttaaaaatttaaattttggctgataagtataaacataaacgaaaaaagataggtcagtttgtttgatttgaagagaattaaacaaaattaagggagagtaattccatatcacaataaacgtataataacttccctccaatatacttttcttatgctctatttccaatcttgcaaggaccctaatgtaaaagtttgcgagacacaaaaaaaaaatattttctttaactttcccatctctttcacaaatcacacacacccctcttaggctcctcctcatcttcttctcccttctctcgtcccctcctcccttctctcctaccgagtccagtgtcgaatagctagaggcgccggccgccattgctggcccctgcacgcgccgccccccctgcgccacggccgtcgccgccggcgggaagtgtagctcgccgccgccactctgcgcgcacccccttcgccttgctccgcccgccgccgccgccgccgccgccgccgccgacgccgaggtcgctgccggtgcccccgcgcgtgccctagccactccccctgccgcctccgcctccacattgccccgcccgcagctgacggagtcgccgccgtcgccccccgcgcatctggcatcgaaggcctcccaccctccaccgacgtcgctcggcttcgcggggaccctccggagctgtggccacaggttcggcgagggcgctgctgttggttggacgagctcgttggtggcctgatctgctcagtggcggtgcggggaggcacgacaagatccccgccggccggatcaggtggagattggttagatcttttggttggcatccgcggttgttggtccactcggtgctagccttggtacgctgcctcaaagccttgctgcggctatggttttggcgtgagaagctcggtggaagatgtggaaagggttcctcagcaagctgccccggaagacctcggcctctgggaggggcgccgacctcgactccggccagtgcagcaatggcgctgggaatgggaacccgatacagcgcaccagcagctgcggcagcatcccatctggccgctccacttccaccatcaagcgcatgtcatccgccatcttcccgtccagcgtcgtggctggtattgagccacttgtctcgttcaaggatgtccccaactcggagaagcagaatctgttcgtcagcaagctgaatctgtgctgtgctgtctttgacttctcggatccgaacaagagctcggcggagaaggatatcaagaggcagacgttgttggatctcatagattacgtggattccagcagttcccgtttctccgaggcggtgattgctgctagctctaggatgtttgctgtcaacttgttccgggtgtttcctccaaattacaggtccagttcatctggcggcggcgagggtgaagaggaggagccaatgtttgagcctgcatggtgccatctgcagcttgtttatgagctgctactgaaatttattggatcctcgtccctcgatgcaaaggtagggaaaaagtactttgatcactccttcattgtgaaactgctgaatcttcttgattcagaggatccaagggaaagggattgtttgaaaactattctgcacaggatttatgggaagttcatggttcaccgtccttttatccggaaagcagtaagcaatatattctaccactttgtgtttgagactgaccggcataacggaattgctgagctgctggaggtatttggcagtgttattagtggctttgcgttgcctctgaaggaagaacacaaaatctttctttggagagttttggttcctttacacaaaccaaaatcagttggtgtgtatctccagcagttgacatattgtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattccagaaatgtatggtacctttgtttaggcggattgctcaatgcatcaagagctctcacttccaggtaacttgcccaaataaatataacctatcgatgtttattttctgtttttgccactatgcatttccctcacctaagaaaaataatatataggtggtaaaaataatatatcggagtactacatatgaaagtagttgtggccctgtttgattgatcaattgccacgctgatgaattactatactagtcgctaactctaccgcttcacctagacattttattatataggtggtaaaattttatgtaaacatcactcagttgaaatggatcatgatcgtaaagctcacatggtatatagggtttttttggttgcatcatttatgtaaggtatgaaagcattacctgttgacttgccaaatggatgagataatagatgtctgatggtccgaaataaatgtggacaacaatagtgggccattatgttatcaactaatcatgctttgggcatggggttgctctgtactgttaatatcacaaatgtgagatatttggaccagcattaagaattgaagacatttgtctgccatgacagactaatgctttttatccaagtaattgcctcaacgagatgggttttttcaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaaggcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactattttccccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctggtcatggttgctcaagcaacttctaatacgttgattcagtttggtagtatctcctaatgtggtattcttacaacctaaaagggcatctggtgtgcttgcaaataaaaattgtaagatgatctacgtaatgacccttgttgatttacatgccataaagcttccagtgtagcatttagctatttagctttgaagatttgttagtttacttggctacctgtgttttcttactgcctaaatgtgatcattcaatgtcttgtgtatttgaaaataaatacttcacttgaaatactgagatgcaaaagaagaatttgcaagataagaacatgaaaaagcctaaatgtgatcattcaatgtcttctgtatttggatataaattcttcacttgaatttcctgagatgcaaaaaatgaaaaaaagattccgttgccgggactcgaacccgggtctctcgggtgagagccgagtatcctaaccagctagactacaacggattattgagtattttttcatgtatagttatattcactaaggcacttcacaaacaactccgtaaaagttatttttctaccgaagtaaatgtaaatttcaatgatatggtataatttttacatattgccaataaattccaggagaaaaatcattgcatgcttccgtgttcaacagtgcatagcaggtagtacaacttgatcgctgatcacatgcagttagtgcatcacgtgtgcactacaatcattttttccactggggcagacgttggacgacaacctgcgaaaataaataataataataaaaccgtttaaatctcactgaaatcatggtgaataaatgcattttcgtgggccaaattttgggtgataagcatgagcgaaaagacccttcgttcttgtggtatacttgtagtcttgtactgatttattcacaaaaaaaaaagagacattttcataaggactcttttggagtagcataataatgagaatagttcaacgtgttaaggaacatgccttgccggaattttctttgtttccaacaatagtctgacaagcaagcctccatgactccggtttctggcatatagacaagaaatacaaatagcagtcaattggcagctgttttggtgtaatcagaaaagcatatagcaacagaaagttcagaaaacagggaagcccagaaacagcattgcccaactgaaaaaaacctgaaatggaatgcttggtaccttcttcagataccggttctcagtgtttgttctttcattcaggagctccttgccatcaactatctgtgtcacattgacaattccaagctgtggttaactaatccagctacagtttaaagttgcatagctaatatcctagtaaggtgaaatgtttcagagtcgttttcagaattcagaccatgaacacaccatttgcaggttcggccaagcatcgaattgaggcaagaactagagatgccattggttaggcaagagagagtagggtacctcgacgatgcaagtgccgcagctgccgccgccgccgcagttcatcaccttcccctgcaaaaacaacaaaacagcaatgcaactctctctgttacactgcagcttggctagaagcaacctgacaaagtgacaaccgtagcaaaaatcttcagagaaatcgaggcagggcgagagggaaactcacatatgccgcgtagagctcgatcttgttctcgaccatgacgtcccggaggagcttctcgccgctgcccgccgccgcccggtccaccgggaacgacccatcggcatccgccttcggctgcacatcacccaggccatcacacatcataagaaggcaaccccaaccttccccatggcggggacaaccagccagtgacttactccgacgaactcgaggtcgatttggggcttgggcggcggcgctgcctcctccgcggaggcggctccggcggacgcgttcggcgaggcggcgttggagcacctgatgcgggccgcccggaaggggccactgccagagctagccttgcggtggcctcgggtggagacgacgcgggaggaagggatggccagcgagaagagcgccgtggaggtggagctcgtggccgccatggctttccttccccttctcttttggcgagcacgtggcctcgaacgagacggtttttttttatcggcaggaggcgcgtccacggtggaagcctcgcgcgccacacggttggctgcgttgcgtcgcttctcgcgggcttctttccgttttctctagggcccaaaccaagacgaggcgggccgcatcgttgccgtgggccagcgcacgcgcgtcttcccgttgttgggccgcgtgcatgcgcgaattgagattggaaaaagtacaccgaaggtccctcaacttgtcaccaggatacaaaagcgtcctgaaccgcaaaatcagatatgcgaggtccctaaactacacaaaaccggtcacctgaggtctttggtggttttgactccggtagtcagcgtgggacccacatgtcagcgtgccacgtctatgtggcgttctcttctttttagttatctttgctgcgggggagtagcatcgggcggcgccgcgcggggctgagcggcggccggcggaggcggcgtgcgatgggcggctggcagagagcagatgggcgcggcgggcgtgggcagcggccggcgagggaggagctaccaccggcggcggcggcgtcaccgcgatcccacaccttacccctccacctccacctccgccgctgatgtagcaaacatgcgcacgccgcactccccccatacacaccccgaacgcggcgcccgacgccgccgaagacgacgcatgctgacgccgctgctgctgaagacgacgacgactatggcgacgggttcgaggaggaggaggacacgcacctccgttatggggatcgctggtatcaagcagcaagcatccatcgtcggcgagccaccgtccgtcggtcttgtcatcccatcagctctcccgtcagcaacaagcgcatcttcatcagcaagcagcgagcatatccagatccacaggcaagccgcaagatccaacgccaagctgttaaatccacagacaagaagcaagctagcagcaacaagtagcaagtgttagcttcagctataatcctgtgccatattatcggttactgtaacgcgtctagcgttgtcgtttcttcagtttcgtcagagtctgtttctctgttttttttctcatgtaagccgagtcttccgggtcgtgcgtcgtgtgcgagtcatccgggtttcagcgtcgtggtcgcgtcatcgtgaatgatggcgtagtggtgttaatttgagtctgtacaaattggctatatatatgagcatcagaaaagtcacagcgagtaagcggcaccaaaaactctgttcgtgttcatcgttcttccgagaccagtgaattcgcgtgagagagagatagtgagtttacacaaatcttgggcttggctttcatttggtatcaaagccatgtccgctcccaccggcggcacgtctcgtactccccggcgaacaggccatcggctctcgccgtctcctccacggccacgcaggcgacagctcgtcgtgcagcggatcgttaaggaaggcggctcggtctcctatccaacgctcacacgctcaaattactctgattgggcggtgttgatgcgagtcaatctccaggctcaaggtctatgggatgctgtcgacaccggcgatgtcccgtatcaggaggatcgccaggcactttcggccatcttgcgagcggtgccggctgagattgtccggccgctcgccgagaaggacagtgccaaagacgcctgggacgcgctcaaatccatgcgagtgggcgcagatcgtgttaaggagtcccgagcatagaagctgcgccaaacttttgagtccatgcgattcaagaatggcgaacacctggaggatttcagccttcgtctccagggtgttgtcagcgatcttcgtctccttggagatgatctgtctgaagagaaggttgttcgaaaaattgcttcgcgtcgttccccggaggtatcgccaaatggctctatcgattgaaaccttgattgatctgacctcgctttctattgaggatctgactggccggcttctcaccgtcgacgatcaccccgactctgacggcgaggacgcgggtcaggcgctcttcagcgaaaaggaggcctcttctcactcaaacaaggaagctgggcataactcagccggggggagcgcgtccagctcgcggcaaccacaccgcagtgggcgcaggcgcgacggcaacggctccgacggcaagtcgggttcgtcccaagcggcgagccgcaatgtgtccaaggacaaatgccgttactgtggcaaacttggtcactgggccaaggactgtcgcaaggcgaagcgagaccgcgagaagctggctcaagcaaatcttctcatcgctgagccagctcaccccgcggacgaaggggagccgacactcctgatggcgcaagtgtgcgagcttgcccctgctaccgattctgtcattactgatggggaggtgacactgaacgaggaacgtgctcacgtttctcttcgtgatgaaggagagcccattgatccagactgaatccttgacacgggcgcttcaaatcacatgacgggctcccgtgatgccttctccgagcttgacaccaccgtgcgcggcactgtcaagtttggtgatgcgtcgagagtccggattaaaggacgaggcacggtgctgttcgcctgcaagaacggcgatcactgcgcactcacaggtgtctattacatccccaatcttcggagcaacatggtcagccttggccagcttgatgaggcacgttgcaagacggtgatcgaggatggcgttctcactctgcgtgattcacagcgacggctgctgtgtagggtgcgccgaggaactgggtgcctctatgttctccacgtcgagctggcgcaaccggtttcccttctcgcaaaggggaacgatcaagcctgggtctggcacgccagatacgggcacctcaacttcgacgcactccgctcactggcgagccgcggcatggcgcgcgacattcccactctggagcgggtcacccaggtctgcgatggctgtctaataggcaaacagcgacgagcgccgttcccaacagcggcgttgcatcgcgccactggtcgtcttgatctggtgcacggggacatctgtggacccatcacgccgtcgacacatggcggtaaaaaatatttccttcttctgattgatgatctaactcgctacatgtggctgtttctgctaacatcaaaaagcgaggctcccgctacaatcaagcggttctaggcaggagtggaggtggagaccggctgcaagctgcgcgttctccgcactgatcgaggaggcgaattcacctctgtcgagttcgggctatactgcgcgaacgaaggcgtcgctaggcagttgatggcgccgtactctccacagcaaaacggcgtcgtcgagcgccgcaaccagacggttgtggcaatggccagatgcatgatgaaggccaagaacatgccgggggagttctggggcgaggcggtcacaactgccgtctacatcctcaaccaggcgccgacaaagagcgtccgcgacaaaacaccattcgaggcgtggcacggtcgtacacctgctgtgcactactttcgcacatttggctgcatagtctacgtcaaggaggtgaaaccacacatcaacaaacttgatgatcggagcaaggcgatggtctttctcggctacgagccgggttccaaggcgtatcgtatctacgacccggtggccaagcgcatcgtcgtgagccacgatgccgtgtttgacaaggcagcgtcgtggccatgggcgtcacccggggaggaggatggggtggcgtcttctcaggaaaccttcaccgttcgctacgaggtagcggcggtggaagtgccgtcccgccactccgactccatgtcgtcgccggctcactcgggaccaccggcgccatcaatctctgcatcaccgggcgtcccagcggtcgagttcgtgtcgccgcctgcggaaacgcctgatgtcgacgacgacaacgtagggccacgtcgtttccggacggtggctaacatcctcgacactacctcgccaattgagctcgattccgacgagcttcatctggctgctgccgaggaaccaagtaaccacactgaggcggcacaggacacactctggcagcgagcgatgcaggaggaactaaagtccatcgtggagaacaacacgtggactctcgctgacctccctgctggcaagcgtcccattggcttgaagtgggtgttcaagctcaagaaggacgagacgggcgtaattgtcaagcacaaggcccgactggtcgctaagggttacgttcagcagcaggggattgatttcgacgaagtattcgcccctgtcgccagaatggaatccgtgcggttgctactcgccattgcagctcaccttgggtggtttgtgcatcacatggacgtgaagtcagccttcctgaacggagagctggaggaggaggtgtatgtcgcccagccaccaggtttcgtcgacgacaagcacccacatcaagtcctgcgcctgaacagagcactttatggcctgcgtcaagctcctcgtgcctggaacgcgaagctggatgttagtcttcatgaactcgggttcacgcggggcatcacagaacatgctgtgtacacgcgcgggaccgggaacgcgcggctaatcgtcggcgtctacgtcgacgatctcatcatcaccggcgctcactctgaaacaattcaaagtttcaagggggagatgcactccctattccggatgagtgatcttggattactcagctactacctcggcattgaggttcatcaaggcaacgatgggatcacaataaatcaatccacttacgcgcagaagctcttgaagatgggtggcctggcgggatgcaattcagcttgcgttccaatggaacccagattgaaactgacgaagaatagcgatcgaccaagtgttgattcaaccttttatcgcagcttagtggggagtctgcggtacttggtgcattcacggccggacattgctttcgctgtgggctacttcagccgtttcatggagtcgccgcgcgatgatcatctcacggcggtgaagcacattctgcgctatgttgcaggtactgtgaactacggttgcaagtttgcacattcaggagaagaggggatccatttgctgggattttccgacagtgatttggggggagatgtggacgatcggaagagtacctctggtgctctcttcttcctcggctcaagcccggttgcatggcagtcccagaagtagaaagtggtcgctcttgcctcctgtgaggctgaatacatcgccgccactggagcggcgtgcctcggcatatggctagctcgattgctggctgaagtgctgggaagtgatccggggaaggctctcctcaaggtcgacaacaagtcggctatctccctgtgcaagaatctggttttccatgaccggagtaaacacatcgatacaaggtatcattttatcaggcaatgcattgaggaaaaaaaggttgaggtggagttcgttccttcggacgagcaggttgccgacattctcacgaagccactcggacgaatcaagtttcaagagtttcgcagtaaggcgggcgtcgtgcagattgtcacccggcgacaagattagggggagtttgttagcttcagctataatcctgtgccatattatcggttactgtaacgcgtctagcgttgtcgtttcttcagtttcgtgagagtctgtttctctgttttttttttcatgtaagccgagtcttccgggtcgtgcgtcgtgtgcgagtcatccgggtttcagcgtcatggtcgcgtcgtcgtgaatgatggcgtagtggtgtcagtttgagtctgtacaaattggctatatatatgagcatcagaaaagtcgcagcgagtaagcggcaccaaaaactctgttcgtgttcatcgttcttccgagatcagtgaattcgtgtgagagagagatagtgagtttacacaaatcttaggcttggctttcagcaagctcccgctgtcgtcgtccatcaccacaagcagcagcaagttgtatacgccctcctgttcgtcttcaacagcatcagcaagtcggggcccccaggccgccgtcgatcgctgtacgccccgcgccgatctccgcccgcatgcgccgtcgccccgccagtttcggagttcggacgcgtcggcactccgcccgccgtcgcccctcttcgcccgcatgcgccattgccccactccgcccgttgccgccccgccggcttcgcgcgcgtcgctgctccgcccgccgtcgccccgcttcgccctccgtccaagatggactgtttcttgtcctccgtttgcacgccacttaatctctaggtacacatcgatgatatagatagatgctgctctgtgtggttgaggtgattttgatctttggttggatgcttgatgtgctcagttcatcgacgtggcgtcaaggtggagcgggcgaccacgacggcggcggcggcaaaggggggcgccgctggggaggatatcgcacgccggggcaggaggcggtggtggtggcgcgcaggaggagaggacgatactgaaggggataaccgacaaggtgaggccgtgggaggtgctggctgtactgggaccatcggggagaggcaagtcgacgctggtctccatcctcggcgggcggctcgccggccggcacgccgggatggtgctggcaggcgggcgcgcgccgtgccgtgccgtgcagcggcgcgcggggttcgtggcgcaggacgacgtgctccacccccacctcaccgtctgcgagacgctcctcttctgcgccatgctccgcctcccgacctccgcgcccgccaccgccgaggccgccaccgccgaggccgtcatctccgagctcggcctcgcgtcgtgcgccgacaccatcgtcggcaacgcgttcgtccgcggcgtcgcctcttctgcgccatgctccgcctcccggccgccgcgcgctcgcacgccgcctccgccggccgccgctcagcacgctgggcgccgcccgttgctactccccgcagcaaagagaactaaaaaaaagagagaaaaaagaaaggggaaatttgacgtggcacgctgacatgtgggtcccacgctgactcagccgccacatagaccaagatcggtgttaaaaccaccgaaggaccttaggtgaccggttttgtatagttaagggacctcgcatatctggttttgcggttcgagcctccacatagaccaaaatcggtgttaaaaccaccgaaggaccttgggtgaccggttttgtatagttaagggacctcgcatatctggttttgcggttcgaggacgtattttatcccgatgacaagttgagggaccttcggtgtactttttccaattgagatgggatggtttgggccggttcttccagcccattcagatcgagttgcattgaccaaacccccgatgggactagctaatcgtttcaaattcagcggcatttgtgcctacctgagtgctaagtatatggtgattctctgaagatactccaagatattcttctcggcaatcgctgcctgagaaatatcttcatgtcagctagtggcagcgaagagcacattgcatggcgtcatggcgatgttgatatgaggcaagcttaccacttgctgcatggcactatgctatattgctatgccatctactggcactgtaacacggtgtctttttgtcacaaacgacattgatcccaacctgaacaatgctagctgcgagcctgcggcgttggccagcatcaggccggagatgatgcacatatatggaacaatccattgatgatgtgcacgtgtttgtctgcaaccttgcgccagtgttctgggtgacggttgtacatgcatatggtcgatcgagccggccagaggtggtgaatcttgaagatatttggtgatccgatccgatccaatgcagacacttttcatcttatcatcatgttctaatacattgacgtgtaatccttttaacgtgttcgcgaaatcttcatcatcatggggtgcctaattcgatcatgccgcgtaatttatcaaaacttctacaatattgttcaggacaattctcaactgatcgatttcaatggaacatatacatgcatgcatgctaaactagctaaagtaaccaacatctcatcatctagctagattcttcttcctcttcttctgaaggatcatcatcatcatctggattctggatggggaagaagatcacttcctgctcctgcatgcatggatcaaaatatcctgcagggttatggataaactcgaggcaatgactggctgttgcgtagccaattgtcgcagcagccaccactgtccactgctgacacgaccggccggtgttgggtaccaacgacagcagatgattgtaccaccacattggttgccatcagttcagtgcattctctcgtcaacctggcctctctttcacaggcagcacaccgaatcgcccagcaactagcacaccggaaagaaactaacttaaccttcagtaggagtcatgcattgacgtcgcccttgatcgctagagctagctgcaactcaaggagaaatggaacacctcaagcagcttttgtagaaccaatcaatatataattgtgatcagtttggatgtaattgcgagccagggcataaacgtcgccgcacactaatacactatcatattctaatgcaggagttgcagaatattaacccattgatgccaacttggattattctgtaagtaatatgcacgcatgaacgtgtgttagttttgtaaccatgtcatgtcatgtcatttaaagtccaaattaacaatgtgtgacgcatcaaaaaaaaaaaacaatgtgtgattccttcgctatatttgtgggcggacgcaggctagtcgaaaccgtgaagggatcaactgatggcgaagttttagatcagtggatatttgcatgattaattagttactcgatctgacgacctgactttgtcgttgcaaaggttgcagtagaacggactaatttttttctctctttttttaaggaagaaaatctgggctggatgatacgtacactatatccactttactttttgttatggccggaccttgaatctatgggaagattttgtagctgcagccaactgtttaagcaatgagatacttgtctggtggttgcccactcagacgtgtccaaagatgaaaatgatatgggatttcatggcatcttctcgatcctaatatattgacaggccaagctttaatgtgatcgtgaaaattaaaagatatagaatattgtagctcgatcaactataaatgagttgtcaaggctcaacaataggctgacatggaaagggatcatctaacttaattattatgctgttaagtcactgccatgtgagccgtaaaaaagtgaaacccacatgttaattattgggggagtatctccggatcaaaggaagctagcctccgaagggctgcagcgctccggagaaccatcctccccgggagatgaccgtgagtcatggccatgtcggtctgcagatggcccctcactccggaagcctcggggatccgattcggatcccacagtgcgagaggagcaggacctaagcaggctccggatgatggccgcccggctccgggaaagctccgggaggtcatagcaccatgggctccggtaccaccaaaggtgactgggctccgaagcccagaggggttcccaaagtctggaaggagagctccggaggctaccttagggcgtgggagctccgaggggcccctaaagcccgatatgccggccggagcggatcatatctcatgtgctctcacaagacaagccaagaaccaggcgctagtggacgtgaataaatgcgtactacgcgccccaactaactctgacactgttgatggctgccaagcggagcacgctattacccaggggatgcctttacccgggtaatagcgaggtcgctcggaaacagcggtgcccccatgctgggggcagcactcctgtcctctgtcaaattaccgctaggaccaaggtgggcccaccggtaagtcgcataggcatatcataaggatagggacactgaggccttttcctcttatgtatccatgtaaataaatacttcctccgtcccataatacttgtctttctagcatttaaaaattgtcccaaaatagttgtcattttgaagtactacatgtcacatcaaccatttccaattcaaatttctccccattctacccctaaccaccattccacatccaactatccattattaattaaggggtattatagtatttttcttcaaaatattagtatatgctaaacaacctataacgacaagtattttgggacggaggtaggatgtaaatatcacccatagagggcagattgaatacatgagagaaattgagacacttgttgaattcttgcaacaacattaatgactcaactatatatatgtgtctcagactcgttcggtctaacgtatatatctagtggtatttttcaaactctgaaacttctatggtggtgtttatgcccgaatgtctttatttccttgtttttctcatttatgatcatgtatattttagcagttttaaattacttcccattttagattttccataagttaaacatgtctatctttgactaccaacatctacaaatctaaaaaaaaatagtttgacaacatgtgaagtatatattatgaaatttttttcaaggtgaatctaaaagcatactcctaaatcttatgatgttaaattatataattttttagaaaccggtagtcaaaataaatatttgacttaagatatataggtaaaactataacaagaagtaatttgaaacaatttttttggattgatcctatatatctatgtgcagtaaatgtatactctgtatatgatcgattgactatttgacttgtaagaggatgtatatacccctatatatctacttgtgaattatactctatctattgactacagtgtctcgaaaaaatgtcatgcatgcatagacatgaccactagataatggtggaaaactggaaataaatcagttaatactgccatttatgaggcttatgtgattagaggacgcgtctgagaagatagcgcgattatgacatgctgatgaagagagatgcggcatttagcaggcgatttgtacttccttccaatccacgtacccaatagataagacgttgctgaatgctgatcagcaccgggcggattgtccaattaattgtcctcttttggctttcatgttcaggttgggtaacactaggaaacttaaagaaataatctggaccggtgatcccgaagatcacagtacgtacatcctccgataattttctgaatcgtagttaaacatgcgaaaataattgtaaatcaaaaacagaactcgaacttcagaaccagcaatgttataactcaactgttcaatcaaagaataggttgaaaatgacaaactgatcgagcatcataaggattttgacatatgcatgtgtttattggtatttccagtgatcagatacaagagaagtcattgcctcattggcatctagagttgaaaattttaatgttgaatacgtctagagaggaaattgcattcttacttctattatctaaaaaacatctgctaagttgacaatgacgatagctacattttccgtttgggatgtgattatatatatgtgcatatgcagagaaaaacctctatgttcttaccacacttattgtcatttttcctgtggacaaatctacccattggttctggagccattagtcgggttcgatgatctgtatcgtgatataaacaaacgagagaaaaattataaatagaatggtacatgagtcatctgaattactccctccgttttaaaatgtttgacaccgttgactttttagcatatgtttgaccgttcgtcttattaaaaaaaattatgaaatatgtaaaactatatgtgtacatgaaagtatatttaacaatgaatcaaatgataggaaaagaattaataattacttaaaatttttaaataagacgaatggtcaaacatgtactaaaaagtcaactatgtcaaatattttgaaacggagggagtatttaactttcatctttgtaggttgacgacatctatatctagtttctgaaatgttcagaactaggagcacccctgcacttggtttctcaggctaaatcctttgttctgtagcgtttcagagtatgatctcacgagtagcatcgtgcacatatataaagtagtaacatgtttatgatttttaatttttgcagagatcagattcctggtcccattcttgccgtgcttgacacatactcttctggaggcagcggattcctgtgtagctaggtaggctgacctgaatataccagtggatacgtgcagacaacgagcaatatattaatcgtgatagtggcaaattcaacgctttcacctctcactaatcgcagttgcaacccttcaaatccctttcgttcacgtcaactctttgggtgctactagtggtcgagaataaggggatttaagccaaccttgcttggtcaattttgtggatcacggtaatgcgattggttgactacttaagcagttgtggatacgtcttggtaactatcatgtgtaaataaagttaattacttcattaccgacgaactaataatcaaggtgtagcttgcaattgttaaggcttaaattatgtgcaactgattaattgacatactaattctttgtgctcggtagcatgattaatcacattgattcgagcccagaaattattgaagacctctctctatcttcccttttattttatttttaaaaagaagcaaattcttgaacttctcatcttaggctttggtttagcattcaattttgcagagaagcgttgttttgtccatagaaatttgtcatgaatcattgtctttccgttgtcacaagccgttgttgtaatctgcaaggagatatccttgataggacagtaacaaggggtatatagggcatgtttagattgatgcccaaccaaaattttggtagtgtcaaattttgggcaagttttggtactatcaaaattttagtagggtagagttgaaaatgtttatttggattgaagccaaaatttgcccataagagacaagttcataggcaaagccaaatttatggcactggtagagttttagtagagatgtttggtttgctaccctaccaaaattttggtagggcaaattttggtagggtagcaatttaaattggcccataattttaacttcgagatcttgtatttaatccctaactcgctacaatttatacttaaaaagtatttagaagtacgactctcctccaaaatctcctcctgtttttgttgtcgcctgcacgagtgcacgtgtcagcttgctggtgcaagcgatcaatcggtgaccgcctgaccagccggatcgagatcgatcagatcaggcgccgcttgcgcctcagctcgagccgagcggatagcggcgttgtcctacgtgcaaatggcgctacgcgctaatgaacaaagaacccaacaaatccaacgcgacagccggatcgatcgccgttaaacttgtggatcgataagatgatgatgatgagaaaaggtgaaaaacaactgggtttcgccgcctaattgagcgcgcggctttggctccccgcgcccgctcgcctcatcggcatcgccgcatcgccggctgtgcctcgctgtcgccgtggcccccgccagccgctccccgtttccgcacgtcgctctcggctcgctgcagctgagctaaaagattctgctttagctgcgtcggattacgggctttgcggtttgcgatcaacaccctctgaagatgtaaattatcgcgcattttgcccatagttttttttcctcttgtgagggttgatggaagattgtgagcttttgaagtctacattgtgtaatcttcatataactgtcatgcagttctttgtaactttggatgacagtatagaaatatggttcaataattatgtgctttttatcttgtgttgatgttcattcctttgtgtttgctttaattatgggagtgttttttaagtttactttgagatacactcgcttcaagtaatttgatgtaataattggctgtaactcgctaggtaaaggccgggatgattttatattccataattagaaaaaaaaacttttttcaccacctgcagactgcagttacatttcctaccaaaatgcatgccatttgataaaattcttagttataataaatttaggacggaggagtataatttatagcatactgtagaaattttttcaaattatgatatgtccctggaagtatttgctgtaaaacattggagtcccccctcccggccatgttgctttagaaaaaaaaacattgatgccacctacaaggctacaacaagaatcaacgaagaatcagagggagaaaaaaaaagaagtccaagaaaataccacacgaaaatctacgggaagatagggggtggtagcggctattgcgggtcccacacaaaataaccctataaaaatgagggcgcgtgctgctctgtagaacttcagagcagagagagaagaagcgatacacactacactaccacgaggtggagaggcgaagaagccgagcgatcggagaggggagaaagcggccggcgagccgcagttcgccggcgatctccatccatccgaggtgaagaggaaacgacagttcaaatcttccacagaatcgtgaggtataggaatctcagctttgtttgtttttacggcgtgatctgcttctactacgtgtgttcgtctccttttctgttcctcttttcccggtagatttctcggtttatccgaggagttgttggtcacttttagttatccgtaatacggagtagtacttatcttggttttatctaagatgggtagaactagacaattctgaactttctgcaagctaatgtgcagttctatattttaaaaaaaattctaatatttttttataatttaattaactacctttgttattatctctaacgttttctgttgcatttgcaaattttgtgtgcagatttaaaatagcagttctactctactagtagcggaggcattcgttcccgcgcgggcaatgtcggcggcgcagggccttgcgctgaagctgcgcgccgcgccggcggcgggtggcgtccgcggggagaagcggcgccgcgcggcatcggcgaccgcggcggcggcggcgcggcctcgccacggcgccatgtcgctggagggcgggttcctcggcggcgcgctccccgccgaggaccgggtggcgccgcgggcatcggcgtcgcgccaggcagaggcgggggctggggcgggggcggcgcgtcctcctcccaggtcgatgtcgaagatccccgagagcagcattgggctgtacgacccctccatggagcgcgactcctgcggcgtcggcttcatcgccgagctctccggcgagtacagccgcaaaacggtgaggtttccgcggctaagcacggcgctggagttgattgttcccgtgcaaacaatcgaaacccccaacgcggcgtgaatttctgatattctgaaattgttctcggttttgcaggtcgacgacgccatagagatgctcgatagaatggctcaccgtggcgcctgcggctgcgagaagaacaccggagatggcgcaggcatcctcgtcgctctgccgcacaacttcttcagagaggcaaacctacttgaagttttaagccgagaaatatgggaattttctaccgctgggggaatcatttttttttctgcctgtttttgtttttttgtgttctgacaggtcacgaaggacgcaggttttgagcttccgccgcctggtgagtacgccgtcgggatgtttttcatgcccacagatgacaaacgccgtgaaaagagcaagcttttgtttcgtgaggttggtgaccaagcagaacactagaacagttcagttcaatcctattgtaactgatatcatgataccattctcaatttcgtgttgtatctttggatttgtttgggttcatgcagaaagcagagttgctggggcataccgtcctcggctggcgccgggttcccacagacaactcgggcttgggtcaatcagcggtagatacagaaccagtgattgagcaagtgtttgtcaccaaaagtgcaagttcaaaggctgattttgagcggcaggttatttgatgagccagcacatttgaactttatggatttcatccgtagctgttaatttttccttgacttgttcttttgttgactgcaactccagatgtacgtcctacggaggttctcagttatgtccatacgagaagttctaggcgtcaagaatggcggaacaaaagatttctacatgtgctctctatcttcaaggttctgtgttaccatcccattaaagaatgtggtttaagtttccaaccttgggtaatttgaagcgctagccactaaggatttcagttatctgtattaagcaacagtaagctgtgatatggaataaaaaaaaacatgtttcagaaatgcttcattttgataacaaggaatagaagaaaacttttggatgtttttttttcctttgtgatttgatctcatctgaagtgaagtttgatttggtcacatgtgcatgcattccattttctgccaagtaattatttcctgaaattcggttttttacaggaccattgtttataagggtcagcttaagccaagccaactcaaggggtacttctttgcagacttaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41114 - DNA, 1803 bp, Oryza sativa
ttcctttatgagtacagagggagtattatttgtctctgtcctatctatatggattattttgatatatacattgttgttgccattacaatataaatacacgctgatacctttttcatgaaaaatttgatgacacagaagtccgtttgtaagctctcactccttctgtctcgctgagctgggctggcggttttctcctcaactatgcggcggtcatgcctctgttccgcgcgaaaacagagtgcaagttgccacgggctgcacacgaaagcggagacgaccactcggttttggaggtgggaacagcagagacccactggaggcatccaccaatctgtggtgttggtaacaccgtaagtactcctacgtaacaatgacagaaatgagcgtggcaaatccgtgggccgaacggctggagatggcagcacggaccgggacttgtgctatcatccaaagtctaggtttaatgtgttggcaagtgtgtataggaatgaacagttgtcgctgtccagaacaatgagttgacgttcacttttcaagacattaaacgtgtaatgagtaatcagggcgctctatcgtgcgagggttaagtattaacaagtcaaattcaatgatgaccttcatcaacgttaaaaactggataagttaactagctggccattgtcagcccagcagttgtgccagtagatcagatactgccaatatgtagaagcgtgtgtttatactacgtcgtacaattgctcgtatatatatatcttgagcagcccatcgttttacaatttaatatgttgatgaagtacaatactctctcaatcctaatataaatataactttgtattgatgtgactgtatgctcagatttataactatagaatataccatatttgtacaaggtaaggtttcacttgtattgagacggagggagttggagggagtagagttcaactactttagtaggtaaaactataagaataatatgtaggcctagaatgagataagttcatggggaaggattgggatcctttgcattagagtacaaaaatttgcaccatccattcacaatcaattcactaaacgaagcattttcgagacttccgcgaaagtcttcttttagcttgagttcatcggcctgttggcgtcccattttttttccgcttattactatcttctgaattaggtagagtgggagcactcgacgaggcatctacgacagtagaggctcttcctcgtttttggccggacaattctataaatagaatcaaaaaccagaagaattgtgagaaataaatcaatttattaagttgagacacatcgagggataaaacatttcatactatcataagttgattccatttacaattgaatttttttttctttttatgtgagtaaattttattttgggccatgtatttttacccatgttgcagcttgggctaggttttagctgagtttttcaccttggatcacttaatataaccatttgtttcatcctggaccatagccgctcatcttctccgagtccaacaggcgataacccatcaccaacgtgcccatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattact

SEQ ID NO: 41115 - DNA, 727 bp, Oryza sativa
tcctgcagcccttgctgcatgcatgcacttcgccactcctgtcgtcggccatccatgctttgtggcatgaggtgccatacaatttatttccgagatcgcgcggaggggactgggctttggtcaatcgcgagatcgcgagtaatcctagtcgcgtgcgagatcatgactgagcccgttcgtgaggctatataaggcgcagcgatatgatatctaacgaaggacacagtgctgcagacgcacacagagctgttcctctctcagcgccggcggcattagcttttcgctcaactaggcaacggcagcgagcagcaacgattggtgacaggtacaagcacttgtacagtgcgtataaactatacgagcacaggtaaaattttttgctagcaaccatgtttttgctttgttgaattttttttttatgtttttggtctcacaatgtttttatggaataaaaaacataattcgatatgatgaataaatatttggaaaaacggaaggcctagctaatgctctacacgaccgtgtcatcaatctgcagattaatatctagacgaccctcaatgttatgattttttccggtcaatgacatttttctttaatttgatctgacaacgtcgcaaggggaaaaacttaatttgttgtgatgaataatggtttgacagttgatttgatccaagatgagtcgtcctcgctcctcgtttcagcggcttgtggatgaatcatcgtc

SEQ ID NO: 41116 - DNA, 1920 bp, Oryza sativa
aaaaaccaacatactgctagatgtgatacattctaatacaacgaatctagatatacatatgtccagatttgttgtattagaatatatcacatctagttctagatttattttttttgacggatggagtaatgtaaaagaaaaataactgatccaatcaaatagatgtgtccaatctcggggtttttaactatttaccactcttacggagtggcatactgagatgccactcttccaaattttgttacacaaacactacatgagagaggtattttcctaattaaagtgccatatcagccagagagacttaaaataacctttttacccctagtttaagaaatatgagaaattatatacaaacatatataagaaaatattatttaggagtatatcttaaaaaaaagagttatcatgggcaaatataggtcgaacaagttcaccataatttataatagattcaacatagggtgaacttgtttaatatatatttgtccgtgataactctttttgagatataatatagtacgtacttactacgttgaatctattattaaattgtagtgaacgtgtccgacgtatattgcttgtgataactcttttttaatacaatatactgtattgaatctattattaaatttggtgaacttgatcaacgtatatttgctcgtgataaatattttttgagatataatatactatgctaaatctattattaaattgtggtgaacttgttcagcgtttatttgcccgtgatagctcttttctaagatataataaacaatattttcttatattgtttgtatatatctctcatatttctcaaattaggggtaaaaaggtcattccaagtccctcttgttgacgtggcactctagttaggaaaaatacctctcttatgtggggtttgtgtaaaaaagtttggaagagtagcatctcaatagtgccactccgtaagagtggcaaatagttaaaaagaacctcaatctccccgtgataaacccagccaaacacgacacgcagaactaaaataaaacacaaggtacaaacaaatccactcaaaagaaaaaagaaagaaaaaacagggtacaaatccgctgctaaacacacagggttttagcagagcttgtgttgtgttgctcatccgacacccaatcccagacggctctgctctgtgtctgtctcctccgctaccttttgcgttttcccccctccaactcctctctatttccttcgaagcccctcgttcccctctctctctctcctccacctcgctcccacctcctcctcctcggctttgctgatccaggacgagccaatcgagctcgccgacgggcggagccaccaccaccaccacccatccccggcgccgccatgctggcttccgcgaggtgagggtttcttgggggggatatgtcggactcctccttttgctttgctcttgaggtgttcggcgaattgcttgggtgggatgggtgattgattgattgatttgatttgattcgctggtgggggatttgtgttgcagggggttctgggggcggcaccggcggaagatactggtctcgctcggggtcgccggcgccggctacgccgcgtacaggtacttggactcgcaccggaggcagctcgtccgggtggagcagcgcgcgctggaggagcgcgccgccgaggagatcatcaagaaccagtaagatgctcgcggcctcgtcgcctccgtcttacttgctacctacttgagtggggtttaatcggggggtttcttcttcttgcattgctatcatgctgtgttcgtctttgatgggtagcctagcaacagcaaagttgggggtttgagggtaggattatagattctacggttggggtttgaggaaaaaatagaaaccttttgtggtgcgcctattgttctaattgcaggggattagt

SEQ ID NO: 41117 - DNA, 715 bp, Oryza sativa
ttatccaatgttagtttctaggtttgtacactatataaactttacagtatatattttcgaagagttttttctaaagaacagatccgatataggacttcttcgcaaaatacccccatccttcctgcaaacagatgggacaggattgccatagctagagcaaagaggaaccacagtactaaggccatggccagcggcgatgcgggaagatggcccctcggccagcaagaggaccctcattaccggcgacacctgcggctagggtttgaatttcgttgcaaaatttctgaaatttcgttaattttgccctcccaccggcaagctcatatctcgcccgaaattttcgtttttttacaatttttttgtgaatttgtcaaattgtattcaaattcattcaaaatcagttaaacttttaaataatttcggtcaaaaaaattcgaaatttctaaaatttcagtgtcctcgacagaaatagcaatttcgaaatttaaaaccctgccgcggcatcggatactcaccccaacacacttatccccttctcgctggctagggagacctccgccgcggagccttctgttgcttctacgatcaacgcggggaattcatgcgcaggcgtgcggtggtggacgagctggcggcgctgggggcggccgtgcatacctgctccaggaacgaggccgagctgggcgagcgcctcagggagtgggagggcaggggg

SEQ ID NO: 41118 - DNA, 716 bp, Oryza sativa
ttgattgtttgtagctccttacctttcaagtggaaacatccaacggaattgcacaggaccaccaagtcgagcctcataaggtaaatgcatcatcaaatgttgcatggagttgaaaaaaccaggaggaaatatcttctccaatttgcagatcagaataggtatgttctgttccaacctatatacattttccttattaagctctctggcacataattgtctataaaagaagcttaactccgccaaagtcacccatatactctcaggaaggaagccacggaatgctgcaggtagcaaacgctccataaatatgtgataatcatggcttttcatgccaaaaatctttttctgtgccaaattcaccccacggctaatattggctgcatatccatcagggaatttcagttctttaaaccacttgagaatggtgaccttatcattcttatcaatacaataagatgcctttggcttatgccacttgccattagcttttagttccaaatgcagccatggtcgatggcaaatctcctctaaatcttgtcttgccttcacattgtcattggtcttatcagcgatgtcaaagcaagtattccaaatagcttcagcaacatttttctcattgtgcatgacatcaatattgtggcgaagcatcaatttgctgaagtaaggaagtctccaaaaacatgatatatgtctccaattgtgctttttcccataat

SEQ ID NO: 41119 - DNA, 719 bp, Oryza sativa
atctttgttctgattcctgtgcatgaattgcttatggtagcctctagacaaatttcattaggatgtgtcaattttgactgctacttcttcagatatcatcagttagaaaagaggattgatcttgcacatttcattactagtgcttaccttccatcaacttctcaatgatgaaacccgcaaataaagaaaaacttgacattccgaggaattagccaaatgctggtgtacatggttagaaggacaaattgttgtaatatgcccttttttttctatgatattttgcaacatgcgaaatattttcatagaaattagcactgaaatattgaaatgcccatcacagcacaagtaaaagaaagaccatgtttaattgaataccatcacaagacagaatcaagaagtgccagtaactattatctatccaatagaaacaataagagaaatccatgttcaatgatcagttttgtcagctatgatatgtccatactccataccagcagtgtattacaagtttacaattggaataagccattccacgaaaaaaacaacagcagtgctatttgtattcagtattcctgaagaaattgggtgacacaaggaagttgcttctagattaacattgtgatttgttgcagggattcacactacacaaaagcctatttcaagattaaaggatctctgaatgtaaatctaagcatgcaagtcaagcattggagctttta

SEQ ID NO: 41120 - DNA, 731 bp, Oryza sativa
tcctgcagccctgcttgatgggtgccttacatttaagaagagaagattgaaggaacatgaatatgaaacttgtaaagctggtgctgtaaggcttatttctatagttgccatgggtggaatggggaagacaacactagctaggctcgtctataatgacgcaaggttcaaaatcactttgatatacaagcatgggtttgggtttcagaagtattcgatgaagtcagactaaccaaagcagcaatcgagtcggtcaccgctaaaccctgtgatctgactgagctagagccactccagaggcaattgcacgaggaggtcaagggtaagaagatattgcttgtgtttgacgatgtttggaatgaggacaccatcaaatgggagacgatgaaacggccattttctgctgttgctacagggagccacatgatcatcactactcgcaacgagaatgtctccacaattgtgcaggcgaagaaggtaattcatctaggtgggttgcaaaaagatgacagttgggcgttgttctgtaaattgtcattccctgacaatgcttgtagagaaacagagttgggaccaatcgggcggaaaatagtagaaaagagtgatggagtgccactagtcctgaagactctaggtgcaatgttatctttagacacaagcttggagttctggaattatgtactgacaagtgatctctgggagctgggccctggatgggaccacatccttccaat

SEQ ID NO: 41121 - DNA, 1685 bp, Oryza sativa
ccccatgatgaggttgtactggaatccctgcagcctcacaactacatccgacaactcgtaataagtggttttagaggattgaacttctgttcatggctaggagaccggtccttgtttagtttacaagaactggagctgtgcaagtgctactacactgatcatctaccaccacttggacaattgccaaacctgaagcagctcaagctgacgagcctgtggaaattgagaagcatagggcctgagttctacggcgattgcgaggccccatttcagtgtcttgagacattggtggtacagaacctggttgcatgggaggaatggtggctacctgaaaaccatccacattgtgtcttccctctccttcgtacgatcgacatcaggggctcacacaagcttgtgcgccttccactgtcaaatctccatgcccttgcagggatcaccgtatcatcgtgcagcaagttagagaccatagttgggctcaggagcgctgtgaagtgactgctgggaacggtggattgcaagcaggtcagactaacgtgcttccctcccttcgaagggtaaagatcactgcttgcccttcactggaggagcctctgatatcgatgcttcgccggcagacggagatcggcttctcctactgggaacaaagccccagcacctctcccaccgacatcgctgattttggcaagactccatggaaagattctggcaaggatagtacctcatgtggatgtggatttctgtttggtaccagatgctcctcttcatggcacacaccatcctatgcatgtaatgtaggaataagtcttggctggttgtccttggtcttgtggtgccttttttcctgtttttcagctttctaggacagcatctttactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgcctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagg

SEQ ID NO: 41122 - DNA, 713 bp, Oryza sativa
ttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgacgattcgggatcgccgtcgtcgccttcttgccaaggtaaccagaggcactaatcgactctacatcctcagcg

SEQ ID NO: 41123 - DNA, 954 bp, Oryza sativa
cttgcttacactccagtggcgggtggaggagatgccattcccgctccccggcgatcttctccggcggatcgaggcggcggcggtgaactccggcgcgtccgggttgaggcgctccgagacgacgacgacgagctcctccggcgcgccgtcgtggccgtcgccgtagccgtagccgtagccggtgagaccatcaacgcctcgccagaacccctcgtagacgaactccggcgcgtccgcggagagcttcgtcctcctggcggcgtcgcgtcgtcggcggcggcggcgtggcggtgccaccgcggcacgaactccttcgcgttcgggttgaggctgcgccccgccgccgccaccaccaccctcgaagtcctcgcctcctccgctcccatcacctccatacggtctccgactctccgtccggctgcggctgcggcggcggcgatcggcggcggcgacgaggtcgagagcgcgagatcgcgaggagggggaggggagaagagttggtagatttggcactacgacgatgtgaacgcggcgtgctttatatgctacaaccgcaagcgcgagcgcctcaccctcagtgacgccctgcgccgccaccggtggccacgcacgccacactcaccgacaggtggggtacgcgaggatgtgggccccactgtcagcgaccgcggtgggtcggtgagccggtcgggaggtccaccggtcggcgagaggaagagttccgtctctctgtttggcacgcgacagctgtggaggaggggtgtgggggcggggtgagttgctgacgtgtggccccacgggtggcgtgggccagggcggtcagcgagaggcgcgggtcgggtcgcgtgtgcggtctccgaggtcaggaagtccatctgactaggtcaatgacactcggggccaaccaggggggtgggggccccttatgtcagtgatgacgcgagcgctctttac

SEQ ID NO: 41124 - DNA, 1918 bp, Oryza sativa
caacctcgctcgctcgccagcgcggccagccatgcaacctcgccgtttcccgccctcgcgtgcgagtcaccgctctggccgccgccttgcctccgctcgccgccaggcgccaagctaccatgcctgcctttaccgtcacagccggcgtctcaccatggccccgccgctagtgtccaaggcgtcgacgccggtcagtccgccttgccagtcgcgccaccagaagcagtcaagcagagggaggcctcgctttttcgcctcgcgcttttcctttttcctccttgcctctaccttgtcctctagctcggggagacgcggaggcaggcacgccgatgacgtcgccgctctgacgcgctcgccccaccttgaccacgccagctctgttagaataggtgtcgaatatactagtcctatttggttatagttggacttggagttgtaataggtgttaggggtggagttagagtcggactctgtaacccggcaactatcttaaatagagaggggggcaccacgatgtaaccatgacgactacaatgtagcgtagacacgcagtgagaggatggcggcgtggccatggactcgtagcggctaggtgctatgttggttggggaggagcgtccataatcagagccccggggatgtaggcttcggctgaacctcgttaacaaatatcgtgtgttcctgtgtcgtcatctggcatgtcttgggtgatcaacgactgaagcgatcgggaaggttagtcgtcgttccgctatatcgactaaattttataacaagctcggcacacaccgctggctcggtctcctccagaccgatagctctatgaactatgaaagccgccccagggctctctttctccctcctagcttccactccttcaccatccctaaagctcgccgatcgcttccaccactccggtcttgttcaccgcgtggctcgcccggagtgccggtgcttcctggcgactggggcgaggcagctttccttaccccgacctttattggttcgcgccgaagtctgaaaaatacttacgctctgctggcatttcttcactacgcgcccttcggtctcggagtctcccaatcctttttccctagctcatacaccttccaaaggctactagctagctagcttaccgctgtgtcttgtgctcgccatatttccccacactcgtgttcacctggttccgccgctaattcgccgttggccacctagatgcgccgcgccatgccatgaggatgcttgaaatggtatcatgaaccctacaggatgccctagccgcgagcccgtgacgaatcggtcttgcgtttgctccggtgaaactttcccctttggcttgccggcgggatgcgccgccgccgaccacgggttcaattcattctgggctgctgggtgtgcatgcgaactggaacgtcgaccattgtagttgtatacatttaacaaactgtacttctagaaagtcccttatggaaaaaaaaaaaacattagcttctcttaaagaaagtttctcttatagtaacaattctagttgtaaatgagattttacatgtagtactattccatatataattttttttggagataccaagaatatagaaaaatacacacattaattgtcttcactttatccaaatacaacttcacaagctacctgtcacaccctgaagttctttcccaagcctaaattgaatttataatccaccagagaaaatatcgtgtaaaagcaagagaaaaccctaatgaattgatgccaataataatcggatttggcatgtggaatttttcttgagttctacattgtcgaaatacgcttacaagatttttagtggaattttcagagctctaaaaataattttaccaattaaaattgagcacaagcaatatttaatccctggaaattcttttcctttttcctttt

SEQ ID NO: 41125 - DNA, 1476 bp, Oryza sativa
gatagcccgagtcaacaaggtaaaatttccctgttagcataaacataaaccatgagacattattttataattgatgctagttcgacgagactattaaacggataagagaagttaccaggtggtggatgagggaagatagcggcatatttgcgcaaagcatcattgaacaccctcatatcatgtgccgatccaggccaccccgcaacaattaatgcaaacctcatgtcaaagtcacaaatggccaagccattttgcgtcggatatttatttctacccacatgttgaaccacctttgatgcgggcacaactactggtatatgtgtcccatctattgcacctatgcaattgttgaaatggggctcaaaccgatcatcaagtagtcttgggtgaatagttgtgaagtttgggtctctaggtttgacaagatcttttgaaaggagatagatactctgcaacacttcattgaattttctactaatttttccttttgacctctcaaatcggttcttaacttgaacaaatgattgtggagccccaatggtccacaaaaacatttctaaagcttcaactgaatccatcttactagttgacttcagaccataagatgagaccaacaaattatgtaacctctcaaagagtggcctactcattctaaacatgtcataacaatcttgtggaacttcaaggtttctcataacccaagcatgacccgctaaattagcttttctatacttggacttgttcaaataattttcagcgtagaacataccaaatgatgtcaacaccggtccaaattttctcatcatatctagttgtctgctagcaacaataatagtttcatcctcctcctcatcgtcatcatcacttccatacatgcccatctacaaacaatgcaacaaatgatatcacctcaatagtcacagaaagaccatgttgatggatcactaaacagtagttcatccaatcaaaattaaggcgccatattacatggccaggcagtacataagttcatgcgaataaataagtagcaatcttgctaatacatattgtctgacaaagtaaaaacagagataactagttcatgcatataaataattagcaattttctactgctgcccttccttctcgcaccatctctgcaaccaagagagccttcccaccttggtggtaagagtcttgaacatatcacgatgttcagctttcacaaataatcttgtagccatgaaatgctccgcacttccttctgctgccccgcaatccaccaccaaatccatcacctccttaatggaattgaacctaaattcaccttgcatcaccttgttggcaatatcacaattggtatccatagtggtttgaatattcctcattatcctaaccatggggttcttaaccttcttgtatggactagtggcggtgctggaagaccctcgcttcactggttttttacccaatgagcaatctactggtgtgtcgcca

SEQ ID NO: 41126 - DNA, 964 bp, Oryza sativa
cccattattttttttaagagaacttatgtgaaaaaaaaagaggatcaagttgacttatagtataatcgcacctgtcttttaactgtcgagtgacgtctgaccagcgtaattctttcataaatttgttggccatgactttaattccgtattaaccagccacccaagattaccatttctctgtgtgccatgccatatttattctcattttactagtccttcactgaaagccattagtacggttttgtcaagctgtccatattaaaagttcatttaggcatagacgcatagtagccttggagtatgtcggtatattactccatctcgcaactttagtactcgtgtcatcgcgtggtagcatccaccgcaagtctgcaacaatgagaacatattccactgtcagttctgggttcatgaaggcatgaactgccacggcaaatggtcaaagttggtcagcgtcggcgacttaaggctgaggtcgttgcttgggttaggtattcatccctagttcatgcaaaatgacataactcattaacgtatgattaattaagttttagtttttttaaaaaaataaaattaatatgaatataaaatttaaattaactttcatatagatttcatatagatttttgttaaaaaaaacaccgttcagtaattaaaaaaatgtgcatgtgaaaatcgagtgagttaagttgggaccttcaaacaaaaaaaaactttcatcgttcattggcgattgttgctgtcgatgataaacaacacagatgtgctgaccaactttagcattcccagcaaaaaagaaatatatcgctgagtgaaaagacactgatcaggtggctgaccttactacaagtgtgtgaatggaaattagtgctcactttgacattgtctggagatgatgcctcctttttcgccggactcaagctaggtgtctgaaaccactgaattacgagggtcaccggtaata

SEQ ID NO: 41127 - DNA, 995 bp, Oryza sativa
tattttaagttacctgccaccatgcatgtgcttgctgaattaagttttcctcttcattttaccaactaaacattgttgtgactatctagatatatatatgcacatatatagaattgtattaatatagctactagtactgtatatagtgcgtcgttgcaataaaactagatagttagtttaaacacacgaaaatacttttatatgacggaacatacagaaccacaatatggaaaataaccgtgagtggatgtatactggctggaaacgtggtcgtgcaccgactgatgagtgggtacagcaaactaaggattttttggattatgctttttccatgccaaatgttgttgttagtggaaaaattaagtgcccatgctccttgtgccgaaactatgtttcacacagaaggcaaatggttgagatgcatttgtgtcgtgagggtttcaaagagaattacatgaactggtcagaacatggtgagtgttctattggtcaagaagatcaagctacaacttcagcagaaaatgagaaatttgatgaattggatcggatggatgacatgttggttgacatagccggtgactatgagctttctgaggaagagccaacagcctctgcccaagctttctacagaatggttgctagtgctgatgagaaagtgcatagtcagacaacacactcctgtttatctaccacatctcgtcttcttgccatcaagtcacagtacaacatgccagcagcatgctatgatgatgtgatgcaattgatccatgagcttctcccttctaggtcaaaattggatgataatttctaccgttcaaagaaaactcttgctggccttgggatgccatatgaaaaattgatgtgtgctacaacaattgcatgctttactacaaagacaatgctgagaaagttatatgtgatttttgcaaacttctcgatatgagaatgagcatagcaaagttccacataaggtgctaaggtatctccctatcaca

SEQ ID NO: 41128 - DNA, 1335 bp, Oryza sativa
cagtcgtaatccatgagtaataagagatagtttgtcagcatttttgccatgatttaatgaaaatatcacaaattatttatatgtccagattcatagagtgcaaagatcattttccatcacttcagtgttccctgtataatattgctggctgcatcacatctcttattacttaattttcctcttcatctttacagaagtttgtggttaaggtagtttcccttgctatagcccgtgatggtgctagtggaggggttgttcgtaccgtcactgtaagtgctcccttttttcgtccttattgtcattgtctgttcccttgttgtagatattttgaaacatcagataccggaactgattgctttagttgacttcatacaaacatgtaaatttctatgctatatttgtcatgctgtttgctgtgatggccatagaatatagtatcagatgaaacttaaaatgaaaaagttggccttttttaacttccatggactggttttcttgccaaaaatggataatatttcagtgtgatatatcccttatacttcattcagacctgttttactcttttactaaaatgtgttagggtattgtagacaagacattggatgattggaagcattagtaacaaattttcttatgtcttgttgggcatctatttgctttgattgcattttcttgtagctcttcctttttctgaaaatgtgtagcatgtggcaaagtaaattttaagttgaggcatgtcttgttatctttgcttaaaatgctattacttttctgaaagaccaatgattcttgaacttatggatatgataatcttgcagataaacgcagatggtgtttcgaggaaattcaccctggagacaaactacaactgtggcatgaagagctggagccccagaactcgttgctggacatacttgcagctgggaaccctgatccgatggtccaatgaatctgccctcagccatacacctcccttaagcaactttcttctgtatctgactttcactagatttactgaagaactggactgcagaattatgttcagctgtgcgcaattatctagtgcaagatgcttcttgtgctgtatgtaatttcttttcgttaaggaagttcaaaaatatcatttagactttgatttgcctccttttgtggttttgatgcatatggcttgccccctcgtattggcagtatgttgcttctcttttctgcatattttcattttgaggctccatatgcacgtcgtaccttatagtcttcaactgaaaaccagactgttgtgtttattcaggcatagttagaagataaagggtgtaaagaagatttaagtttttttac

SEQ ID NO: 41129 - DNA, 1312 bp, Oryza sativa
ggaggatctcttccattctgcactatacaacaaaacctggtaaataaatgacaatagttcatatatagtatcaacacttttgattgtttttttttcatcacatgttgttcattgcttataggtgtatcaacttggaccaaaaatgcaagtggcttggatacctacagagttcaaatggctggctttaaagcctcactcaaagggtctggccaaatccgcagcgagaaagtcaaaccaagaattgtgagttggttcctgaatagttctcagcatcacattttatagatccttgctgcatttaagtgagagtcaagttaataagtcaagtcaagagtctttaagtagtaagccattagttgaattatttccttatcttaagcttagtgtgtgtagttcagtgatcctaccaagaaaccatacttactttctcatttttatagaatatttactgccaagtttatcacgaagaacgtggtgaggagcataacctgtgagcagtgagttagatgggaatgtggtatataaagcttttggtggactgaaacatggacggtttgcaatgggcaacggagttttcaagaaaactgaagttcttgctgctgttaaacataagaaatctggaatatctggatctacgaattcttacaatgctgtagtgcgtgagaatgcacaacttcgccatgaagtgactgaacagcgtggaatgatacgtgaacagcgtggaatgatacaagaacatcgtggaatgctaaaggtaataactactaaattaatctctgattcatttattttttttcccctcacagaaaaatccaattagcaaatttaacttgcatgcctataggcagtatatgagaagcttggaatggacatacctgaggaggtactttcaaggtgggagtcacaaagagaggtacatttgctttgacaaatgtataatttgttgtttcaatgatttattgtagtagagcgtgaaactgatgtctttactgttagtgaacaatggttgctcacaatgcatggatggatgattgaatgctaatataaagtctgcaagatacatttcatttatttatttccagtattttcatacatagcatggcatgttttctaaatggtttacctagcatacatatatactgcaatatctccatttttcttcaatttgttgtctagcatgccctcttttgtatccacaagactctggaattaagttcttttgccggcacaatgttcccttaacaaaaccagtccaatctccaattattaatcttttagcatgcttcaatatgactatggcctataagcaata

SEQ ID NO: 41130 - DNA, 1012 bp, Oryza sativa
  unsure (1)..(1012): unsure at all n locations
caacttctacaagttgtagaatttgaattttaacttgcatgcttgtggagtgatatattacatattgatctatcttgttcatattttttcaatttttttcatatttatttaatgnatatgcaatanacgggtagacatccactcaagttgttaaaacagtttccctgttatatatattctctggatcattcttgactcttgagtagttggttgaatcgcggaggacggtaactatattgcagggcagttgtagcgtagtactaacacctcttgtttaatttcagttcagttaagatttttctggaatgctaactacttacttgaatttttactgttgctggaactttgtatattccacctacgtaacagggcacaagaagcatgttatatattatctacaaaagcccaatgcaactgtagagaattcatttacctggtctaacatgtacatgcaaatttatttgtgattaacatcactgcttctgcataaaattgttctaggtgctcgtacatagattaaactgtttcaggatgatgctgattttaataaccttacaatttacttgaagtcagcatcaccggtatgtactagctgctccttatgactttcctagtagccgcttggtggtcactggtcagcatcactaacatgtattagttggtccttatgacttttcaggcccaaatcaacttcaaattctggtttttctgcagcctgcaggtaaccacccatttctcacttcctgccactttttttttctgctgaaaggggataattccaaccatggaaataaaattcgatctaaaacaacaccgatgctttatatttgcaatttccaggaacattatatggccttatcctgtattcctgtactcctgcagttttgccaccgtgcaatagttttttacagactcataggagcttgttgaatattgcaaaaaatatattttagtcgcatgcttaggggcaacaccgtaaaagctcattccttttggattggagcaaggccag

SEQ ID NO: 41131 - DNA, 1501 bp, Oryza sativa
ttatgcgcttgtacgaataaatataggttcctaaccaaaacagacagacataaataccactgcggtaaggagcaaatctataagcctcctgaggagttcagcatgtcttgtgtcctccatttgcgtcctaaatttttcctctctgaaagaagctttctgaaatcccatagaattttgatcttctctagcatgtgtgagtatgagctgagagctatctgagattgcttcaattgcaatttcctcatgtttagtcctatttcaagttccttgagctcatttgaacgagtctgctcattcagagatctctcaaatacattaagaatgtgcctatcaaattctggactagctttattatgaggtagtttaaccaactgctgatcggtgcccgcatgaagaatgatttgattatccattgaacttaacgatgtactctcctggatatcatgtaccggcctttttgaatcagcaccactcaatttgatttcagcagcagaagtaccatcttcgtgagaaaaccgagagttatcttgctcatagacaggtgtctcattaattaaatgaagtgtcctcaatgtacttccaaatgatttctcaaagtttttcgtgaagttgtcgaatctatcaccatatatctgcagaataacgtaagtcagatatgtaaaaaaacctgtctaagtgtaatcacagacaaggaaatgaaccattcatacatttgtcaaggactctttcactgctgacgtgcacatctgcatcaagattcagagttagcatacctgaagttctgttatagtccatggccatcatttgtagaaaggctaattacatgaactgtgtacctttgaaaggaaatcaggttgtaatcttccttcagagcaactgcttctattaaggacctgaaacaggataaggtcagttcttgttaattacgagtaagaaaaggttaaaccatacaagctgaatccatgcttcagaaccacagttctctactggagagcccaagaaattcatttgattcatttttgtaaataaacaacttcattttaatttggcttggatgtatttcatcatcctaatggcgagacgatcatccagagaacagaaggattacatatctgagcctacgcttcaaaacacacgcttctgttcattagtgccgtcccatgtaaatttgcttaattcaatttggttatataaacgactttagttgaatttagatgcaatgtgaaaagacgcccaaaatgagttccggagcaaaagaatatctctacttctccatcctaaattcataatccaatgaccgtcccagcaaggcaagaattgggtgaaccacatgaggagggtaaaaaccgaacctttccgccgcgactaaacaagaaaccagtcaagaatcgaagcgaacgcgcacctgggcaagaaccgccgcgaaggacatcccgagaggcagcgcgaggtcctgcgcgccgtcggcggcgcccctcccatcccctccagtcgcaagcag

SEQ ID NO: 41132 - DNA, 812 bp, Oryza sativa
ttacagggaatcggggtgctggtcatgcatcaaggctttggtttattttagtgtgtcgactcgagagagctgggaatttgctgtgtgcttatgactttgtgctctgacttttgacttaattatgtgagaaaatgatgcaagtagaacttgcctttacagtaattaaaaccacagggtgcctgctctgtagatcctagaggccatttccataactacaatactcggcttctcaaactaaccaagccgctgttaatcaccagttctgaacaactcccataggacgtttgctgcaagctcatgcatgatcttgcaggctttcacctgctaaaaatatttgcccctgacgcatgtcctggaacacggggggaatcaacaaagaaagctactaaattatgatcgctccaatgctgcatcacagccgatctaatggaggtcggctggtcgaatttgccgatgcacgtatccatccaccatggaacgcgggtccggcccctgatagtatattggcgttgatcattcagagaagcgtaaaggaagcaggaaagaagcgacgagagtgtacaggcaggatctcgagtggggctcgtgcgtgtgtgcatgcccggtgtccgtgtccatgagctccccaggattcacctgggcgaggtcatttctcaggcaagctgcattcgggggtggctggatccggcagccaccaaatgccgtctccttttcttgcacctaagctggggttattaggaggtcaggaaaaaaacttcttttttgaacctcgatcaactaatccatcagcctgtgtttagcataacacggcc

SEQ ID NO: 41133 - DNA, 826 bp, Oryza sativa
caagggatttgggatcatcctcagcatcaacagctgtcctgtttccacaggtaaaattaaaatctatgaaatgcaacagagagaaatccattaatgtttgcaatacaggatcatagtcatagcgccctatttcttgaaatttttgtatgagaaagaatggaatactgaccagcttatgtacaagcaagtttgttagcaacacaagagtgattaggcgcctttatgttgcagtgatctctggacaaatggatggtcaacagctgagcagcagatggccgatcatttggatttacttttacacacttaattatgaaatcacgagcatcttctgacagtgtagctggaatttctggtggtattcctctaccaattttaagcaaagcatgcgtctacatagcagaagaaaagactgcatcacggacagtaataatacaaattcccggataataagaaaattaacacagcaacatacagtggatttgctgtttgcagttctgatagaaatgtttaattttcctactgacatttttaaatccaatactacccaaattttcctgatgaaactaatgtttgattttcccaaaaagatatacttcatacgtactgatgtaagcaaacaagtcatcaacatgaagaagttgtcatcaatgtttttgctcctttaattaaatagcgtgcagcccgcgtatatcagtgcatttggtatttaaaaatgggatgctgttactggaaagtaagacaagagatatactcacccattccatatcagggtatggaactttgccagtcagcatttctaaaactgtgcagccaagactccatatat

SEQ ID NO: 41134 - DNA, 837 bp, Oryza sativa
accaaactcatactaagagtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaatactcttccgaggcatcgagtcacctacacacgaaataaacaaagaaaccatattccgataccaagctatccccaacttgactcattgttagcaaacaacagtattacatacgtatattatctatctagaagtcataaccatgaaacaatcatggatatccaaagaaacaacccgaaaccgaaaccgacatagcgtcggccggtcagaccgcgggctggccggtctgaccgctcgatcaccaccggtctgaccggcatacaccacctagtcggaccggtcacataaaataatagtgaatccgatcatcacctgaaaattgattatctccaaaaccacttcgacgataatctccaaatatcaaaaccaataatcacagatgtcaattgttcatcacagaataagaatcaaaacacactttaatcttacattacgttattatacgttcaccgtgaataacatttagacccatcactctcgagttcatatatcagccaccacatcggaggaaagttatgtgagagaatttcaatcggtgataatataggcacgtacgtgtcgcctctcgcgacatgtaaga

SEQ ID NO: 41135 - DNA, 1130 bp, Oryza sativa
cataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatagagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagacgacggctccaatgaggagatcaaatataggactcaacaagca

SEQ ID NO: 41136 - DNA, 1265 bp, Oryza sativa
aaaaatggagcagtgaaggttggagattttggactggcaaaggaaggtcacttcatttttggtttcagtgtccttttttcccctggtttgactgacagattattaaatgattttgtttgatattgacgatgtgaattctcaacccttttaattgatgtaatgccagataaaagtttggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactcattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaa

SEQ ID NO: 41137 - DNA, 950 bp, Oryza sativa
atatatatatatatatatatatatatatatatatgtggataatgctaaaaagtcttacattctgaaatgaagggagtattaattaagacagatcatacgaattcagcaagtattgttttgtgctgtactgctacagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcaagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagact

SEQ ID NO: 41138 - DNA, 840 bp, Oryza sativa
tcgcagtagatcatttcctacaaaattgttaatcactactacaacaatcaaaaagcttaaaagcatcaacagaagctcaaaagatacattaaagggtattttgctacgccattgcggccaatcctccaatctacacgcaaagaatacaccgagaacaccgctctcgtgctactggttcaatgactaaaattttgacaataggaggccccttttgctcgcccatcttcgtttttaggtcaaataccccagcaattgtaaccacagtcacctaaatcctcactgagaaggcataattcaccttgataagatcaaattaggccatccagtctgagatcccgacctagaccactcccatcagagagctccacaaaattctcccgaaggagcgccaagaaccagccagaaaacactcaaatcagcaccggaaccccccaaattcccccaaaccaagaagaattcctcccatccgcacccaaatcacagagatagaaccccgaaacaaagctccctagccaccattccaggacaaagaacttgggcctcggcgcctggcgaaccaacccaccaccaagatacccaaccaaccaaatctgacatgttcgaatcgggacgaagggcatgggcaggggggcaagggcaagtacctagacccggggggcgagcgcccgatgcgggagcgaggaggtcagccggattccggcggcggtgagcgcgaggccgcgacggagttggagacgacgacgaggaggaggagagcagcaaaccgagcgagagagaaaatggcgaaagacaaggacacccctagttaagccaaattaacgaaaaaaaaaacaaaacgaa

SEQ ID NO: 41139 - DNA, 970 bp, Oryza sativa
ttcatatttggtgaatggtgaaacaaattccatgctgatacgatcgaacattgaagtcgtgcggattatctaagcggaaaatgacccttgattttgacaataataattaagcagaagattgcatatagcctagtggctacagtgacctgagtagtaccccaaggttctgagttcaaattttctatggagcgaatttattgtttgcagaactaaattccctatttcaatggatgcatatattcggttggatatagaggccgggtaaaaaatacccttctaaaaaaagaagcagaagactgcattttggccttgattttgtagtagctagaccgtggacaaccgaaggcgacgcggcgtcggtatcccattccagaccaccatctaggtggaataagttcactttaggtctcttaatttttcgcttggtctgattttcgattttgaaaaaaaaaatagctagaccgtggacaactgaaggcgacgcggcgtcggtatcccattccagagcaccatctgggtggaataagttcactttaggtctcttaatttttcgcttggtctgatttttgattttgaaaaaaaagccagttacaatggatccaggagttgaatctggagtgtaattgttgagtagtctaaacctaactttgcctctctagttcattttataaaaatgctccaccgagcttcgcgagctccgctcttgttttagctagagctacaaatgtttggttggttcagctccaggacatgtggagctggaacccacaaattggtcagcccacaattgctgaggccggcccaacatatcggcacagttcacgggaatctggctcaggcccagatcgtcgttactgggctggtagtttgtggtctgtccatagcgcgatatcagcccaacattcgcgacgtgggaatccagttccgaccaatatttccgcacgtaggccgcattaccgttccggcccat

SEQ ID NO: 41140 - DNA, 1418 bp, Oryza sativa
  unsure (1)..(1418): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgtaccagaatgctcatgctgtcagtgaacttcacatctagctcagtcatcaacactagaattgttccagcgacataagcagcccatctgaaacaggatggagttaacaaacatgtcaacacagttgagcagtttaagcttctgtggggaatagaagacatttacttctgggatgggttgcgacaaaaaaattctctggctttctcgtaggatattggtttgtcgacatccattaaatctgacaatttcatatcaaaagttggtgaacggttactcaattcagacccaaatgatacctgtgagagagtttattggtagtaagcaccatatgaatttcataattgagatcttttttctcatgtaagaattagccaggacaagcattttcagcatataactaatatgcagtatccacgttcactgaggattaataaaaaaatatatttggatgattgagtagaacatactatttgtaccacaggttccatgcctccgttctcaagccgtcttgcctgtgtattttcccatagcttctgattgcttgggtggttcctctgtacagcaacatgacaggcttcccgaaggggcagctagtaattgcaccaaaacttttaattacaactgactaaaacagaagatgtattgttgtgatgccattagatggttcatttgctaatacaccatccaccagtgccaagcaatgcttttggatcaaacaaggagaatcacaaaaaatgggacttatacatcccaattattaattatttaaaagtcggggggggggggtcaagggagaataaaatcgcctaacttaaagatcaagtacagaaatatgatttttcacctgcaattgagcatacctgcaagactagacttcctgaatagtcaccaatgccacccatgacatctaaacgaccaggtgcccttgctatatacatttcctcctgaaatggaaccacgcaaaaaacaaataagggattatgattactcagtcatttattaagcattttgaatgacttccttcaattgttagaacaaaaggttaacaagaataattgattaatcagttatcaaagctcagtttcgataagagttgataaaaagaaagatcggttaaagaaacaattcaatggccaaaaaaaagagagagctgtttggacatgttctgcaccatgtaatagatatggaaattacatgatacaaatcgtggtcaacaatgccaatcacaaaaaggatctgcaaactgtattatcttaaatgtttcccttgaattatatttcgtaagaaagcatgaaactaacatatggtgaattgacatgtg

SEQ ID NO: 41141 - DNA, 3558 bp, Oryza sativa
ttagtgaaacttaaaatgaaacatcacaggatcattgttgatatattttgtgcatttaggaagttattagcttattatctgattgtacattgttgcacctttatgcactcttgcaacagctacactctagacatgctacatgaacagaagaagcaaaatttggtgcatgtggtagtatagtttagcagtaaaatgaatacagggaattccaagtacctcccagtcaaagagcacagatgcagcaattctctcttgaggttgcttcccattactctttaactcactttgattaaattcagataagctcttcaaaaaggacatggtgtctggtaatccttgcagatccccatgaagtatctcaaagtcttcaaaacatctaccagagttaaacttgttatgtcagtaacgaagtctattgttcaacaactacccaaatatgaaaagagagggcatttaactcacgattcggtgctttcttttgttttaatattttctgagattggacaggcaccaacttctgtctcggaaagagaataccagtcaggaatcgctacatctctccctggagccctttgtaattgataccctaacactatggcgtcttgcaatcgtcttgctccattgaactataattacaaataggatatgttgattggctcagatgattgtacaacagggtttccaaaacagatctaatttttttgacaatttaaaagaaggaaacagaagttcccagttcaatgaatgctggttttacatagcatggagcatagaaagtttcaaaagaagcttactgtcctctaacctccctgagaaaagttttccacatgaagtgtaaaaactaaagagctcaggatgaaaacaggcatatgagcaaaaaggtagacatggaaatccaaccctgttgtaactcactttgtcagaaatacacttcttcccaacagcagtgtcctcgaggattcgtgcagccacctgaatggacaagcattagtttatcattacaaataatacttatacggaatacaatcgatttagtgactatgcatctatccttctcattttggtctagataaatgagtattgcttttatcttatcacatctgattctgaacaaaaaaacaaaataaaatgttgttgcattaaccacataaatattgtgaattttggccagtttgcatgaaattatgcaataacctgggaaatcagttgcaaaattacctcaccaccatttgttggaccatcatagcatggttgaagtgtgagagcacggagtagataaggtttccagtgcccatgaaggaagtcccttctggtcatttcaatactgctctggtagtgctgaaatagaatgggacatggcggcatttttagcatagctgtacataagttattcctagcataacttgatgattagaaatgattcaacctcaagtaaattccgcaaaaatggctcttcattaaaataatctctgcggacaaagataaatggcagcttgtaggccaaagcctcacttgcagttccatatccaattttccctatagggtagtgagagtaagcagtgcatagcaaaatatagaaaatatggactagtattaaaaaatgaatatatcatgttttaccaagcatgcagtcagatgctgccatagcatcaggtgtgtaagcatcttttgcaagcttaatgaagtttggaggaacctcttgagaatcagatgcaccgcagacctttcatgaagacagtgctaagttttagacaaccacaccgggcagatgctttacttatttaaaggatagaaatccagtataaaaatctataccaaacagatccagccatcaggcagccattcttgcttcaggttccatcctgctggctggggacaatagtacattaataatttcgttttatttgtgatcatacttctttaactcaaataaaaacataggagcattcagtaatgaagtcaagattgggagctttcaacaaagcatataatatgaaacatgctgttaaaacagtactacagtgcaatcatggttttttttttctgttgcgggaacatcacgcgatgatatatctagatactagctaaaggcaacatagattcaaaaaaaaagcacaagatttatttcaggataatttaaaacacagagttatataaaacaatatcaaagggggaaaacagaaacatatcacctaagcttatgaaatttaaccatagggaacgcccacctgtcccccaaaattaaaaaccaccaccttcgcattttctgctattccaagttccttcctcacctaatagatcaaaaaagggaactgtaaattaagaaagcagaatgttgttcaagcccatggagcatcattcatcagtagaatcacacaaacctctgatctagatttgcgtagccctcttaccacaagaggcacatcagtgacatcacggaaagccggcactatggatttaaggaaaactcattttttaaaaaaattaaaactgagaaatgaaatactgacaattttgtccgttcgaaatatgaacattttaaagaaagaataggaaaaacacaaatgaacatactagggcagtatccaggtagtcgaagtaagatatcacaatgagaataatcctccgctatctgcaaaatattgagtagatagttggatattgagcaggtaatcgtatctgcacatggaaaagggagattgctaaaggagacaatagtgcagataacctaaaggccagaatttgaccactctcaacaggaaagggtaatgagctgatgtgggaaaaaaacaaacctgccaaacaatagaacggtgatgatcgccagatgccacaatatattctgcatatatgtagtcccaactgcagattgcacatatagtgaaacaatagcgtattatcagtgttgcttgattccgcaatgctaaagtatgcatccttatactatgatatgcaattctatttggcattctaaagtttggcaagacatggaactgaacatgaggtagagataagttgtgatgtgccaactgattcattcaaaacagatgaagtaaagcggggaagagacataaccccacctaaaattcccaatgcagaccgaggggataccaacatctgcagccaccctgcaggccacaggaacaacatccgagatctgcaggccccaaaagcaacaacagcacccacattcacttcagtccaagtaaatttcactcttaacaagtaacatccccctcctaaaaatagcaaaatgcatcgcaatgagacaagagcaatccagaagtagtagtaccactaggtctgcgttgatggaggtgagccactccgcctcggtcctcaaaatcgactcgcggggcaccacggccgtctcatgatactgcattccacagcaattcaggcaaaaataggtggaaaatgaagagagaagcagcagcgtggaaagcgaggagggcgtgggtgaaaaccttgaggagggaggcgagggggtcgactgtgagggcgtccgtctggacggcgccgcactctaggatggccctgcggatgtggaggaggccc

SEQ ID NO: 41142 - DNA, 11506 bp, Oryza sativa
acttgatatataggggtttactgccatatcttatgaacaatgagctggtcttctaatccatacactttgcttctttgcaggtgtttttgtgccaggttgagccatggaaacaaatggtacagagaagaataactgttccaaagagttgatggtacccttggcccttttcgctgtggaattgaacagcaagaagcgactgctgtttgatgtttcaagccgaaagatccatggggtaaccagtacggtgtttccagatgctttctgtgaatttgagaatggtgggtggctcctaatggcgcagcacaagccgttgtccttccaagatcagatcgtgttccttgttcatcctagcaccggcacgcacttggacctaccggtacttcgttctcctaatgaggggttctttgttttctatgttggttctcatggaatgcctctagtggttgcattcattgagatcatgagtgctgttccaactgcccatattgcctgtcctggagatgtgtactggagcatctataagcatattagtgatccagaaatgtcagaagcaatgtacaaggtccagagtgctttgatcgttgatgtggtgttgctggggaaacaggctgtgtgcgtcgattttcatgggcaaatcttgtccttcagcatcactgatatgatttggagaacagtgtcatcttgtcctgattggagtaaacaagattctcattttcttgttgcgtccaatgagcaagtcgtggccatattgcatccttgtaaaacagggagtgctttcaagttctttaagctggatctacaagcaatggagtggtcactgctggatgacagggagttggataataccagctggttcctttgtaagggccaatcgtaccatgtgaaggaggaagggaagaggagagtctacttatttggtccaaataaatgtgccggctcaatcgtgaatggaactgaggtggccaccttcactggttcattaggtccttcaacactgaagtccatcacaaatatttatgcatatgatttagttgatgagactgttgagacagtgataccagcatcaatcgttacagaagtgcaccgttggattctccctagtacattcgctacttgagctaaatagtgccacatattggacatgtgggcttgaatttgattctacttttactttttgttcttataggtcttgaatttgtgcaattctctgtaggaaacattatcatttcttttgacatcttatggaggcataccatgtatatacatgtaagcagctttgtaattgtactggttacagaatgatcagtggtgaatctttatggtttttgttcctattgctattttgtaaactcattatttgagcatgggtaattactgttgtctttgtttcttcatcaccatcccaaatcctctgcctacatggctacatataatttcaattacaagttataactgtgggtcaatgtcttttgaggcaaatatatcctctttcaactagagatttgatatcttactctcaaccttgaacagcaaattttccaatctgtcaacaaaatgggggagcttacatcttgaatttcccccgactttcagctcaaaaactatactctcaacttgaagttcacacttttcaagtgaacacaaaaatcatagccaaccaccatcaatattcaaatctacatttgtacctcccaaaaatcacataaatgcctttacactctcatcatcaaaaggtttccatgcatatacttcaaaaagtttggaaaggaagagagatgttaaaaattatcacgagaaagtatccgagtttggggaaaactgtggcaactggttcactgacaaagaattatgttgtcaggaggcagaataaaattgaacatccaactggcaaccgttttactttgttcaaatatattctctaaagaaaacgagcagtatacatcatccagtatgtgagagttacattgctctgcatgttttgcagaagatcacagtgtatcaacctatagaatgaagcacagatcatccagtataggacatatatgtacgggactagaagagcacatattcatccaatcatgataagtggtagcccaacaggaaaaacagcttattccaaatgttatctcacagttgattcatgcagtattgcgacagccgacaggcactggcagtggataaagcgcaaagaacatggcccaggtttattgaacaggctggcaagagttgcctctacctgtattgatcaaaggaattcagtgtcagaattttattgagaacgatatcagacagtatatagtaattagtttcaaaggtatccggacttcctcatatggaaatgcatcaaaaaaatttatcaactcaatgagaatagagaagcattttatgattatggacatgaatcaacatctgtagtccagtttagctttctgataattaactaattaagaaaattaaagtacactagtacacatgtgcagtctcaatataattactaactcttgggtagttcctatggctgcgattgaagcaaggtcaacaaatacaactagaagatactcacaaggtagttactggagttttgctaggttcgcctcttggtacgcagcatagcccaaacactgctacaaggtagcgtggcaaagaaagtggcagggctttataatttcattttgattggttttccagctgaacctgcagagaaatataagcattcaaatgttataagtatattttatccaatcaaaatattttgcatcaagtaatcaggcggtgttatactaacatagagcagtcgacatccggtatcatgtttccagtgaataacttgccattatccgcttcggatgatgggagtacaaaacctccttgtcttgagactgtaaatacgtctttccccttcaacctcttttcatcaacaagaagctcatctccaacgacgatttggtatgatttagctacttcatttgggaaaaaaccgccaccgttcacaatgtataggtcatcaaaatgctttaccagtgaaaagttcatcccatatattctcactgagccgttccaaatcataagttctaagccctcagatgtttgcctcgcacaacacaacgaaccgctgtcagttaaccaaaaaagcatgccctgatgaatggtgaggctattcaacccgctgtgctcataatcacacctcaccgaccctttgctccagccaccaatcttaaccgatctgagccagattgcagttatagcttcttctccgagctttgggggatgttgtcgcgcaagagctattgtcacatcgaatggtgggttcccgataaaatatccctgatgaataatctcctcagcttcgccaacaaaccatcgcttctctgtgttaacattccaaaggctgattatatttgcctcccttagtaagaaccagctaccattggagtacaacacatcgtcaatatcaatctccatattctccctgtagaaggtgctcttggtatatggagagaaacaactcattccaggagaatggacgttgcatataagcaatacaggtccgcacatttctttttcataggatcctaaaggaggcaggcgaaacagaggggcctcaggattagctgccagttgtttgcatgcatttcgagagggcctgaaattttgcaacaaatataatacttaaggtgagtacatgacatatctatgctaaacagcatacacaggaaatgatagacagaggacaacataaacaggaagtgacaaaggaaggttgaactgtgtaatgaaaaatgaattgccaatagaagtttcagaaacatcgacgtacgcgtaatcaagttcattgtcctggatcctgactagaggggcttgaggaaagctcatcttgagacctggccataatatgatgccttcttcttcacaagtatcttgtaattcactaccacatgatacatccgtaacagccttgacacgagtacatagttcatttcctgaatatatacacagtatgcagtaatttatatgtgagagcactgaatgtaactcatggaataaccatagcaagaactccgaaaaggagggggcccttcaaaaacatggatgacaatatgcattaaacataaatacggaagaccaacatgaagaaactaagaacttgaccaaacgaagctatacctatcagaagcatagcacaattagcataataacatattttcagtccttccatctctaatcctaatagagtgcatcagtatgtgctgcaaggcatacaactaaagcattggtgatttacattgcgtagactaaccttttgaatcctcagtttgatcagtatgagactgagaagatctcgaagcaccactaatgttactgcatgaatcctcagcttgatcaatattcatcattatgtccccctgttgcatccaggaatccaaccgttaaacatgacaccagagtttagaaagtgccaaatatgcgcataacagtaaagaagcaaagacatttgaaagaatatacctcccaattcacatagaatataaatcattcaaataaaaaagagagaaatatcagaaccagttttgttaacaactaagatcaactgtgtgcaaataatttctccataaagatgcaaattagcctaatgtacataaccggaaggtaaaaatgatttaaactgcatgccatgtgataactagtaagtgccaaatggaaagggaatatttgccattcttttactcaaatgatgttgatcatgttgttgtacttcatgtgaatattcactactgtgtaaatcaatccagtatggacacaccattatatttgaacctgctccctagttttgttgaggagtaaattttcaactagaacaatattgacactaggaatcattttccagtttgagagaaagcatctgctcttgtgtgaaagaatgcatgactaaatgtgaaagacgacatgagtacatgaccaataacatgaagaaatcatgtaagacaagcatccataatgaaacagaaaggctgcaatctaaatgcgggatttcctttgtgaataatggccgggatcacaattgcacttaaattccaagcttgaaatatcttactgagcaaccatttaatgtaaataattgaaaatgataagaacacagccatccaaactacattgacacaaggatgttcctgacttcctgtatagtgacttactttatcaactgaagtatacagcatatacatcagaacgaaaagaacacaaaagataagtacgcacgaagttcgttaaacatttttttgagaaggacgaagtccattaaacatgagagctaacttttgtattgggacaaaatgacacaaattcgttaaaatacggcattatatggatcaaagaaccactagtgcgatttatttgatcagtaactagaggaataaacctcaggagtcaggaatccaatagtttctaacagttgatcgggcggaaaaaaaatatgatgcctaatcacaagattcagaggtaaaccgtcaattgggggaagaactagaagcagaggatgaggtgaattagaacacgtacatgtcgcgcacacgaatggcgccgaccaaacggaatcgggctgagcgcacggggcaagaagtccgtaaaagcaggggaagaattttccgtcgccatcgcactacaaggaagtaggatctcgttcgttccccgtccctgcaacgcatacgcatgagcaaaaaaatccatccaagaagaaggtgtcaagaacgcacaatcgcgcaagaaccaggaaaaagaagaggaatttgatcgcgaaagagtttcatctccattagttgggggcaaagaaggcaactcacccgcagattcaccgcgcccgcccggctgcgaaaggagatcgagaacccgatggatcgaaagcgccgccgccgcgcgcttcctccaacaacccgagggatcgagagcatgcttcctcgggccggcggaggaggcgcacctcacgctcgcgctccggccggattctctcccgacggcgaagcggacaaccccgagagagaggggatcgaaaccgccgcgtcctcggggaggaccaggacgcgcgccccggccggcttctgctccggcctccctcgcgctcgctcgccggagacgccgcagatggctgaaaccctaaccctcgactccgagagagagagagagagagagagagagagaggtggaacgcggcggcgaggagaggcggaggaggggggcgagctcgcaacggcgaagaggataaaaagagagggaaccgagagggcttcgcgaaactttgaaaaccccaggagtcactgacccgtgggccccaccccgaccccaccgtgtcagaaagacgtttatacgtgtgcctgtaccgccttgatcagttgaccgtgttagtctctgctgatgtactactccctccatatacttttaatagttatattttatctttacacacatatcaagaataagtaattctaattatcatctatttaaatgtgctactcgtaaacaagtgacattaatatttacatttctcgatgtccatgtagctaatattgtgtggaagaatggagagtcacgcattaaatccgaaaaaatcattaagagtatagattgttggattgaaatatgcttatcaaaaataatttttttagatttggaaatatgtccatcaaaaatagattgggggagtactgctgactgaaatcactgagacgatctctgtagccgatttcccttgacacttgtaatcttttggtttaaaaagtgtaaataaattgtaatattgtacttcatactttaagtcattttgaattttttttctttgatcaaacatttttaagtttgactaagtatatagaaaaacattacaacatttctaacccaaaacaaacatattatcaaactctattaaatattagttttaataaaactaattcagtgttgtagatgttgctaaatcttttctataaatttagtcagactttaagaagttggactagaaaaaaatcaaaacgatttataaattataatataaaagagagagtgtgtgtatttcatatagaaaaacgtcaattttactccccaaaactaattagttagatgatttgatatcctaaactattgttaagctcattttacctcctaaattattgaaaatggtttactttactacttaataatatttctcttttatgttacgttttataccggttgtattctagtaatagaattggatggagtattttcttgtagtaaagctcttacatttatttctataagtgcaatcatatttctcacaaagtatagcagttctagagctgttcagttcaggtttacacgaaccgtccaaattaagctttgcctttcaggagtgcagggcagtgcagcacggtcagcgccagatttggcgcgccctttcgaactgatgtttcatgggccgggcctaattggttagagcctaaagcctaattgaagcaaactcccctcttaaaagttgtacttattaaagttttggaataagatcactttgactcccttaactagtgaccgaatctaatttgcatccttcaatcgcaataccggatatctcgacccctcaactattaaaactggtacaatttgactccctcgatggttttggagggcggtttcgctgacgtggtgtcacgcccagaaattcccgaatagaattccaagcagaatgtgtattaaaacccccgtccaggaccagccggggtacacaaacgacaatgttgacatacagatccacgtcttacaaacattataaaggtctgacagaaatgcagcggaaaaacaaaagaaactggagctaagccttgacttgaacggcagcgggaacaccactccacaggcatcctcgacggcacggacgaagcctactcctcggagaaaccttcatctgacacatacccgtcctctggggttgggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcctgcgaaccggtccttaactgccatgggtgcgactagcaaaaccgtgcacccacagcccaccatgtggttcattttatttaaccaacaccagagcggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtagcagtaggtatccatcccatagtgatattataaaacaatgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcgcgcggcccaccggtcagcggcacgggaaaaggttgggcggcggcgccacgtggcgaccggaccgacggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagagattagagagagagagatggaccatggcgatcgggatctatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatgggggaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacacgtggcgtctacgtggcagtgttgacttgtctgtggcgttgatgtggcgcttaggtggcattagagttaaaaacataatgtgggtccatttgtcatccacacacacacaaagaaaatgtgggcccactaacacatgggacccacttgtcatcctatcctcactccttccttctcactctctcacttctctctctgactctttctctccccttggaccgcatcaccgcctgtcgccgcgacgaagggtgaggagtcatggcggcacggagcgctcgcggcggtggagggcctgctggctgctgctgctgctgctccggttctctccattgtcggagtcgacgtcgcccgtgctgacagagaatcccaaggaggcgacgggcacgccgaggctcggacccagcttcgtcggcaggacaaaacgggactcgacgaaggcggtggagctctcctccttctcctcctcctccaacaccacctcgtgtagctcccctctcagcgcgccggcaggtaggggtatccgccgccgccgcaggattggggatcggggggaagagatggaggggtggtgagagagagagagaaagagagagagagagacagaggcggcagcgcgatgaagcttggtgagggagctctagggcggcgaggccggctgtgatggggacgacggtgactaggggtaggctagtgcacctgctgctcctggggctacg

SEQ ID NO: 41143 - DNA, 7203 bp, Oryza sativa
aaaaagaaaaagaaaaggaaaaaggattttccctggaagtaacgattgcactttagtgatttttaattggttaaaattatttctagagctctgaaaattccactaaaaatcctgttaatgaatttcgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacaaacctaccccccttaaacggaatctcggccccgagattcggtggagctggtgaagaggtacggatgggcggctttcaactcatcttccctttcccaggtcgcttcctcttccgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtccccaattcttcttgtagtttctgccagaactttgaagtgaactgactccctcgatcagatacaatctttttgggtaccccatgtagacacatgattctcgagaggtagagctccgccaaccttttgcccgtatacgtggtatgtactggtatgaagtgagcaaccttagtgagtcgatccacgactacccaaattgaatcgtgacccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaacttctctttgaggtcttgatacattttagtgctgcctggatgaatggagtactgggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccacgttgagatgctcaaactcctgccgcaattcctcacacatgccctcgatgcatagggcagtgcagtaacttttccggcttaaagcgtctgccaccacattggctttacccgggtggtagtgaatactcatgtcgtagtctttgattagttccaaccatcttcgttgtcggagatttaggtccggttgggtgaagatgtacttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctgccctcttgcattaggacacatccaagtccgtgacgggaggcatcgcaatagacttggaagtctttcgtctggtcgggcaggatcaacaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacacggtcttaggtggggtccatttggtaactgactccacgttcgatgggtcgactgccacaccctgagctgtaatgacatgacccagaaattttacttccgtcaaccagaagtcacacttgctgaacttggcgtatagctggtgctccttcaacttctcgagtaccagacggagatgttgttcatgttcttcctcggactttgaatagataagaatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccgggttctcaactggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctccgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcgatgtccactgggatttccgtctcaatctgattcaacgaggctcctttctttggcgagactagagatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctgggcttcgggcatttgtcagcgaagtggccaagctcgccacagttgaagcaggaccctggctttgctcccgtctccttcttggcttgtgcgggcgggcctgactgtgccggtgccatcggtgggcgtggagctgtaccgcggttgggctgacttccatggtgattctggctgccactggagccctggtggaagttgctggggttgaacgggcggtgctgacggacgatcatggtggtaggtccaccctgctgcccgggagtgaagcgcagcctctggtgacttccctgatgtgccctgaactgagcggccttcctcttcctatccatcttgttgcgttgatcctcctggcggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgttgccctgatggagctcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcaaaagcgaccttctcctgatcattacactgcaggaggttcagcttcttctctattgcatggagccagtcattcgcctccatggggttggtggtgctggagaaggtgggtggcctgacgcgtagaaattctggcaacttggactgagggggagggggaccaaactgctggtgctgctgttcggcgtgctgcatcatcctctggtgcatctgctggtgctgctgctgcatctgctgcatcatggctgccatcatctgagtttgatgtgccataacttgggcaagggtcggattctcgggaagtggtggcggaccattgccggaatcactgttggggtgcacaccatcagcgcgttcttcaccgttgctgccctcgcctgtcgtgcggttgccagtcctggtgtagaccatctggaggggaaagcagacgggggagaagaagaaaaacagatgctcaagaactaagctttattatataggaattaaaactgcaattgttctgatctgaattaaaacacttaaaaaggcaagcaaaaatccttattaagacagccatatcataggcacatgatatcgaccgtcgactgaccccaaacaagcaacctaaacacacaaactaacaagcagaaactagacaatcgataaactaatgggaaaacgagcctaatgctcggaacggctcctgcggtcggtggagtcgaaagcgtcctcctgctcgtcacctggtccctctgaacgactcctggagcctgacagatcagtctcgccgctgccactgggagtagcggacaaccaacctccggtaccactggctggacctctggcggctgatgctggagcgaaggaaagagtgaacgcgggagctggagctggagctgaagctggagctgcaggaactgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctcctgacgcctccaccgccatgttagcgaggcaagtccccacgtagccatggacctccaagcggacacggtaaggaagctcgccactgagcggcggaatggtcgtgtattccggcgcgtcggggtagcccactaccagtgtcatgcgtgccagctctgccacgaagtcgatcatgccttctccgcggtggttgggtgggtgaccggccatctagagaagacaaaggagtaggatcaatgcatgctcaaatccaaatttaaataaagcaataaaggactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataatttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaggtctgacagaaatgcagcggaaaaacaaaagaaactggagctaagccttgacttgaacggcagcgggaacaccactccacaggcatcctcgacggcacggacgaagcctactcctcggagaaaccttcatctgacacatacccgtcctctggggttgggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaaga

SEQ ID NO: 41144 - DNA, 29383 bp, Oryza sativa
gccgcagcaggatggtgcggctccgcctcaactgccccctcaccgtgagtgccagcgttgagtctgcagctgccttcgccgcccacggctgcgacggcgcgtccctcccgaggagagagggggagagagggaggaagaaggggtcaaagagagactaacatgtggggtccacatgttagtggggcccataatatttattttggtgaatgaaaaatgggtcccgcatatatttttttaattctaatgccatataagtgctagtcaacaccacgttggaagaagacgaagtcaacaccaccacataatcgccacgtcagtgaaaccactctccaaaaccacccagggagtcaacttgcaccggttttaacaatttagggggtcaaagatatctagttttgtggttgagggtcacggattagatttgggtcacttttaagggagtcaaagtgaacttattcctaaagtctttgctggcttgctcggttcatttaggcccattcggctctaatcctctctcttactagaatgttagtgtgaacctttaaatgtcaaaccttaaaatatggctgaatttagggacgttaacgagccgagcttgagcgagctcgtttgttgaaactcgacacgagtctatttcacccccgagcttttgagtaggcttcgttcgagcttgattaaggtcgaccttggtaatctagctcaaccatgactgagtagtatagcgtatattttagggatattctcttataaatataattatcttgagaaaattaactaagattttgggatggcctgtcggatttcactcaactgctggggtcctctcttcatattgtttctttccctctttccaattgcaaatgccccgacttattagggacatatccggtgaaaatgagcttaagtgttggaaagtcgtgaaaatcatacctaaaagttttataaattcataaaaaaaaatactagagatagtgtagatatgaaatatattctcactaaatatcaagttcaaactcaactttatttaggagtaaaaaaaaagacaaatttcaggtgaatagtaacatgacactattcatctgaaatttttttcctcttaaacgaagttgagtttggagttgagatttggtgagaatgtattttatatctgcacctctctctagtatttttttcatgaatttacgaaacttttaggtatgattttcatgagttttcaacacttagctcttttcaccggatatgtcctccgacttatcagagtaactatgacaattcatcttgatgccatccaaaatggatttatcagttgggtaagaattgctggtaattcaaacccatgttagctggctgccacatgcatattttatctattctttgggaatatatcttgtgcacacaagattattgtccattggtacacagtagctaaacaatatcacagtttttttttaaaaaaaaaatctacatgtactcatcctccatttaagtaaaaaatttcaagtttggattcattacacaaagagcagcaggcaatagaagattttgcaatttctgatttttccttttttattaccgctaaaatgaaatgaatttaattttgaagttttatgcattgatggagtaacagtagaagtacatgaagaccttttctttagaatgtctgatgtttttgttagttgatctatattgtgaatacatccaaaatatgtccgcatacgctatccttattcaaataacagacaaaaagaaatccaagccattcatatctgacttgattcaaaaaaaaaatccgtgtttggctgaattcgtagtccaatacatattagaggcaaatttgtcacccccatgtctagcactccctccgtttcatattacaagtcattttaattattttttaatcaaacttatttaagtttggtcaaacttatagataaacatagcagcattttcaacataaaataaatctctatctctactattataaaaattgaagatatttttgccggtattttggtacgttattcgtgtttgagtcggtttttaagttcattcgcttttggaaatacaaatccgtgtttgagttagaaatataaaaggagtcgtataagaaatctctttaaaaaaactcatgctaacttgagatgaaatacagactcctaattgcagctcatgatttccttaaaaaaatattcaagcgaattaacacagtgaattttagcttacctaaaccgtataacaattataatatcaaaatagcatttacctgttgcaacatacgaatatttttttagtcgtattaaaaatataatccttattacatttaatgaaactaatttggtgttttaaatgctgctaataaacttgatcaaacttaaaataaaaaaaatcaaaacaactaataatatgaaaggatagggtactaggcaaacaaaagtttccaaattctaatccaagccagtcaggtcaggtccattaaaaaactttggaatacggacatggtcgcgtcactttcggcccggcccaaacgaaaccagtccgcctcggtctcttcttcttcttcttcccaatttgcatccctacttccacgggaagcatcaccgaatcggcgagcgagagcgactcctccgatcctcatcgctccctccgccttgccgccggcgccgcgcccccgccggaatcctcattcgcttcgcctcgcttctcttctccgaggtgaacttccctcgatcgatcccttgtgccaagcgcgagtattagggttaggtctctctcttgatccggtggtcgattatttgctctgcatgcgctgtgtagattaattaattgtcctcttggcctcgatcccccatgattggtgatgtagttagggcgcgtgatattcttttgtctgttttttacccggtatctatatccaaccagatatatgtgatatttttaaatcgaaaacttagcccctcaaataatccaatctaaaatttactcctatggagatttgcacttaggactttggagtgctactctacgtgccctttcgctctgaacataagtgggatttggtagctaatagtaagtattttggaattaggaagcattagtaggattcgaacccattgttaaagaaacctattcaccactcactatttgtgaccataatagcattgcattgcaagttatgtaaaccaatggttaaattacattattctggactctatctattagcatgctacaacttggctgcacaggatggtagatgctagatagtgtgccatgtagtattacatttgtataatataagcactactctaattgtaccaaattatcaatctttgttctttgcttatatctcacagatttggatatagtattacactgtatgtaatataagtagagttttcattgtaccaaatgatcaacctctgccctttgcttatctcagatctggaggaactagctagtaccaattaagattcaccatggagccagatgcttctccaacaagtaccacttcttgttccaagcaatccaagctaccattggcattgttaactctggaatgcaacagcaacaaatgtttcctgttcgatccatccaccaagcagacccgtggagcaaccgacatggccgccttcttcctggacgccgcgacattggcgttcgagaaccgcgggtggctgctcatggtccagaactaccgccatagcccccggcgagagaaaacactgcgaaccgtcttcctgtccacgccggcaacggccggcgggtggacctgccggtgttccgctccgtcgccggtggcctcttcgtcttccacatcaactcccatggggagccactggtggtggcctgcgtcgagacggcctccgattatcccaccatcctgccccggcgacgtgtactggacaacctacaagaacacgaacacctcccccccgcagcaagctcgccacgggcggcgccgcgccgcgttcacattcatcgtggacgcggcgttgcgcgggaagcaggtggtctgcgccgactaccgtgggaggatctccgtgttcgacatgacggagacggcctggaggacgccggtgccctcgccggggtggaactggcaagaggatcacttcctcgtcaccgcctctggcgaaggcggtggcgaggaagaggaagaagaggaggtcatcctagtctcatgtcgccgtcacgatgatcagttctgcgagttcaagttcttcaagctggatatagcaatggcgccgtcgccattggacgccggcgatctggatgggttcagctggttcctctgccgtggtagatcctcccgtttaagggaggagaaaggtgggaggaaagtgtacacgttctgccctgaccggctgtggggtgagagcagaacgatcgatcttggaaacggaaagaagaggaagatggctcctttcaatccacgaggtttgatagagaaatccatcacaaatgtatatgcacacaatctggttgatggtgttgttgaggagcttctcccggcatcgattgtgactgaggcacgccattgggttcactctgctgtcttcagtgaaccatttgcctgattctagaatttgggttaattggacctgatgatgctaaattttcaaacatggcatttcagtgtaagcctagtgacattgtcggaggaacttcactgctttcatcttttgacattttcttctgggtaatcacatgataaaacatggttccattcacaggcccttgcaaatacaaaatgttcttggcacatactcatgcgtagctcttctttcagttttctggataagcagattttcagtgtcaggatttcctgaatatgaatccttaagtatctgactggttaatcgagcatcaacacaaagcatccaaagacaagagacagaaaaacgaagcataaaacatctggtacactgataacactgtctgtctactccagacttccatgttacaataccagtacaactaccatatcaacatatgtagcaggctgtccatggaaaatattctgccaagtctatcagactaatgctggctaacatattctgccaagtctatcagactagtgctggctacctagttatgtggatgctacagcctatgtcatggccatgttaagacgtagttagattaccaaaattcgatgcttagcgcatctgatcaaacccaaaacattgggcatataggtcgaagtttatgtttcttgagaggtatagacaatgagacgaaccaaaaggcagactgacagagacaaaggcactgcatccagagttcacagcgaaacaaactcgacgtcgcttacgcatcctccagactgatctttggatgaaccaggtggagtcgattgagaccccgttgctgacactcgccctcgtttcatagttttcttctttgtgcgtggaggtagtggcgcagactcctcgggctggtgcaagtctacagggtatgacacctcagactggctgacatcaacagatcttgaggttgaagcaccaagctcaccaagcagttcgctgcgtgtagggggtgctgcccagcagagtggatccactgaaaaataacaatgtatactcaataacaaatatatcagcaaaagctcccaagaacaggtagttttgacaggatatagctatgggatgaaactgggggaaaatatattcagttaatatcacaacactaaatgatatttagatggtgctaagatcaagaaaggatgtaaagtagcaaaatgcaagggcatcatgagtacatgacttctcacagctcatttgactgaaaataactagacatgcttgcattgcaaagatacctccaactgtgccatttgcgcagcaacttaccttgtttgaagcacgcctcctttccaacaatgtggggaacaagaagttaaaaatgaaaaaaaagtagaatagatgtaacaaacctaggactgataacacaccttgcgcagtctcaagaagctctggtaattcaggagttgctgcatatgtatgcttcctgacatagtcttcttgcagaggcttgggggtggcgaaagagaactgggttaagttaaccccttgcctaatgtagtgtgggttctctgccaagtacctagaatatggacataataattacatcatttcctgggaaatatttcaagaactttccagagcttttccagagcttcgttttgttgtaccagaccaactagaactaggtaccccaagtaatacactagccacacaaaatatgcaacaaaaagagcacaaatggatgaatcccacctcccaacttctaccaatgacctcaacttcttcccagttggagaagtgtagtacctgaaggaaaaaagaaaagtatttcacatatgtcaacctcgagtatcttgtgtgtcctacaagcaatgttgctgttcgaaatatcatataatgaaaaagttcctgaggaaactggcaaacataataatggctgtttgcattattcaagcaggcatatcataaggaattagtgagatatttgctatggtgttacaaagtattaactgaaaactgtagaagtttcatgatcataggtggtactagtatgaataaacttgagatcgcactaattatttagaaagtgttaactaatcttagcagttagcagctagtcaaggcataaataaacaggaccagtgtgccacgattaacatgaagatgctattaggcacataaagaaagaagtttgatatccgaatatggaaacggccaaaaatatggtaccaaatatcacgtactactgcaaatccaggaaaggaaacagtgacatacacatctgcaaacttgctgcaaccctctcctctgattctgacctctctatcccagccaggaggagtctgggaaatgcttgccttgtcaatcgcccacaccctacttccatcctgtgatatatcttcaggatcaacgcaagatataacacggttccattcacgagctctttcacatacaaacacatcctgacaaatattctcacgtatctcttcatatttctcttttgttgggatgatcctccatttgaagcagtgagcacattgcacggtgtaagcaccgatagatggtaaaacagtgttatatccgtgtcttggcttcatgtatctttggttcagcgaagtatagttatctataggctcagtaacttcaacttccccttgtttgtcatacgtgatctcaggattgtacatgacaaggtgctttgatgtgtcttccattgagtaatccttgtggatattcgcatcaccatcactgtcatcatcaataatgtgtacctcaacagtgtcatagaactcgcgaggcttcttttttgaaggttgagacttgcgagaatgaactttcatagtgttggggttatgaccttggaaagtcctcatgacatgctgtcttttacctgtaataaggaacacagggttcaataacagcagcatgatttcagaaagggtatccctttctgttccccgttaaagaaaacaatacaatatgatagtaattcaatgaccagaaggaaatcagtacatcacatgaactgcagcatcaaaaagattatatacaagaagttgaagttcatcaccagtgaaagctggggaatgaaagcaatcaattctgttaactacctcatgcaataactaataagtatatgtctttgataaggttccagttattatgtctttcacatgatgaaatggaaaattcatccattttgatggccggataattgttatatgctagtgcacagatcaaccaagtacacaaaaatattggtatacctaaaacatgaagtaacagaaaatctggggggaaaagttatatcatttccttctgcacctaagtactccctccattccaaattgatctatatatttcataggtacactaagaccaagaaaagctaataactctctcatactatatttactctagcaacaaactcgatgcatccaccatccccactatttcctagccaatagcaaatgtgcttttttcaaatgttttgagttgaaagtttttaaatattgacttgaaaattttcaaatctagccttgaaaatttcaattctcgagtgaaaattttcgaatcttagttgaaagttttcaaaattttcaaatctggacttgaaagttttcgaatatcgagttgaaagttttcaaatctcgagttgaaaattttcaaatctcaagttgaaagttttcaaaattttcaaatctagacttgaaagttttcgaatcttaagttgaaagtttttaaatctcgagttgaaaatttttaaatctcaagttaaaagttttcaaatttttcaaatctggattttgaaagttttcaaaatttgactttaaaatttgaaacttaaatcaaaagttttcaaatctaacttaaaaaattaaattttcaatctgttagtaaaaaaatctcttaaaaatcttcagaatcttttctaattactactagtatcattagtgttaaatattaactaataaattaatagatgtagttaaagtcttaaggggaggtgcttgctagccgcgcgcacgcgctagctatgagccccaagtatcagaccatgtatcagtacactataagtatatatttgtaggtaactactatatatattaactattaaattaactatagataatttagacttagcagttagctatactatcgaacttgctctactatagagtactactccttttaaaataaacgttgatgttagattttttgtaaatcatttgatcatttactaatttaaaacttttgtataattatataaaggtactgaagtattttttttaatagatgatgtcgttgttattttgtcacatgtttgactattcgttttatttaagaaaatttacgtaattatattttttttgttgtgagttgttttatcattcaaagtaatttaagcatgatttatgctccctttatttcatattataagttattttgactttggttaaacttaaactacttcatgtttgatcaagtttgtagacaaatatagtaatatttacaacactaaattagttttattaaatatgttttcataatattttttcttgagatgaaaatttaattaactttttctacaaacttggtcaaatttaaactaatttgcctttaccaaagttaaaacaacttataatctaaaacggagagagtatcttatatatttgtataaaatttttaaataaaacgaataatcaaacatgtgttcaaaagttaatagtgtcatctattaaaaaccgaagagagtatctcaaatgcccggatatgctgtatgaagccaaatcttgaggtgaacctctagattatgtttatcatagcagaggccggtcataaagaatatggagttatgggcgagccgtggtggctttactgggcatattacacccatggttttaaaataaatcaacctcgtacgaaatgtgacacataatagtattataaatctagatatacgccattcgtcccaaaataaaccaaacctcgagtagctagctaggcactatatgctagtacgtatatgtgcgattaaagtctaatttaagagtgcatttagtagagttttaactcctaaatctaacttaaagaggggagttgcggtgtggcccaaactacgctccatcctatgcctatagcctgttccgttttctttttgagcgaagttgaaatattttgagcccaatttaaaatctgacaaaacatgatagtactccataactccaacaaagtcaatgtttttgccaaaaagagagaaaaaaaaggtcaatgtgttctattttggtgctgtgctgggccttccaccagatccatttgtattctggaaggcccattcggaatccatataggaggaggagatgggcccggcccggcccatatttcgcgacctcgcgttccccctcctactccaactccaaccaccccacgtcgtcaacctctcgattccccattccaaaacaaaattaaaaccctagaccgccatgttcgtccccgacctccacccgcgccgccgccgcccccacgccggcgacactcgccgctacggcctctactccccggagcagcagcaccagcgtgcaagctcctccaccgctgctggtgaccgacgtcccgttctctcctcgatcgccgcctcatcgctgtgcaagctagcttaactaccttgatcgatctataggatggagttctaaacagggttcagaatttcgggtctatagatatgaaatgatttcgcccggaatttttggatttcttttcaatttttttttgtgtatttgttcagatttgactaaattttgatcaaattttaaattatttcaggccgaaatttaattccagtataacctgaaaacgacaatttgaaccctgtttcgaagtatactcatttgcttttaagacgcaggcgcatgtacgaagacgagggagatagacgcagagatgatcagtatgtttgctgatcaccggcacactgcaggtgagcttattatttcatgacttatatatctgtgcaaacttaacaccgtacgtgaatgaaaaatcttatgtttatctaatgtgcagatctattggtcatcacaagagaagcttaattaagcccctcgcagctgagtactttaccgtatgatcgctgcaagagccctcctgaaagatttgatggtatacgtagtccagtgtaagaacatggtggtgttcttttctcttgaagatgaagatgaagataaagattaagtattttacgtaaaatgaggtggtattaacgtatgatttattgagttttaattattaaaaacttgaaaaatagattaatatgatattttagagcaactttcatatagaaagttttcgcacgaaacataccgtttagcagtttaaaaaacgtgccacgaaaatcttaatttttatccaactcttgttggagaaaatcttaatctttatccaactcttgttggagaaaagaacagggcctatatggaagaaactcttatgtgattgacatggcctgtgatataccacctccgtcccaaaatataagaacctggaacacgtttgctagtacaatatatatggacaaacatctcatctgattctaaattcctatattttaggacggagggagcatatatttatgtggcacttgtggtaggatatttgaaagcatgtttttaccatatgacactccgctagtggtctagtgcgtttggcacatgacactcgtagtgcattatttggccgatgagagtttttagaggggaattttgtcctctaagttttatatgcttggggtctttggggtgttctctatgattgggtttaaatgaactcttattcagtgtcgacgtgggaaacggaatacggttgtcggacaaaaaggtcccgccaaatgattaatcgaaattaattatacggaaatttaacggttgtgttctagagttgtagtaggatacataggcaaacaacaacttttcagcaggtccacggtattatttttaaatgtataagatctcagcagaatgaggaggatttccagttgcaaaattcaaccaagaccggcgccctgcatccatgatccatgtgacaattatcaaaatcgttggttcctttcattgggcaagaacaaacgatccatgcctcaatgtgtcttaccaaaggtcaaactaatctatttattcttaccggcctaattgaagaacagcaaccgtttgaaaagtaaagattaatgctttggtcgtctataagttctggctcacttggcatgataaccactttgacttatatttttcatcctttggcgtttcataggctgtcacaaacccggcatctcacacagatcgagtgtctgtatatcaacatagagtatacgccattcaaggatatgactagccaatgcgaagtccggtggctaattaccatgctaactaatcaacccagccagatctgcctcaaggtgtatttatacacaacaattccaactcttaaggccatactttaacttgttatatatagactgagaaaagcatactgcattttgatcgacattaatttacgtttaacaatccgttggcgataacatgcaattaatctccagtacatggttccatacgaggttgcaagtgcaattacacaattactcattacatgtggtgcaacaccttgtttatatgctatttcggccagctcaaatggaatttggagatgaaaattaacggcgccaatctgcagctagtttatgattgttagcaacagttcctgaggttgccaggataagagatgtacctgatagtgtagtagcaagaggtgtatagttttaaccccgagatcccgtgttcaatccccaatacactcataatttcttcttaaaaatgttttgagggatgtctctccctccaaatctcgtttaggttgccagcgtcaatcctcatggctgctggttgttgaggttgagcctgaagcagcaactctcaattagtagttcacaattcacatcgatgaaaaaaaaaaatctcaaactgataaccaaatggtttggcatttttccatttttcagcaggaaccatgtccacatgtatgcaaaaatgtcacatgctgcaaattgcagagtatatcacgaaaatgatgtgtctatgaacaacacaagttcctttcctgcaccagaaagaggaagatcacagggctctcaaagcatcgtacgacccagtgattctccttcacaactttgtaatcattctgtaagcaggggcatcataatcatcttgttgatcatgcatgtaatggcatctctttatctcgctttcaccacccaacctgacatgccattgcagccattcttgaaatcgtgtagacgccgtgggtctgaacgtgagacctgacaccgaaatctgttgctgttgactgctcgtgtatctggaatgggacagctactgctaactgatgtgcattacattctttttgcagcctctggtttcaggatgcaaaaccaagcatgataatcggtgaaaattcaggtaggtgaacagcgatcgaactcatgattgaaggctgatatatgtaaaaattggtcgatcatcgtgaattttggtccaccactgtgctgaacgcatttgcttgcagttcagttagctaaccagtttctgaattttggtcacattatcagtcgacagcttcaggtccatggattttcatattctctgaactttgcagcatctcttttaactactccattatatggtgttgcttggttacttgagctaatgatatgccaagcttgcttaattaatctaattgtgttactagaaaatcatggaccgtttcaaatcttcagacaagtatttttctgaccagatttggcctgcctccactgcatcgtacgtacggacacccaaaacgcaatttgctcctctgcttttctactgacttttgattttagtcacgtcaggttctggaggcagaattataataataatttgtttatgtatatatttgaccatatctgattgcctagctaacgtaaccgacgcaatgtatagcttttgttttgttgcaaaaaggctacattttttttggttaaaagggaaaggctatatattctcttctgctagagaatgatgaagctatttctgctagaatatgcctcttcaattcagttattgttaattgtatgtatttcaacatatatgtcgtccttttctattatattattacatgtagatatttagtgctttgccggcgtctagaaaaagatcagataattctcgacatatataggatctcatgcagtatattccttcaagaaataatgcatgtcaggacaggattttcaggatgatattttgttactggagaaaataaatctatagtggttaaacattattaattaaggccatatgctaattctgcactactagcacacaagtgatcaacaggccaattcaactgaaagagacgcaaaagaaaagatcaatcaatcatgcatgcattcacaagaccatatagctctacctaatatctgaagaagaagaaaaagaaattaactaggaagttgatggagaaaggctcgctaatctcagcttgtcatttcctcggccaaagtcacgggtcttgtctgcgggcagctaattaattattcatttgcgtgaacccaatcttcaagataattccatttacctatctcaaaaatcttattaattaattaatagaagccttcttaagaaacacatcataagtcacaacacacgcacacatatcgtatattttgatattaacgaaattatcacgaacgattcgctatcgacatataccgttgaaagaattactatctgtaaatgtaatcgcggtaagaaatctacgcacttgagctttactcgctttgctattattagaattattatacctacatatgtccatctgtatatatatacactcactgatcgagctcgaccttgttgttgtcagttgcctaataaacaagaaatcgtgtgaaattaaacctcaccggcagcacaccgacaaacataatttggattttggagtttgaaatttccgtcctggatactgaagacaacgtacaaaactgtctgaagaaaatgtacgtagaattaacaggttgagacataagattattattcaggggccgtgctgaaaatgattgatattatgtcattgttagactaactatacaacccgtgtatgtgtttgaacaaaacagttgccccacttgtccataggaatggccccccttctaacagtgatatttcttggcttaaatttctttttttgaaactcaatacgaacaccaatgtatatattatacactcacccccgtaataactgcacaccttatcccacatcacttattactgaaagtgtatatatatggtcgatcttaaatatgagcactcatgtaagtctaagataaattaacctagaaggacaactcccacgcgaaaaagattaaaaataaattacgtacaccgatcgagttctctccttttcctttatagtgaaaatagattacatatcgatctttggcttgtatcaatagacacaatgtattgatctctttcttggcttaaaattaatcttgattattgcaatgcgtgcatccatgcacgtacgtgcagtgtgagtttacctgaaccacaaaattaatcaaatgcatgcgagaaaaaaattacaactctactgaaaaggatttcttcatcttcatcagggttgatcaatctgtgcgtgcgcgtatatcttcttgctttgaatctgaactgttcaaagaagaacactgttcatccaaccccaattaattaattaattagtgccatctccactcaaatcatttcaaccaatttgaccagcgccctctctgaattcggcgccacggttccatcagtcatacggcgacatgcaatataatcaacgtccaaattataatccgatgctaattctgaaccgtgctaattgcgtggtgcttaattaatcaatcattctctgcagcaataataatttagtagtttatccagacagttgcgtttagatgctgtcactacgcggaaattcagacaaactaaaccagattagaaaattttgcttggcaattggttgactggcttggctggctgacaatcgtgcagttcacgcagcgggagacgcgagatgatgaagggattagagatgagattacaataattaattaagggagggattggtgattaattaagatatttgcatagattaaggggggtgaaagtggccggccaactgatcttaggccgtactctagtcgtccccaatttcgtactcctctttgtctgctgcatcaccaataaattacttctttcttgcatccgggtccatctagctaattagttgaattatttaccatgtatatatcatgtgtgcacgtacaataattgatttggccattaattatgtatacttggcacttgaaagcatatttttctcatatatgtacatattgtaagctgtttatgtttgtcccaagttaaatttattaaagtttaactaagtttataaatgaattaacaatattttcaacacaaacaaatagttgtactccttaatttaaaggaagatatatggtgatgccaccccacctactttcattgtaatttttttaaattactactcaaacttcttaatattgagaaataatcggataggcacatataaaattgaattatggtaagaacataccctatagaaaaatgatgtgtaacacataatattataataaaatttcttttatccgtattaagcacatgcattcagctagtgctataaaatatattaatattcaaaagtaaattacattttgcactaggtaggttgcacagggccggtttatcatgtactttgttcacattacaccatggtgcattgaaaagatttcactttaatacactatcaaaactatgaaaatttcaagaaatctgaatgaactttcgtaaaacatggtctaaattcgaaagattttgtaagctccacttagatattttataagattttctttcaattgtatgacaccacctatagtgcaaagtgaaacttaattatttacacttgtgtaaagtaaaagtatgtagtaaacctagtgttaaatgaaacatgatacaatttccttggtgcaaaatacaatttagatttaacgaaactaatctggtgttatagatattattatgttttctataaatttagacaaatctaaaaaaaaaggttgtcttagaacaggctaaattaaacacaatggaacaattcaaaagcgtatattcgcgggagtaacacggtgtgcggtgatatgagtgttacatttcttaattatgtaccgcattctacacgatggattagaaaatgcttcacatatttgaatccggatttagtatataatgttgctatccacaaagggatacgtgtatgcagaagcataactctggtagtacataaaagaataccagcgaattgaatagtgaaaaaaaaagagagatgaagtggtcggtatgtccgtttagttcatctaataatcctgcaagtaattatagagtcaatgggtcattagtactacggaaccgtacttattataaacttaattatccggccgtacattgctaatctcatcgatacatctggccacttatccgttgatgcatgatgattagtcaacacagcaggagtattgtgtacacgatttggtaagacgattattaattgggatgtgggctgtggccaagttcacacgtacgtattagtatttttaagttaataaaattgcgtaaaacactcctagaattgcatcttatctccttaaatagatatctactccactcgatatcgatagcaaaagaatacctttttggactttaaaaagttaacaaaacaaaactaaaaccacttattctttacatagattgaaaaacaatcacccccaccattttttcacaaacatgtaaaaggactgcacgctaatatattagaagaaagcagggttttggttacagctaaagatcagccattgccaaggaataaggaagaaaaaaaaagggaaagaaactgaccatgcaaaggcaaataatcttggtatgctactgaccacatggtggagcttatggttggaaagaaacataagaatttttcgtgcaaaaagttggaacaagatcgaggttgagcagctcattttaaaccgccctgaagggtgtcccttttttctttttaactaagtggacttgtgattatcctctaatccccttgagcctctaaacttctttcttattatttttttgaactttactcctcctcaatatatccggtagagctactgtcatagtttccttaaaaaaggtatttgaaaacaataatcaaatatacaagtgtaatactataataaagttttttcaataaatttttcatatgaacaataaagattacattttaaattatactctatctgttttttaatagataacgccgttaacttttaaacacatgtttgattattcgtcttattcaaaaatatatatgatataaatcatgctttaagtactttgagtgataaaacaaccctcagcaaaataaattataaatacgtaatttttttaataagacgaatgatcaaacgcgtgataaaaaaaatttaacggtgggattcataatttggaattacaaaataaatgtcttttgagtaagtggttgtacaagctaataaatgagaaaggggtttggcagaacttattgaaaaggaaatatctttataacaagtctataacccaagtggacaagaaacaaggtgattcccttttttggtcagggcttatgaaagtcaaaagtacttttttagatataggctcttggattgtgaatgatggggaacaaataagattttgggaagataaatggctaggtaacttggctttcaaggataaatttccatctttatatgctatagtccgaagtaaatcatccactattgccactgttatgggatctgttccgcttaatgtttcttttagaagagctttagttggtcagaatcttgtatattggcatgaattgtgtgcttctattgtacatattcaattaaatccttcttctgactgttttagatggaattatcatcagaatgataggttctcagtaaggtcaatgtatctagctttaattaacaacggttatattgagagaaacaaatatacatggaaatttaagatgccgcttaagattaagatctttatgtggtacttgcttaagggagttgtgttaaccaaggataatttggcgagacggaattggaatggtagcttaagatgttgcttttgtatgaaaaatgaaactattcaacatctcttcatagattgtcattatgcaaaattcatatggagagcagtttagttttttttggttttaatcttccaactaatatatctcatatatttgatgggtggcttttgggggttgataagaaaaagagtaaactgatactggttagagcttctgccatttgttgggctctatggttgagtaaaaatgatttggtttttaataaatcaccatctatttcatatatgcaggtaattttcagggcaatgcactagctccggttttgggcacagctacaaaggtgtgaggatgatggggagttcctaaagattgcatgccgcaagttggagtcaatggttatgcaattatttgccaattatggatggaggttcacaaatagacttcaataaatgtgttctccttattttgacttggtttcctctgtttttgtttggtgtgtcctatttagctgaactacgctcttttctagattgctataatgtaataattggctgtagctctttttgagcaaaggccgggatgttaaattccattatctaaaaaaatctattaaaaacagagatgatattaagcacgagtaacttcaccttacattgactgcacacgtcgatcctaattaaaataacattttctttcttaccagagtgaagactaccgtaccggctaaaatcaactgagtttatttaatctcatatttaaaaaattaaccccctatcaaattacaactataaaacactcacccccttagcttcccaacctcctaatcatacgagtttggttgccatttgacaccaccacgtataggaattgaagtgatcgagaaaagctgagaccacgtcgtcgtcgtcgtggtggttgtgcttctccaccaccaccaatccgaaagatccaaagaatcaaattaagagcttagctagcgatctcgatcgatcgatcgagcagccgccatggccgccaccaactcatgatacgaccagaatcgccgccgatcgacgacgaccaagaaacgtagtgcggtgtggtgtttgatcttgctgcggcctcgccggccggcggcgatgatggtgatgggctacttgctggcgcccaagaagggcgggaggaggaggagggggaaggatcagccgtcggcggcggcgcatcacggcgataacgacgatggactccgggagacgctgctggagcagcagcagcagccggcgtcgtcgtcgtcgccgacggccggtggcggcggcgtgccgaaggggtacttcgcggtgtacgtcggcgaggaggcgcggcggttcgtggtgcccacggggtacctccgcgagccggcgttccgggacctcatggagcgcgccgccgacgagttcggcttcgcccaggccggcggcctccgcgtgccctgcggcgaggacgacttcgaggatctcctccgccgcctccgccgcaagaacggcggcgccgccgccgccaaggctaagaaagccatcagctagccacgcgtacgtatacggtatatataccgtatatatatatacacgtacgtatttacactaattttatggattatatagtacctaaaatactggattgcttcaggtgcaagtgcaaaatataatgtagagacgagagaaaaaaaattcagaattagcatgaatatgcatgggtagctagcatagttgcatcatgctgcaagcagatgcatggcgtgttcttggtgacttttgctttcaatccatggatttctggagaagcaattggcttagacagtagctttgatgtgcatgcaagttaatctatggagtagtacatttgacagagtgattaattaagagattaattaattctagtttctttctttgagccatatatatatagttcatggtggagagagacaaatcaaattagcagatgaaacagcaaagctgtgaactgcaaaaaagcatctgcaggagaggaatttctgatgatgattggttgatctgaacttggaggaatttcggttcaggttattgtacataaacccaaaagatataaatatctatagggttttaggaacttgcgcttttgcgtttttcaagtactgaaattccgtgctgaatatatttataactgaagaaataattttgtttttattggtagttggaggcgataggaatatgggatgatagtatatctatctcacccatcaattgaacgtcatggatcatggatgaacagatgcagtaccctctatgtccattaaaactgaatgggtttttgcaattggcagcatgcctagttaatgtaaactggtcattttcaaaacagaattgataaatcagtcttaacaattttgtaactttggatctggatctgtgcaattcaagaatgcctggctgatcacaatgagtgcagctctgtgctgcattttgaaattcagggaatttttgtgtctgtcagtcagactgtcactaacttatctctgcaaaaatgtacttatttcccagaattttgagggtgctgccaatagaacaaatctccaaatagagcaatcattgtactccccttaccagttggggccagacagtttcgcctgatggatttgtcttgtcaatattatttagagaaacctaattcagtttcaggaactcgcccaagttcagagtaccattgagattggttgttttcagctgtaacttcagattctgagataccaccaaaatgatattgatcttattctttcactcaaaaaaatgttcttttaatgctatcacggctatgtttctacactctacaggagatgatatattcggagatgatgctagtttaattagtattagcttaattaagattcaccaaaatatggagagagtttggtcccaatcccatacatgtgttcctttgaggaccaggtgtgattgccatgtgagcatgtactataatcttaaacattatacaaactcacatgattaagaatatgctagtaccatcactagtcaagattcttcagaatggagcttgcagtaagtaaaaatggcttctttttttacttcaagtgaagagtaggtcttaccctgcctgtgcagaaggttaaaacggtaaaaaaaaaatcccttgcactcttgtgacctaccattgctaatctctttagatacttgtattttggtcagtaattatcattattgttatctgcactgagaaaatactgaagtgtaagccattttcagctttttcagttgcttataggcttcagtttctgaaccaagaatgcagcaaacaaaacaaaccaacatatacatatgagagtactctgtgacacaaatatataaattagtagcctaaagtttgcattagatcattgcagtgaagaatgaatccttcatctcctccccttgtacaaaccataaaattttacatatctcatcatcaattactgtctctgactctcagtctgttgcattgcatcgcattgcagccaacctcttctcctttcttcagcaaaaaaaaagtagccgcgaagaaagaaagcgagaaggaacgaacgaacgcaagaaaggagagagaggaaaacacacacgcacacacaaatggcgaaatggtgttgatcatcatcatctgcacaagatctcggtgtcggaggagcaggagcacatggcggcggcgtcgtccttggccttggcgttgccgttgccggcggcgacgaggcggagggtggcctcgaaggcggcgacgtcgcaggggatccggagggcgccctggtggcggaagccgaactcctcctcggcgtcgcggagcagccgctcgaacgcccagtggccgaggtactccgtcgggatcacgaaccgccgcatctcctcgccgacgtacaccgcgaacgaccccttgggcacgccgctcctcccccccggcgccatggtcgccagcttcttccacctcttgagcagctgctgcagcctcacgatgtccctgatcttgttgctcgccctgcctacaccgccaccctgatgatcctccattgctgctgattggagtgaggtgttcttgagcagctgcaggttggttggttgaatggtgggaaggagaatggaatggaggagatgagatggtggtggtgagggtgagaatttataggaaggagggggtttgctgcctctggctgtgagccgccgtctcgtgagctctcgactcctttttcggttagtttaactgtacaaatcgatgcttttttttaatggtagagattaatgattcttaaacccggtttgggagcttaaaattctgagaagcaactaatacattttttggattctacaactgctaaaatctatattgtttggaggagctattatagtagaagatgcaattgtcagaaactccacccttagttttttttgggaaaattggaaccatgccattataattttacaaaatttaagatatgtcatcatgacccacaagtcattgatttatgtgggtcttacatgtcattgagatacctgtttggcagggctctctacctgttacagtacggcagatctccacaaagatgaatctcctctgcagtacatacttgtgtcactgatatatgggcccaacccgtgtggggtccatatgtcaatcacttgaagtcatagggcattactgcagaggatctgtttccaactgcacaaatgaaaaggtgtttttttttcttttactcttataattttactactcccttcgttcgcaaattataagatttcaatgtgtgggaaccaaagtattttcagccaatcagatgattaggagaggaattcaagcagtttaaaatttgaccaaccaggtgattgaaaataaatcttttcccttaatattaacatttagtaatcaaccgaaaaatgcttatatttaataacggaggaagtacattgatactacgggatcactataactgaagcatacatgatgtgggtcaaggtgattggtgaaaactgaaagagaaatgctaccccatctgaacatattgacagatttactgcattcaaatactcaattatcttggtacctagtacttactaatacttcctccatcttaaaatataactatataagaaattttggatggatgcgacatattctagcactaagaatatggatatattctctatctagatttataggactagattgcatccctttcattcaaaatctcttatattttgtgacagattgagtagaatttaagctgaatgttctatgggtgttgtcctatcatggtcagtcagtcaagattgtgggtatggcaattgattctctcaagtacaagatcactcatttgctggttgtgatgtggaaaattcatgggcttttgtttacagttcagaaagaaatgcagagttggtggtggataaagaaaatgaatatttttgccttggtttctgtggtgtatgggtgaaggcaattgctcaagaactcctattattgctatacaacgatgatagattttttctgttcaatgaaccagacaactcctgaactttttcctagtgtgaagagagcagagtgaaattgctgcagatgtcacttttatagttttactgtatggtatcaaggactagctagatgcttctttgcatttgaacaaacagcatatttcccctgatcaagcaccatttctctacccctcaaaaaaaaaaagcaccatttctctgaagtatcattttgaattagtagagcagcataaatgataaatctacaaatctgtatgtacctgatcagcatcaatttggctgtaagtatggaacttaaaagtaagacctgaattcagagaatcatctaccttacgtgtatccaactaatgaaacgccaaacgaactgctcaagcaaactgaaaaacattgggaaccaaaacaaaatgctcagtggttttcagtcagttagcctgcatatcacaaacaaaaacaaagtttgtttttgaggctctcaacttgccatttggattgcatcggtagattcatataataaaaagttggtgtacttttctctgactagtgcctatgttcttacttgatcttggttcaaggcttctaactttcttttttctcagtttcaaattgtgtgcatggggagaacatggcaggcctgactagtgtggagggagttgcatgcttgcaagcatgtgaggaggcttcacatggtatcatcaataaaaatatgtcctactactttctaagcaaaagaaaagaacaatggaagcactgcaaattaagatgcctctgatgcataataatatgattaattagttctgatcatacctgaacttttaaagtttcttaacatgaattgtgttgaataattcaataaaatgggttgatcaagtgtgaaaatatttaatgcaagattccctaattgtatcaaccagttagacttcacattcttctatgtatcgttatagttttcatgtgaatacaaaataattgttttctgaaggttacaggtacaatccaagttgctgaaagattcctccaccatgctaatcatgagcaggaggacccaaatgagcaatcgatcagcacctaaaacccaattagtatatcttgaactaccatatgcttgattttgttctctaatcattgtgcaagaagatggccggatcatggattgaaagggactaagtcagtatgtcctggtgctctaggtagaatataaactgcaattgtaataagttgcatgcacgtttcagtacaattatgtagagtgtagacattgaatatctcatttttgtactttgctttcttttgtatccatagtttaaacctgtttgatttagattattgagcaaattatccactttatcatatcgataatttaaatattttaaaaaataaacttaataaatagtttgaaacaagctagtggtataaataatgcaatagaagatagtttttctaaaaaatattttttatacacatggaataaataatccgttccaataactattcaagtagctgacattgtaatgaataaattggacttcattatgttctagccaggtagtgatttagttcgtcagagttctcatggttcatcttcttctgaaaaaaatgaacaatcttcagttctgaattctgatcaagtcctgctcccaaataaaatttgcaaacatccatcatcaagcgtcaacggttggattcaaacacattgtaattaatcttgagttcttgactcgaggtcagacctgggagttaggaagaaccgaaatttcaaagggcagaggcaactgacgaagtagtggcgattagttatttcttccctttcagttaaggtggcaagaagctgaagattgtgttgtacgtagttggtcaagctcgatctgctcgccgtgctagcttaatcaaattaattacagttaactacaatagattggtacggtttggattgttgtcgtacgatcaaagaaaagattccctttctcgcagcccaacaataatcaagaaccgatgcagatcaccactacactactggagtggagtaatttgttaatatctctgaacacaaatctgaaaccttaattaatttttaaccatggatcatgcacaatataatacaccaaattttcttgttggaagaagctacctgcatgcgcatgtgaagcgatcatggaggtttgtagcaactagcaagggcatctgtgatcgatcatgtgaagtcaaattgcaacaaaattttgtcaggtcacttctgcatttctgttttggtatgaagtacggcccagaccaccagtttgttatgcttgaacagccagcagcaagctagccatttttaaatgaaaacccccattctctcggaaaaaataaggccctgccagtaaggccccccccctttactctggttcttcttaagatgagctagcaaaccactgtcctgtagctggaattgcagataagatagatgtactagcatttaggacagtagtgctatctacagagtatccatctatctattcctctatctcggaatataaacggaagctaaggaagtatatatggaattaaatgaaaaatggctgtgatcgattgatatgggtatatatatagctgaagaaactaaatgagatattgttgcgattagctgagatatgagagtaacagaaattgtatactccggataaattttaaatactaaaagttattacaatttaggacgacatattaaccgcgccggccgttgatgtaatgctgtagcttgtgaatgtagctagctagtgcgggataacggcagcatcaaccatcaggaatcggtggtcgagcagatcaaagcagcagagtagggaccaaactgaacattttggacaggcatgcttgcttgcatgcattcacagtagtttcagagaacggcaaccgaggatatctaactgcagatacgctgctgaacttctgcccatcagtactcctccgtccaatttgaagtgtagttgtgtatttctgtgtccaacatttaatcatttgttttatttaaaaatttataaaaaagttttaaaaaacacacataaagtactattcatattttatcatctaataacaataaaaatactaattataaaaaaattcaaatgaggcggacgatcaaatggtagacacagaaactcatagctggacttaaaatgggacggatggagtagtaaattactagtaacttttgctcttatcttttaaagaagcaaaggtactacatccgtatcaaaatgaaaatgtatgattgataaccctcattcaattatctctacctacttttttaatatctgtgcctgctttaaaaatattttacattctgggatggagatagtatatgtttacacgatggtgtaaatacagaacatgcatgcttgcagagttgcagatgatgcagtttcttgtgtccaactccaacggggagggatcaaattgagttatattagctgaaggcattataaactaattggactgcaacgaccaagaaatgcgccgcgcattgcatacataaactgccataaccgttgctgatcgtgcccagctaactaggtaggttggttcaaggtatagtggccagccaatgtcgttgcacatgctggatgacacactacacttgctaggatgaatgctacggaggtactcctagctagcttagctaattaattatatactcccttcgttcgagaatgtagtaacaggatacgataagatttaccatacgataacgaatctagacatatgagatatgtgtagattcgttattttaggatggatctcatcccatccaaggtcattacaaaccaatggcgacaaaaggccacatcttaggtaaaaaagagacaaattttaggtaaaaaagagagagataaatttaagtttggactttgagatttgaagatttggcagtaatgtaattcatgtctatacttatctctggtaaaattttttttatgaatttacaaaacttataggtttcgtttttaacgggttttcacttatttgataattaattttcattagatatgtcttaatatatctattatcatatcatttacaaccaatttaattgcttttttagtaggtggatatagaaacgtagtacatgattaatgtctagctaatgctatattattaaattattttattatagtctgctatatctggttacatatatatgatatttttttctcttctctctccaacttaacacaaatctgagatagcaactcaaataaattcatttgcatcttcttattgccgttggcgtgacctgcagccgttgtcgtgtcatcgatctgagagtttagtagacagtggcaagggcagggcactctgttttgggcctgatttcgtaggagaaagctcgcgtcagcgagtggcccgtcaaaacgagcccacttcccacacgcaagagaaatagaggcccagaatagggtagtagaggatattggactgggctggccggccttacgatgcatccgttgaaattgtctccagtatttcgcactggaataagttcaccggacgtccctcactttacgccgagtctgtttgaggtcccctaaccgcaataccagaatgtgtacccctaaactatgtaaaaccgtcgaaaaaaggtcccgagacagtatttcgctaacgtggcatcctagtcagcaaaaataaataaataaacatatggggcccacatgtaagtgagagaaaatagtgtgggcctcacatttctcctttcttttcttttttctcttctcttctctcctgattctcttgagcaggcgcggcggcagacgagagagaggtggctggcgacggagcgggggctgtaggggagggggagagaggtggccggcgcgaggtggccggtgcaacggcggtggcgggagaggaggtggtcggcgcgacggcagcggcgagagaggaggagaggagtcagtcggtgcaacggcggcggcgagagaggaggaggtcggcgtgacggcgagctcgtcggctagaagagtagcgtgcggcgcggcgtggcaaggcggtgagggagaggagtggcacggctcccgttttctccct

SEQ ID NO: 41145 - DNA, 41369 bp, Oryza sativa
aacctctataaataaacttttaaaaatacacacctatatatatatatatatatatatatatatatatatatatatatatatatatatatatatatatatatatatatatatatatctactactacttaaaaaataagaggtgcttccatcgtccatcaaaaaaaccgggtgaaaaaaaaccgggcagaaaaaaccaagtttgtccgataaaaaaaccggacgaaaaaaaaaatccgatccaaaaaaaaagtgaaaaaaaaaaccgggcgaaaaaaacacccgtccctggcaaaaaaacacccgatcccttaaaaagggaaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaacacttctctaggtgcttctgtcgtccgtcaaaaaacgggagaaaaaaccgagcgaaaaaaaaagaaaagtccgataaaaaaacctggcgaaaaaaaaccgggcggaaaaaaaacaaatatgtccgacaaaaaaaaaggaaaaaagggaaaaaaataccgaaacgaatccgactacatcgacgcggtaaaaagagtttaaaaaaataaaaagaaaactgtcctattccaaagaaaaatgaattatatgtatcgtggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaatcgaccgggcgaaaaaaagaaaaaaatagtccgatccgaaaaaaacaggagaaaaaaaaatgggcgaaaaaaaaatttgtccgataaaagaaaaggaaaaagctgaaaaaaatctgactccatcgacgcggtaaaaaaaggcgaaaaaaaactttccgataaagaaaaaggaattatatgtgacgcggtaaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtatatatatatatatatatatatctcaccacgtacatatgtaaaattctaagatcaaaccttgagttattgacactgacaaatgaaagcgctcctcactacaaaactttgattattttataaaaacatggtgattttttaaaaacttgagttggtcgtttctctaccacaaggttttgtccttacaaggttgtaaactatatcacctcctctgatttgttttaaaagcatggtagttcctgcgtaataggtggtaatcttcaccacatgtttttagtttccaagtttctaaagtcgtatagcactcggccagtactcgcaaccatatatagtaatagttactcactccgtcccaaaatataataatttaggattggatggaatacatcctagtccaattaatcaatctggatgatgagctatccagattcgttagactagaatatgtctcttccaatcctaggttgttatattttatgatggaggcagtatctaactagtgtttcttcacgcatgatttcattccagtgggtggagtcatgcactataattttaagattggacttgagtttttttttgggagggggggggtgaaagatcaaaattgagttagtgacaatgacatctcacaaatgaaatcgctcctcgtatgcatgtatgtacggaattttttaaaatcgtggtggttcctagctagtactctctccgtttctaaatatttgacaccgttaactttttagcacatgtttgactattcatcttattcaaaaacttttatgaaatatataaaactatatgtatacatataagcatatttaacaatgaatcaaatgataggaaaagaattaataattatttaaattttttgaataagacgaacagccaaatatatctaaaaaagtcaatgacgtcaaatatttagaaatagagggtgtatgtggcaatctccaccacaagtttttttttttgttctttacaaggctgtaaactatatcacctcctcagtgtatgtatgagatctttttctaaatcttcaaatcatactagtagttcctgcctagtaggtggcactgtggcagtctacactctacaggactcaacaattaactaataactcacttagggtaacatctatctgagagcagagatagatatagcaaggggcagagcccctaccagtcatcgaattcttcattgaaattttagttgtggaattgaggatataatttttatagctatatactagatatagtacaggttggctgaactcaaaaatctttctagctctgtcagtgcatagaataaacgttggtccacttgattttttttatcaatcctgatgggtagagtcatacaccgcataatttcatcgccgtagtatcgatgcttccataatgtttcctttttaaaagtatatatatacaatattgcccatgagatgatcctgttaattagacatatatatgccgtgcataattaaagatagcatatggtttgccggtaggtgaaatgaacagtatagctacgcgttcatcacgcgttcggcctcaatggcaaatagtcatgggcgctgggaattagtagtcttcgatcgattacgacgcaaccaatcaattaaggtcgaacttaactacagcttcatcatccaaatatataaaaaaagaaaacgtcagattaacaagattttcttcagtttgatcgaaacctagctagccagcgatcaacctgtacgatgcctacacgcacacgtcgctagctgcccaccaataatggcattgttaattcttccttggcagcaaatgatgcactattttttttattgcaccttgttgctgccgactaaaataacagcgtaacctagtaagaaacaaaacaccagagttagtacctctgtcttaaaacaatataaaattatatgagatatattctagtgatataaatttgatatgtatagactctctgtccagattctctctgtccagattcgtagtcctatgatatgtttcattcaatactaaattgctacgttatgggtcggagagtagctaattggtgatcaacatgacagaaacaacccatctagcgtaggtctcatcggtagataggcttcaactcgatctgatccatttgtaacagttcttgttgcgtgcctgcaatgaatttctcaaacagctagctagctaaccgcaggcaatttatacttgtacgctgcgctaaatgcgagtccatttgctcttttgcgctgaatatggaatggatgacatggtttgtgataattattcgagggtataaataaattaaatgaataaactattataaagttgaatatgaatttaaaacggttttctcatatataaattttttctaaaaaaatatcataccgcttaggtttgaaaaacatgtgcatattatattcgtcacatcattctatcgtaagttgaagatttgaactcaaaatcttgggatgctacttagatcattgcaaccactagactatatgctcattcgcaggggtgtaaatatggagcaagtatactactcactctgtcctgaaaaaaacgaatctaagactagatgtggtatattctagtacaatgaatctggacagaggtatgcccagattcgtagtactagaatatgtcacatctagtactagcttgattttttatgggacggagggagtacatatgacatcaattgatgcaagctagatggttttctgtcagattaccaacctcaagatgcaggtatttgtttcttaacatcgatcaatctataggaataaactcagtaatgatcggatcagtgttgtcgacttgtcttgtccatttgtctcttggccatcgtctgattgtgtcccttccaatgcacaaacgggcgtaactgtcgaggcaggagccaaagaacaaagctagcagaagctctgatcacttcgtgtccccactccccagtgggctgatgatgacctgatcacttagcttgcaatatggctgacttgaacccaaattaatgaagatcaagctcaattatgcagaaatatattccacttatccatttttatcctcctctgcattatcttcatccattattgccgctttgacctgcagctgcatgcaaatgcaagagaggatcatatgctgctggttggccggtgaagccatattgccactgcatgggctcatgcacttggatgcaggacaagtgttcatataaacgtacatgtacttgatgtactctgaactcaaagatagaacatggcctgaatgcagtcagctgcttgattgcctcaataattctgcttgtttattgccattttcagcagtatgattgtccatattgtatttatgccttaattgctgccgttagtggttgcacatgcacctagctagtagttgacaatcaagtaccaagtatcaactatcaacccatggtcggtataatattcttcagttttccatcaagtccaactttatgtacaatggagatttcctcgatccaaaatccaactttaatactttgtgtacaatgaagatttcctttttttttatccccaagtccaactttgtgtgcaatgtaattgtagatttctttgattttccaaggccaatgtcaatttgtttgtcaccataattaataaaaaaaacaaggcgctggaaaataccagcgaatcggtcattgataattggtggcaatatattatcctattattacaatgaaaaataattcgtggcaatatattgtcctattgcaatgataaagggcttgttcagattgtagccaaaatgaacattaccaaattttggcattaattttggcaatttggcaatattgacaagttttggcatgatttcttatgatttaccagagtttggtaaaaaactaaatggatgcacatatttggcaactttgctaaaatttggtaaggtttattttggctacaatctgaacaggcccaaaattttctgcaacaaataaccatattttgttgaaatgatttataatcgtcgttttattcaatatttttgttgcaaaaggaaatgagctatcgccacacaaaaaagttattgttgcaaaaaacatattctatcgccacagttttatttttctgccaatttgcatagtccatggccatgataagttacttttcactattttctattgctacgattgttgacgaaaaaatcgaacacaccggcctgagagatctgcttaactcctgtgcaggtccaaaggttgatgagatgcgggcgtgccagtcaatttgatcctgcaactgacaagatatgtaaacagctgatcaaatagccgatcggctgacaagccgatgtagtagttccagctgatagccgataatagccgatgccgataccagccgatagcaatagggtttaagcaatcggctatatgtccaatatagataatgatatataaggcaatcggctgttgatgatgtgataaaataacaatataatcgagtagaaaccaatcggctagaaacccaagatatagatagaggcacctcgactcctgatatgggttcacaagccattacatttcggttgaaggtccgatgtcattaaatccacaggattagataaacagtaaaaactatgttgcgatcggctaaaatccaacttatatgtatatgcaatccttacaagccgatgcaacgttcagataacttatcggctagcaccccgataaaacattagcatgaacttttcggcttaacaagacttatattatcaacaacaatctagtaggtcgaacctaaccgatgcagtatgagattgtatatgataatctaatactcgatgagccgatagatctatctaatgtgatggatataacaaatctatttagaacaacattgtgattgtagagatatatcggctaagacagaagatcggacctaaccgagacagttccaacaaaaccgatgcgtctctaaacacaatgcgattagagatagaattgagatattaggtaggcaaatatatcaaccaaaccagagcgatccaagagatcgagacgatgcagccttgaacaacaccaatacagccaacagattcaccaaggcccgacggaacgtaggacttatcccttcaccggagatcgaaacccgatgcagccccgcgtcaggtgcccaaatcccgccggaagataagtaaaaaccttagggaagagggtggcgatgcgccgagagtagttgtattgatcgagattgatagattacatagaccccgggtgaacatatttatacccatgggttgatacaagtccttgttggacaagaaagaaactatcctaaagataaaaggaaaacataaagtccttatcggacactaaacacacttttctaaagataaaaggaaactaacaaaatattcctaattaatagataaactgccatgccgcatccttcttgaactcggactcttctggataaattccctttagttgatccgactccatctagaacacggttgctggcgattcgacgactcccatcggctgattccataactctgaagccgatactgactctaagccgatgatgactttgggcttaccaaatttcactattaacaacgatcaacaaatttgttgcaataaaaaaatttgttatctcataatttaacttaattttttatatggacacggattgggacaaactttatatgaaacttataggtctagatgagacctacaattttataagtgacatctttttcatttgaaatcttttagatactcaaatccatgattcaatctcagctaggtggctcaaatgaaaagatatgtaatttctaccataattgatgcgtaggtgagttagtaaaggagagcgtgcgtgggagaggtcaagggttcaaatcctaggcatgacaagatatgaaaaagaaatagttatgattatagtttaatattaataaaaattttgatttgatatatatatagctaatgccacgtatgaagtagtggcaataatcatttattgcaatatgactttttttgctacattgtggcaatatcaaaatttgttaccacccaataaaaatcgttgcaataacctattaccactatatttgttaccacggctagcaacgattttataatggtggcaacatgtatctattgtcacgattttaacattgatgccatgatgtttttcgtggtgataaaatcattttcctagtagtggaccaggtgtcatattttggtttttaatttgcaatttgcgtagctttatgatggtgttttcctactttttttttctatggaagatgtgatatctagcacgaggaattgtcctatgttgaaaaggaataacttagtcttgaaaacacagaatttttaattgatcaaaatgaccagaagcagaggtcatccattcttcagcaggtgaatttcaaagatcaggttcaaatttgctagtctaaacttagttataaaagacaaataattgtgaagaaatccacgaagaaaatctcatcccgacaggtactaatcagcccgggcttatgtagaggtcatccatggcccatggttactgattacatttctgttaatccacagaacacttaatttttagaatacaacatataataggttcatgattgcactgctcacgtttacaaaagaattacaccaacttcttcatggctcacatagagttcttctctaagtgagagcatttctggagttctcttttcttttgtcctcaccaattgctggtgaggaggtattgtacctacagaaagagacaatgtttcttacttcagaagaggaaagaaactctcttggtactcagaataatctcttataatagtcttctccaatgattgattttaaaacaaccagatgcttcaaagccaatgcttcattgccctatatataacaccagctgcagaccggtcttcgcaaaaaggcactccatttgctttgttatactcatagctcctttgcttcaaaatgacgagcatttaccaagaattcattcataccaagtgtcagagcttcagaagcatttgtagatatgttcttcattcaattgtcctcatctatagattcgtttccttgcatgttcacccattctggatccaactgtcctacttcttcttaattaacctcctaggttcagttttattaatgtttctgaagccaagcagcccaaagttcaagccaggttacattgacatgttgttcttgtcaacctctgctatgaaaacggagcggatacgaacggataatgcttataccatattcgttttcatattttttaccggataggaaaacgaatatggatagctcgaatacggaaacaaatacggattatctcgaatacgaataagaatcgaatatgatcggacacgaatacggaaacatttttttctcggaacacgaaaaccaactcaacttctaatagaaacaaatatcaacatatataattagctcattttatataaaatgaggtataatttataaatattttttaaaatttaaataatattaatagtatggactagtgttaagagataaactactattaaaaatctataaaggtatattgaaggttatagagttagaaagaaatggggtatgtctcatgggtcctgcggatatccgaatagcactgttcaccggatatccgaattattatccgtatccgacggaaaccctgataccatatttgtattcgtatccgggagaaaatattcgtattcgtatccgtatctgaactatccgagaattatccgatccgaaaggtatccgtatccgtttttgtccggatcggacagaaactatccgctccgttttcatccctacaactaacccatagatttgtcacaattgggggatttactgttaccatataagttggcccaataggcacaatatagattacatgactagaggaaatgaccaaaatacccttcacatctatacctttaacaccccctatcaaatgcaatgtgtatgcaatagcattgcttttgaaactagacaatgggttaatgaggatgatgatccatatatttcattttgaaactaaaatcaaagccatgcttgaaaatattgttgaagcgtgcaattcttgaaaaatgatgacgaagaagaagaattcatcccctcctcaatgaagtggacctcggttcttcggctctcgttaccttgaagccttcacaaactattcttcggctctcttcactaaatcggagacgttgatgacaatggtaaaggaccttcacatattgttcttcagcccttcactgattgatgatgatgatgatgatggtgaaatgacaatgatcagctctgatgtggagctgatgaagttggagatagattggcatgactttgacgaattgaaggatgtgcaatgagtttgatggactcgatggcaactagcaaatgacacaatgataccagtatatatgcagctggacttgaatagatagactagataggaaacaaaagaaatcgatttgtagagtacattgatatgccagcaaaagacaaaatgctggctgcccagaaactgcagactagctgattctatccaatttggtagcagagagcagcagctgatgaagatggacaactcctggtgatgaaagaccacgaaaactttcagtaaagcacaggtttggacagcaaaagcatgaccaggagctgtgagcaactctttgaagcattttgtcaagcaccttgtgttagtagttgtgaagaaatgatcaggaaatcaacctaatgaataaggtggtaatgacagtagcaagcatgagaaataagatgatatgaattaatgagccgagcagagaccaatccaagccatgcgtagaatggaatttgctacaatgctgctgctagcccagaagaaagaagaggcatttgcttttgctgctgttactagctgatgaagaagagaaccacaggttgccactgctgctactaaagatggtcagccctaaacccaacctatccgaagagaaagaagacagaataaatatgcagatcagacacctttctttggtgctgctattggttgcctgctgaagatggacgacgatgcaatgcatactgctggctgctgcttgtttgctgacgacggcgccgcggctggatttgggactgagatcggatctgatgacctcagggccggatcgagctgctctcaaccaagatgacggctgccgctgcacctagttgacgaagatgacgactgacgagacgattggagttgatctgaactgaggtaatgatgtgatggggttttgggcatcgagccaccggtggcttgccggagcgccgaccgaggctcgccggagtgacggctggggctcccataccatgtcacaattaggggatttgctatcattgtatattttttttgactgggttatatattattatattgggactatataaaaaaaaactgaaaaaactttcaattctaactaaagtataattatagagggctgctacaaaacgggattccgttacaacgggatagacatattaactattctcttgtacgagtatcataggtattaggtcctaggtatcacaggtaccgggtaacaggtatcgggtattatgcagctgataccataataggtatcaggtactgtctcatataagggtatctcgttccaatgggataccgttgtctaggttttctaataattataatataatttcactataactatatttatattataacttgtatataagtattttttaaaagcaaacttgtatataagtattaaaataatatatgcagctatatatatgacttgtgaagatattacaatgtagatacagtagagtataattacattgtagttacactacaactatactcaagggcaaattcagtgtggatactagggggaggacttaccccattagatcaccattgatagaaggagatgaaatgagaagaagagggaaaaaatgaagagtaggagggactgaagaatgaagaaggactaaagaagaaagaaggagataagttcccctagatctgtccctaattatactatatactatagttacactttaagtaaaaaacttacgatattttttttgtctaaaaaacttacgatattttttttaccaattctgtgttatattaccacagaagtggcccaatagacaatatagtagattacagggctagagaaaatgaccaaaatactctttacatctatacccttaacaaacatctatacccttaacaaggttgtacttaacaagataaaaataataatattctgtctttctatgggaatatttctcatattcttcttttttttagtgcatatgggaatgtaggactaaccactggttacagctgttcgaggttgcaaaaactgcacccggggagcatctgccaggacaagccgttcagcttgtccggatggtggagcgatgaaggaaagttgctgctagtctttgtgatgctctatggaaggctcaaggccttcaccaaaggtacgggtgaatattggaggctatggtagaagctgaagcctgaacagaatcacttgcaaaggcaggtgaatcaagtgcagtgtatgtaactgtttagggccttttgaatcgtagaaataagaaaaatgaaataatagaaaaacacatgattctgacagtaattataagtgtaaaatagatgattgcaaaagataggaatgatcgtttgattggacatttggaccgcacaaaaaacacatgaatcggatgaaagagatagactcaaagaaatttttccaagagattaaatatcttgctaaattttgtcctaaacctacatgtaatgagccattccatatggattttataggatttaaaaaattcaatccttctaatcaaagggtcaaattggaaactttcctataggatttcaattctataaaattccttcataaatcctttgattcgggggttaagtggatccatgccattgcaaatttacccaattgaaaatatatcattactatttatgaaatcaggtggatgccactataatgtttcaaaattagaacatgccaccccgtcacgaaatctgtcaactctgtcatgtgggacctacatgtcagtcccatcttcaccaccctcccctctcttctcttctccccttctctctcgacgtgagatggttgtgatcactgagttcttgacagtgaacctgtatgtatattattgggcttgtatgtgttatattggttgttaattgggcttgtgaaatattggattttaattgagcttgtcagagagtggtcccctccagcgggaggctgtgaggcccccctttgtgagttcggccgggggcacgggtgaattcttgaggagtttttaggacgtatgtgaagtggattagagggggttaatttctaagtgacgatgaggactaggggatgattcttttgtgcttccaaagtctctgaatccctggtgggcaagctaaggcagatcaatcctttagccgctggcctcgaaggttcgatcccccctcctccgctaggcgcggtcctccttttatactctaaggggataccacatgtgccgcaagagccaccatcgggaagaggaaaatattctctacatttaatgcatgtcttgagccttgatccagaagtcatccgcacgtcggctgctgggcaagtcccatcaaatcctgctggctgacacaggggacaacgctgtcattcggtatttaatgcatgaggacctttggaagtatgcatgtaccgagagcacaatgtcggccacgtcccggctggtcaagccggctgttgattggatgaggggcacagagctcctcatcatcatgacgagacagggcatacctgccctcatgccgcctgacatgagctcggggcgtggggggcttgccgctatcccatccattcatcacccggtcgcagaccggtcacaggtgggtcacagacgggtcgcaggcgcacgacgcacgcttcccgtcgcattcggtgcgacggagcgcgcctgccccgcttgccataaatgcggttaggtgggtagcagtcgttccacttaacatgcatgcatggttgccatgcggcacctgcccgaggggctcgggataacccaaaccctcgggcccgaggggtgcgggggtggtcccgagcccgaggggggatggccgccccccacacaaggacgtgctcccatgggggatttattgcacgtgtcctgtgggggtagcctctccctcctgggtttggtacccccggcccccgggcccatatcgccgacagagcttatgcaatattggatgttaattgggcttatataacctatctgatatatgagctattatttggtatagtgcttaggtctatacgggctgttgttgggtgtaatgcttgggcttatataggcttttgaaattggcttagctcacttattaatagatactaatgcaaatggatataatattgggctgaaaactatgagtaaagtgctacatcttaaatggaccatgcctaaatctaattgggttaacccataaacaggctactcactatatggacctagataggccacaaagacattttgtgatgttttctgagatagataatgacaaaaataagtgtcataaagttaatgacgaaagaagaaacgtcactagattaatgacaaaaaaaaaagttttcatcaaagaacataattagagacgcatgataggtgacgaatgaatttttgtcacgtgagcgtcacggattttgaaacatgacataattgtttgtttttgtgatgtaagtaaaacgttacctatcataagatttcttatagttatagttatgcttgaatattcaagtttctaattgggccatagtggataaaaaaacacccaatatcatttctcttactacaaagatacgtaatacttttgcatattttgaaaaaaaaaacccaatatgttgaaattgcaattaatataaaattgttgtttcccaaccaagtccctttttttttacttgtattgagtcagtcgccatcaaattatcaatgcaactactccctccatccaaaaaaatcaacctctccctcctagaacaatatatctggacatcccttcataggacaatgtatctagacatacactgtcctaggttgattttttttttggggacggagggagtacgcatggaatcatccatccacgtgatgtatgtacctagtaggtgctaattctcagtgagtggtcttaataaaccttctccggtgtcttttccaaaatttgacgaattcagagaaatcttaagattagattaataatgatcacgggtttagctccagtttcaattcagtccagaaatgcttttccactcaaacaatcatcctttgtttggatcagtcgggttgtaactgcatgctttcatttatggtatgccattttttcacgtataacgaactcgatctctactcgtcccctggccgaatcttcaagggggctcctctctttcctattatgggagatccacactccaacatccacataatacaatggccaatcaatttgtcaataatacatattggataatgacctaggtgagcatagactacatactgtcaaaaatcccaggtcgcagccatcagatgtgggagcatagacttaggtgaaatcctagaaggtgtcccggcagtaagagcgtaattcccaatgaaatatcttggactacccctagccctaggaaggataaaaactgaaagtgcattaatccccttggtgggtttgggtgattaatgacaaatgtggttaagggactaatgagtttattgagctactttcagatgcattagtctaaggtgtggaagatggatgcttggagaccccccccccccctaaaagtataaaatcaaagcggaccggaactcgagaaatgcataggatagtttatttattgcaatcgagttttaggaaaaaccgtactattaagaggggttccaggtgatgctctgagatgtgtcaagtgctcttagtgtgaatcaagtgacatttccccttggagtcatttttgcaaatgctccatctgtctagaaatgcatgtccggaacttcctgtcttccaggtccggaagttccggtcttgtgaaaaagattttcctaagtgttgtccagaagttcttgtcttccaggtccgaaacttcctgtctagtttccagttcaaaattgtgagtagcggatagatgacgtcacctagccgttatacataactagctcgtttccagctcgttttttggccattccacttttacttttcgaccctagagctgttactagcctctcccaagtgttccttaccttctccactcaatcttgagcccaattcttgtgaaaaagagagattgagagtgagagaggaagatttggagatgtgtgaagactaggatcttgggtgagcacttgaaatatctcgtgggctgtcatctcggtgcttattactcttggagatgatctcctagacggttaggtgtcgcccgcgagaatccgttgcatattgtggatgtcccgggtaagtttgtgaaggatttcctctcctccgaaagggaacgaggtaagttaatgaagttcttgtgctgagattctagaggttttccaagtagagcaactcacacttgtggcgaatttctataagaaggttgagttggatcttggtggtcactcaattctagaaatttgcctaggggtgttttgggttgaaggctgtggatttcctctggggtttttgcacaagtgaggcaaggggttaattgagacccagctctttagagctcctcaacggagagtaggatcgtaagatccgaacttcgggaaaaaatcgctcttgtctctttctgtgatgtttctgtggatgtttctgtgatctatcctctacttagaatacctgtgcatcatcgtgtgaagattggcttagtctcctattccgaaatttgaatttcatctttgttctgttacccggaagttcctgcctaagaacaccggaagttccgggcctagcagaccggaagttccggtgttccttaccaggaagttccggtatgtttgaattttaccgctgcgatttgtttttaatttttagggacagcctattcaccctccccccccctctaggcttcatcagcacgttcaaaaacgtcagatatgtagtccgtcttcgacaagatcaccgggcgcatagccaggtggagggggaagaatgtcacgccccgaactagtaccgaccggaactagcctgtgacgctccaaattaacctgttaatcgataccagtcccaggaaacagtgctggtatcacagggagacagaatatcacagcaacagagatctctttattatagagtagaagtacagtcatgttgggctgcggacagatcccgagctcacaactacattacaaaagggaaacggaagccaggacttggaccaaacatcacaggcgcgacttgggaactaggccgaaaccctaaaactcatcgaagccggcttgctcctggaagaactcctcatcagtgggatccgcttcatcttcttcagcaactgggagggggattatttatatagagcaagggtgagtacgggagtactcagcaagccaggggaaataagtgtttaatgcaggcttcaaggagaggctggtgtttttgcaattgattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggttgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctaataagctagttactcagccaggggtgtcccattccacccatgtagtcgtacttgtcttatgtttggatgaaattccaaggaatcggtccttaagtgcgagagcgggaaaccgtacacccggtacattccccggtccacgattttggaaattcatttagttcgcaagcgccgacccaggtgtcgggttttccaagtcttttgtaaaacccaagttttacccaagttgtttttcagattttaagtttgaaggcgaccatcggtactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgaaatctggagcttgatcctcgaaatcctcgcactgcgggtcttcgggctccgaaactacacgtgaaacgggacaactcaacaaacggcgaaaataaggccctattaatgacctctaagcgtgccattagatggatctcgagatttgaggaattttggaagctgaacggagtcaaacggatttacggttgggaagatattgaatttctaagattattggatttttggtctaaagggaaaaggatttaattaaatcctttttggaaaaagaaaaagaaaagaaaaggaaagagggagggattatagacttttccttgggcggctagggcgcggcccaagggaaaaggagcggaccggccgagctaaatgggccggccggcccaaggcggcccaagtgcgcgcgcgggaggggaggagagagagggccggtggaccgggctcacctcgcgcggtcccaggtgggacccgcttgtcagcggctcggctcaccgtgcggagggagcacgcggcgcggcgctagggtggaggatggacgtgatacacgcgcgcggttcgcggtggacgcgggtgcggcgggtccacgcgcagcctcacggctcgcggtggaacgcgcgcacggggagggactgaccggggtcggcccgtcccgacctcggctgagctggcgccgtcgtggcgcctacgtggctgccacgcgggccggcgggaggtagacgacgacgccggccggaacggacggcagacgacagcggtgagcggcggagcgaaccacggcgataccggcgaaagcgagtacaccgggtggctgcacaggacgagaggagatgagccaacgacccggattcgccggaggatgcccgacggcggcgaattgcggcggcggcatccggcggcggaagaagggggaaacggcgacgaggtcacgaggggccgattcccggcggcgagagcatctacgcggctacgggaatccgatgctagcgtcggattgggcggagctacgccgagcgaggccggcgacgagcggggcggcgacggcggcgagcacacggcgagcgtcggcaacggtcggggcggcgccggctagctacggggaggctactcgtgctaccaccgaaaactaagggggggagatggagcgaggaggaagaacggagggaggcactaccgtgcgggcggggcgccgtgacgagaggccgacggcgcgggagtaatctctccggcctcgggccgaggaagaggaagaagagggcgcgcccggagtgcccttccgcgtcctagtgtgcaccggctcctccggcacacacgcgacgacgaacggcgacggcgaacaggggcgacagcaatggcacggaggcgaatgggagaggaagggaaaggggggaagccgggtttaaatgggcggcaatgtcggtttgggagaggggaaccggcattggacggtcaagccggcgagctagcgctccggctagcggccaaaactgcgacaggaggtgacgccggcgagggggaaaaaggggaaaagagggggagaaaaggggagctcgtcccttgccactttgggaaaaaggaggaggggagcgggagcgtcgcggcagagggaggagggctctgcctccgtctcttggcggcttgcgcgcggggaggcggggccgaggtgatgacgacggcgatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcgcggcttgggcacgcacgctggcttgcggggccgggcggctgcgcggctgcaggcgcggcagggcagcggggccgggcggcgcggacggcgcagacggcgcggctctcgcgcacgcgcgcgcggcgcgcgggcagagcggagggaggggcgctgggcgcggctctcgcgcacgcgcgcgcggcgcgcgggcggagcggaggaagggagagagagagagagagagagagcgccgggagggagggggagatgggccgagagaaattcggcccatcgaacccgggggaggcaaaatagacttttgcggatggatttgatttggaaggatttggattcggaaatgaactcgacgatagatcggggattgagatcttgagatggcacggacactagacaacaagcgaagaaacaaatttcgcaattagggtttttaagagataattttcccgctaggcgccacgacggaacgggcgctacaaagaacatggggccggctggaagagccacgctcgtcaagtcagtcttaacggcccaaccaatctacctcctcaccgcccttagagtttcaaaggaagctcttgggcaactggacaagcaacgacgccgctttctctgggccggcacaggtgacatcacaggaggaaagtgcaagatcaattggacaaaaacgtgcatgccgacttgtcatggaggtctcggggtacttaatttggaaaagttcacgagggcactacgtttacggtggctatggcatgaatggaaggacccaagcaaaccttgggcgggcctagaaacgtcgtgcgatgaagtagacaaggttctcttcgctgcgtcaacaaagataaccgttggagacggaaacacaacacgcttttggtattccgcgtggatagatgggcgcagaccaaaggacctcatgccactggtctatgcaatctcgaagaaaaaaggcaagtccctatgacagggaaaggaaattgatgcttggatcaacaacttggaccttgaagccaacccgtcaatctcggtggaccttattgaacaactagtctccttatggattgccgtgagagacattcacttaaacaatgagcagtcggaccaaattgcgtggaaactcacaaaccatggagaatactcagcgtcgtcggcttaccaggcacaatgcttcggcgcgacagacacgaactttgactcgctcatctggagagcttgggcgccagggaagtgtaaattccacgcctggctggtcatccaaaatagggtttggacctccgatcgactcgcgacgagaggatggcaaaataatgggctctgcccactttgccgcagagaaggcgaaacagccctacatcttcttgtcagttgcaaatacacgaaaagaatatggagcatggtagccacctgggtagcttactagcagctcgaccctgggcgttgggggatgacccaaactgtcaaaaattggtgggagactctagctaacacggcagaggtttctaagagaggtttgcgcaccctcatcctcctcatagtttgagagatatgaaaggaaaggaaccaacgaatcttccagcacaaggaggccacgccatctttgctcttcgtcaagataaaggaagaggcgcggacttggacgatggcaggagcaaagcatttgcgagaccttctacccctccatgtataatatttaaagtgtataaagtttttcgtttttttgtatttaggggttgttttttcttccgctatattcaatggaaaggtacaacctggtgttgttttcccctaaaaaaataatgaagataacattggtacggcgccagtaggtgatagttgaacatgtagctatacgcggagctcacgcgtccggcagcctcagtggcagaaatcattcatcatgggctgccaattcaagtctatgattacgatgcagccaatcaacatctaattaactagcttcctcaacaaattaagctgaaaaaaaaagagatagagatcgagctagcgacctgtacgatgcctacacgcacacgtacgtcgcagcctccaataatggtattattttttttcttcactgaataatgcactttattttattgtaggctgtgttcgcatgcaccttttcccatcccctctccttcgttttccgcgcgcacgcttttcaaactactaaacggtgtgtttttttgtaaaaagtttctatacgaaagttgcttaaaaaaatcaaattaatccatttttaaaaaaaaattagctaatacttaattaatcacgtgttaatggaccgctccgttttccgtgcgcaggagttaggttcccatctcccccatccgaactcagccgttaacgtccagcagccaggttcaactggatcgctccacgtttacattaatttctagcgtcttccatgaacttgtcttctcaaactgctagctaaccgcatgacaatttgtatgctactccctccctcttataatataagcactgtttaaccatttatcttatttaaaaaatttagaattattatttattttatttgtgagttaatttattattcaaagtactttaagaacaattttttattttttatatttgcacatttttttcaaataaaacgagtggccaaacaatataaataaaaagtcaaaatcccttatattatgggacgaagggagtagctgtgtgcatgcttgcgaggttaattacctcattcggtcatagatttacttaacaagacaagattcgatcgatcgaacgaactaaaatccatccataaatcttagtgtgttatcctaaacatttaatatttaatatttataattggagagtagttttctctcttaacagtattgttgatagccaaatttgtattatgatccaattatagcaaagtttagctgaattcaaaaacagacccgaacttcccgtatgagacaagtctaaccttaggtatatggcgggtctgaccaggccccaattggaccttaggtgtataatcttagagaggggggtggggtgggggtgggttgtgttttaatacaacgcaccacatctgtagtatagtatatatatatctctctagatatagccatatttcaagctttcagaagttcattgcaggtatgcaagtgatgtatcatctctgtttatatagaaatgtccatactacattcgtccttttttaagtataattatagcttttcgtgtctaacgtttgaccgtccgtcttatttaaaaaagttatgaaaaaaaataaaaaaaaagtcacacataaagtgttatttatattttatcatttaataacaacaaaaatactagtcataaattttttttcaaataagacggataattaaacgtttgacatatccggtgtaaaactatggtctttctggtatttatgacgtagatcaatcccagataagattgagggatttctgtcagagattaccaatcaacctgaggaacctgcaggtgtttgtttcttactgcatcaatcagcctgtactacgaacaagaacaaactcagcaatgatcgatcaattgtcccaagtggccatgtctcttgtccattgtcggattgtcccttccaatgcccaagcaagcgttactgtcgaagctagagccaagcagatgagctagcagaagaagctacatatgcaaatgctccatcattgtccctttgaccttgatcagttaattagctgcatactagtctgtccaaaaaaaaaagtaaactctagctacgaacctatgtatgtacggaggattatgcaagtgagagagagagaggatacatgctgctggttggccggtgaaggatgctttttgcatttgcttttgcatgagctcatacactactgagatgaacgtacctgtacttgatgtactctgcactcaaattaaagatagaacatggcctcaatgccttcaatcattctgcttgtttattgccttctttaattagcagtttgattggtccattttgtatgccttgattgctaccgttagtagttgcacatgcacctagcaatagatgccgatcaacgttcccatccatggtcagtaccatgttcttcaatttttccaagaaaagttttgtgtacgatgaagattttgttccattttttccaagtccaacttcaaggaattaaatttaaaaatacattatttatttatcttttcctcaaaaatatacgagatgtaatttctttggcacaaatttaccaccgtcgttgagtaggaatgtgaaaatggcacgttatatatcgctgaaccgttgcacgaaaataacgacaccggtggccacgccgcggtctcgcaggacggtgccacgagggcgcgggacccagcacggtgtcattgggcgagtgtctgagacaccaacaagcgagatgaaacaatgattagtgattaattaattactaatgatgctgattaaagaaataacaataattagtacggtctcgcttcaccaactactagcaaaatggtataatgattagtattaatcaaaagaaataacaataattagttaattgttaatgacgctaattaacctattaatcaccgagttagccagttaagagatgcgaagtcgtagtctcgcgcccgcgtcgcgggacattcgccgcgcgaattggcacggtaacgcacgcacgtactcgcacttttattctgcaacaatgatatacttatgtaaatccttctaaatgtgtatatttatgtaaaatcagtggaaaatgggtatattttttaaaaaaatttcccaattttaagtatcgatggagattaattttctctattttttttggcaggtctaatcttgcgtacgtacaatgaagatgtgatattagaacgctgatgtactagttgcaaaggcagaaatagtctcgagaaactcttatttagggcctgtttagatcccaccctacaactttacaccctatcacatcgaatgtttagacatatgtatggagtattaaatatagaaaaaaaaaaactaattacacagattccatgtaaattgcgagacgaattttttaagcctaattagtctatgatctgacaatgtggtactacattaaggccctctttgtttaggattaggcttattggcttagacttttaagtcagcttattggcttatatgatttataagccggtggatttaatgtcctaagtttagtggtggagtcatacatcaacctcacataagccaaaaaatcttctccaacctagtttttggcttaatagtgttagagtggcttatggcttcaaaaaagccaaacaaataagctgcttgtttgtttaggcttagacttttcggcttataagttggcttataagcctaaacaaatagggcctaaatatttactaatgacagattaattaagcttaataaattcgtctcacagtttacaggcggaatctataatttgttttgttattagtctacgtttaatacttcaaacgtgtgccagcatatccgatgtgacacgccaaaactttacacccctggatctaaacacccccttaatcaaaaacaacaagtgttgggacttcagttcttttctgagaagatacctggctcgaaggctcatcggttcgctcattggcaccggccgtatacacggttgtccctgcccgtttgagaaatcgccgtacggtggctgaggcgcttcacgacagagggtggattaggaacatcaccgccgctcttggcgtccaagctatcctggagtatttcaaactctaggacatcctcagatcagttcaactctcggatgagcctgactctctgacttggaggtgggagtcctcaagggagtattcttctcggtcagcataccgtgctttgttctcgggtagaatccgttttcaatacaagcctaattggaaatccttggcgcctcctcgttgtcgctacttactttggttggtcgctctcaacagatgctggacggcagaccgtctccagagccatggcttgtcgcaccctgtgcgttgcgttctttgtgatcaaagtgacgagactatcgatcaccttttggttgcatgtccagagtcttggcagctgtggtggattgctctcagagcaattgggctttcgaaatgcttgccgatcaatgaccttcctttcatcattggctctgtgatagcaaaaagaagatgaccaaggcgcatcgtcggggatttgacaccatcgcaaccctggtagcatggacgatctggaaagagagaaacaatagagttttcaatcaggtcagcataacttgggtggagatcgctcgggccatgatagacgaagctgatctttggaggctggctagggctgccatacacaccttagtagtccatgtagatagagagaggtcgcttggagattaggctctaatgctcttgcacctctcctgtatcctccccgtcttgtttttcttttgttatgtccacttgtacataaactttatttcttcttaatataaagatgcgctccttgcgaattcccaaaaaaaacaacaagaagcaagtcatctttctttttttttttttttgacgctgagcaggtaatcattagaacagttagaacttttaaaaagacaaataatgctgctgaaaatattccacgaagaataatctcatccggccaggttccaagcagccagaacttacttatgcagaagctagtcatccatgggtagtatcagtgtttacacttctgagaatccgtatagtaattcttctcagagtgtgggtgtttctcgagctatgcatctgataaggaagcattgcatctatcaccaggaaaaccaaataattgagctacagattagttataccggtcttactgtccaataattgatttttttaatggaatcatagtctcacagataccaccaaagccaatactcctccattgcctgcatataaataacacaaaagcagaccggtcttggcaaaggacactcactttgctttctcatactcgttggctcgttgctcctttgcatcaaatgacgagcatttaccatgatttcattcataacaagctgcagagcttcggaaggatcggtagatattttgttaattttgttgttctagcccatagattcattgccttgcatattcacccattctggattcagttgtcctacttccttctcattagcatcctaggttcagttctattgatgttcctgaagccaaccaacccagaattcagaccaggttacattgacatgctgttcttgtcaacctctgctctgacactttccagcctcatcaccatcgaaatggaggttctctcaagctcacaaattgtggttattacactgctgatgcttctcgggggtgaagtctttgtttctttcctaggcctcatgcttagactgaaccataagcacaacccagagttttcaggggacaaggtcagttcagttcctatcgagcttgatacaatcaactcggcaagcactgtgataagttgtgaagagctgcagctggaagcagcaattcctgaagttccatcttccaccattaaggatttgaagaggagcaagcgcctgaggtggttcttaggatttgtagtcttcagctattttgttgtgatccatgtcgctggctttctgctggttctctggtacataagtcgtgtctcatctgcaaaagctccactgaagaagaaagggatcaacattgcactcttctcattctcggtcacagtctcctcgtttgcgaatgtggggctcgtgccgacgaatgagaacatggcaatcttctccaagaacccgggcctcctcctcctgttcatcggccagattcttgcaggcaatacactttaccctctcttcctaaggctattgatatggttcctggggaaggtgaccaagttgagagaactgaagctcatgatcaagaaccctgaggagctacagtatgattatttgcttcctaagttgccaacggcgtttctggcatcaactgtcattggccttatggcttccttggtcacattgttcggtgctgtcgactggaattcttcagtctttgatggactcagctcttaccagaagattatcaatgcattgttcatggcagtgaacgcaaggcactcgggggagaactccatcgactgctcactcatcgcccctgctgttctagtactgttcatcatcttaatgttagttcatgacacctcatctatttatgtttcatgtcatccaactaatactgttagcttcagccttcaggtgatgacatatttgtctgaaactttactttcttggttttcaggtacttaccaccatcgacaacatttgcactgtccaatggagatgaaaaaactgcaaataagaaagcgaaaagaaaattaggtttagtggtgcagaacttggcattttcacagcttgcctgcatctcagtctttgtgatagttgcattcatcactgagaggagtcgtctcagaaatgatccactcaacttctctgctctgaacatgatatttgaaatcatcaggtgtgttcctctctcttgattatgcaatcaaaattctcgtatcaatctgctaagttacactgggcatcaagccaatgatattgtaggcaaaataaaaacaacgaaacacgataaaataataaacttcattagcaaagcaagccaagtagtaagatccacatctgacacctcagaatctttcagaagacaagaaaactaacccaaacatagattgttctcaacaagataactattttgtactattctgtctttctaaaagagtatgcctgttctttcttttttttttttgcagtgcatatgggaatgtagggctatccactggttacagctgttcgaggttgcagaaactgcacccggggagcatctgccaggacaagccgtacagcttgtccggatggtggagtgatgaaggaaagttgctgctagtctttgtgatgctctatggaaggctcaaggccttcacaaaaggtacaggtgaatattggaggctatggtaaaagctgaagcctgaacaaaagcacttgcaaaggcaagtgcatcaagtgcagtatatgtaactatttagagttctgcctgaaagttcaggtttctaattgggccatagtgtataaaaatacacccaatattattcctcttaatacagtggtgcgcaatcctttagcgtattcccgaaaaaaagaacacccaatatgttgcaattgcaatatagaactgttgttctccaaccaaggccgagtttagttctaaaatttttcttcaaacttcaaatttttttatcgcattaaaacttttctatacatacagactttcaacttttccgtcacatcgttccaatttcaaccaaacttctaattttgacgtgaactaaacacaccccaagtctttttttttgtacttgtattaagccagtcgccatcaaattatcaatgcaactaacacatggagtcatcagtccacgtgatgtatgtacctagtaggtgctaattcccagtgagtggtcttaataaaccttctccggtgtcttttacaaaatttgctgaattcaaggacatcttaaaacaattagtaacgatcacgagtttacctccagtttcagtccagaaatgcttgtccactcgaacaatcgtactttgtctggatgagtccggttgtaacagcatgcttgcatttatggtgtaccatggtcagcaaggaactgaatagagcagtggctgatagaggattgatttctgtccagtgatttctgtgcatgtcctttgaagcatggcatcagaatgcttcctagccatgaattttgtaacagctaaacatgctccagtgctatcgattggtagtagctgcaatctctttctggatcatcagtgcaggacatactcaaggcaaccaaatctatctattaacttattaacttattaaaggaaaagaaaaaggagcctacacgttcactctcacggcctagaaattctcatattactcggagaaaaagaagaacagagtccatatagaaatataatttaaaaatagttgaaattcggaattaaaaaataaagaatattggaagaggagactagagtccataaagaaatacaatttataaataactgaaattcgaaattagaaaataaagaatattagaagaagagtataaagtccatataaaaatacaattaagaaataatagaaattcggaattaaaaataaggaatattagaagtagagtatagagtacatatagaaatacaattaagaaataatagaaattcggaattaaaaataaggaatgttagaagtatagtatagagtccatataggaatttaaaactaactaaaattcagaataaacgtaataaaattaaaagtagagtttagagttcatataaaaatacaatttacaaataactaaaatttgaaattaaaaaaaaacatgagaagaatagtctaaagtcgatataggaatacaatttatacgaatctgaaattcgaaattaaaaattaaagaatattaaaaaatgagtttagagtccacatagaaatgcaattagaaataataaaaattcaaaattaaaaaaaatattggaagaagtgactagagtctatataaaaatacaatttacagataacaaaaattagaaatttaaaaaaaaataaatattgaaagacgagtctagagtccatataggaatataatttacaaataactaaaatttgatattaaaaataattaatagctaacacatatataaaatacaatatgaatactacacattagtagtttcgtaaagttaattcaaaatttaaaattatgttgtcattttaatatatttgaataatacattgagaaaacatatatgttattatatgagagaaaatataatgatgttagccgcgtaatctgcgcgggccgtcatgctagttcaaataacttgcacgaaagagatgagttgaatatacttacctaaatgatactaagtggtggtaccgtaataattctattaaccttcttgttcaaatacaaaatttcagagatgctttggcatccataaaaaaatcaccatatcattccagatgtactgtaatcattttcgggttttccataaaaattcagagatgatatcaaacagaggcactgtaataactctattaaccttcggatgtcggcaatgttataccaattgccaagaatttcagtcaattggttgaggagcatgcctgcctgctctttcaataacatgtcatcttgctcaaacagttgctattctcacccattacacttgcttatccacagtcatagttgccttaccagtatggcaaatagaggaacaaaaattcagcacgcatgcaagcagtagagcacttctttctatgctttttgcaagcattcgtgtatctacctgcatgctccgcaacttaacatcatgttctgaaaggcatctcaactatgttacacatgtcttcctcctctccactaatattaaccaatagacagatacactattacagtgccttgtatatatatactctcactgagattggttgtcacctttatatttcaatacagcagttgtagttccatcttgaatcaagacaaacacaataaggagctagaggctctgccctctatctccaatgcctattcggctgcatatctttgtcagttctgcaaggcatgccatcaactcgtcggcattgatttgtcggttcatcgcattccatcttagcccgcttttgattcacctgtcctattttcttatcattgatgtacttggttttgttgccttggtggtgctcaggccaagcaaccacaagtacaatcctcgctatatcgatatgtttttcctatcgacatctgcagttacagtcacaggattagccaccacacaaatggaggatctttctagctctcagatagctgtcctgactctcttgatgttcttaggaagtgagatgttcctttcctttcttggccttgtccttgagtcgagcaagcaaaacaagcatgatcctgaaaaccgtagagtaagttcagttaccgtgtgtgagcagtcacatctagaagaggcaattccacaaactccatccatgaactccactgatatcaagaggagctgccacaaatacttagtgtttgtggtgttggcatacatgattattattcttgtcactggttctctattggtgttcatgtacatagctcatgtttcaagtgctagagatgtgctaacaaggaaaagcatcaacaaagctctttctcgatatcggtcacagtctcctcatttacaaatggagggttattgccgacaaatgagagtatggctgtattctcctcaaacaatggcctcctgttgctactcatcggccagattcttgcaggcagcacactgctccctatgtttctgaggttggtgatatgggcattgagaggactaagattagcaaaagctgaagagccagacttcatgatgaacaacagcagctcagtaggtttcagtcacctgctacctaacttgcagacaatatttcttgcagctgtggaggttgcttttgtaggcatgacagtcatcctcttctgctgcttgaactgggattctgcagtgtttgcagggctaacctccctccagaagataaccaatgcattgttcatggcagtgagtgcaaggcaggcaggagaaaattccattgattgttcccttgttgcgccagcggctttagtactattcatggtcatgatgtgagttcctctctttcaagctcttcacatttttcaggcaacaatcagaagagataacataacacggttgcttacatttctcaggtacactccatccttgacaaagttgttctcagcatgtcaagatcacaaacaaatcggcccggaaagcgacgatagaacaagcaaggggaaaccattcctgaagacgatggcattttcaccactagccttcaacaccacagtgataatgctggtctgcatcactgaaaggagatcgatctccactgaccctctcaatttctccacatttaacatcatctttgaggtgataaggtaattaagttgcacatctactcaccaaattcttcttctgatactgttcttgctccctccatgattaattcagctaatttattcatcacccattgcttctgcacacagtgcctacgggaacattgggttgtccactggctacagctgctcgagacagctacagcaccaggatgggattgcttgccatgagaagccatacagcttctcggggtggtggagtgaaccagggaagctgattcttgttcttgcgatgctctacgggaggctcaactcaaaggattccacaagcgcacgaactaggtgatgatgttatgcaagaatcaagaatgcagtgtaccatcccatcaaaaaaaaagaaaagaaaaatggatgcactcaactatgatctgcctctatgttcaaatttcaatgattggcgacagcgcacttaccggaggcggcggagggtgatgcccttcgcgggagtgcctcgctgcgacaaacagacggcgccgttgcgattcctgcaatttttcacaaatgtagacagtcaaaaaaggccctccttttcttaaaaattaatggattattaaaaaagaacacatttatcccccctttaacctttattattatatcaattagtaaattacactaatttaattgtcaatcatagccaggatcatgttgcatgcaagtatctagacgatgaacaggggaacatgttctcaaatgaattgatagatgagagaacaggtaaatgaacaatgtatctaccaatgcttctgaagttctgaaacttgctacgaatgcattcatggtaaatgctagtagtcattttctgcaaagaggtccgagtatcacaaaccaagttgagcttcttgccaagatcccagaaatctcataaaccattcccctcgaggaactagtactgaatataaggagtatactataaaaaaaatgaatcataatcagctataatatcactatttacagcaagaaataaaataataaagaaatagaacctaacaaactctgataagatcattgtggtatcctaaaaatagcaaccagttcctaaaaaacaacaaccaaagtatccacggactgcaagcaaaagggaagaagctaactttgtgaaagcaaacccccactgtaccaaaatatatgaacaccacaactcatgcaaaactacaagcatggaaagcatcaaagggcatcgatacacatcctgaaactcattttaagccatatcactgcagtatattataaataaccatccagtccacataaaactataataaaaaaagataccttcattaaaataagacatcggaatacacatcacctatactctcaatatcactctagcttgcattcacccataaagcagttctagttcatgcctctcaatgtcactctagcttgtattcacccttaaaatgtcactccagcttatattcgcccttgaagcagttcggttcatgcattgggcgaacttagcatctcgggtaggatcgaaatagatataatcgtccccacacatgcctactctattgcctgcccacttcccaccactaatgattcttgcattggtcagctcatgcgtgccatgcgccatttctgtgaagtccatgtcgccaccacaataattttcaattggatgcgcaggatgcataatcctggtcccttcatattcataataacaacaacgagcttctccaaaaaagacataccaaaaaaaggttagcatcaaaatacaagaaagaatcattctataaattatatttaagaaaaggacacaatcatatatcaaacataccatgttttgattttcttgagacagtacagcaaaaggatacatcatcatcatcattactgaattcagcaaagaataacttaagtccacttccaacttttgggcttgccaaaaagtttacatgtgaatatggacacttgaagtccaagaagttcatctggctgcccacacgctcatttgcaacacagattacttgaagatcatatagatatccctacaaccatgaaagaagtgaacttgtagaaaaatggcaattataatgacattatgaaaaggaaaattacacactaaacagatactcttgttatcctaatcaatagggaagaagtgaacttgcaaaagaaaaactacaatgacattatgaaatgggtaattccacactgaacaaatcctttcatcgttatcctaatcaaatcattagggaataagtgaacttgcagaaaagtgcaaccataatgacatcatgaaatggataattccacgctaaatagatactaaactaggaaagaagtgaacttgcataaaattgcaattataaatttataatgacattatgaaatgataattccgcgataaacagatcctttcattatctcaatcatcaggtaagaattgaatttgcagagaagagcaattataatgacaatatgaaatagataattctacactaaatatatattttcatttccaaatcaatagtctaactagagagcaatactttgaaagtagcacataatatggaatggaaggtgctaacctttttccttagtgcagcttcaatctttctacgaaaaaaaccctattgagtgacacatttttccttgaacgctataaacatatccaatgcatctgtagacagatcaacaattgtctccaaagatttagcagagatgcaatttgaagatggcaacaacgtagctagctgaagaacatcattcgaggaaagtggggtagaagcacacaatagtgatttaacggcagcctgcaccttaggtagagattgagtggaaaactgtacataagcttcgagctcaggatgaaacaatgcatccgctgcagccttgtaggcactgacatcccagctggattcccacccttacactcctgccatttcaactgctttgcaaactttcagattattctttagcagatatatcatggcatcatgctcaaaaatctcaggaatgcatgtaagcaattgcttgataaggccacgaagggaccgggactccacacgaacaaaggtggaggtgcagatcatgtccacctcaagtttctccacagcagggaaagcagagtcataccagagggtattgatgatgatgttggtcacacaactgaatgggccatagcagtaaccaccattgacaaaggcaaggtggtaatgagcccgaacatcttgcattggtaatcgagagattgccttgatgtacttggcatgaatcttgtcaagtaaaacagcccggagtgatattgtcaaaccacctggcaccttctcaccattagcatcaccagtatgacagttacgaagccgccgttcatcagcgaaaaatcattggattgtcagacttcaagcgtgagcggcttcttcttcttcagaattccagaaagcaacaagatcttctcaagccgcgatctgctattatcacggcctgggtgacgaattcaagatgagacgccagcgaaaacgaagcggcgatgaagccgtcgacgttcggttgcctcgcggatgaggctgcgcatgtaagggcagccctggcagcgtaggaggagatttggaatcgttcgtccttggtgttgtagcagccgcgattgagctcgatgaggcggacggcgacgaggaggtcggtgttcgcgaggcgcaggtagcggagcgcgtcccaggtggggaggtagcggaagtaggatgtgaggaaggtgacgagcccctccagcgatcgctcggcgatggctcgtgtctccgacgacgacctcgctgctgctgccgatggcgccgccttcgtcttgcgcttgcgcttcttggcactgtgatcgggagggagggaggagagggtgttggcgatgatattggtggtagggtcggcgaagccgaagcagacgccggcggcgacgagaagcggggcgagctccgtcggccggcgatttggttggaagacttgggaattcgagggggtttgggacggggaattaaaaggtcgaattccaaccaatctcttatctggggaagacctgttaattcgtgagacttggagggaattcaatgtgaaaccaaataagggatgatgactaaaaatataactcccacgaccaatctcaccatcaactccctccttaaaactcccattcctctttccttctcttcccaaacatgccgttaaggtttggcgtcgacaggggatttgatttgatctgatttgatctttttttttcctcccctttctccctcgctcctccggcggtccggccttcgacacttcgacagacaactcaggggggaagacagagagtgagtgggcctaaactgggccagattcaatgaataggagttccgtgtgtggcgtgaggaataagttcattttaggtcccttaacttgtcaacgaatccgattttcgtccttccaccgaaaaacaacatgtctctcaactgtcaaaaccggtgaagcccaaggcgttttggacggcggtttgcgctgacgtgatgcctacatggctaatttgactcggcctaaaaattgtgggcctacatgtcagtaacaccaaaaacaataacttaaaaaaggtgggggcccacatgtcaatctcactctcttcttcttcctcctcactcccccatctcccctatcttcatctctcccctctcctctctcgggcgtgacgaccgatgggcggcgggaagaagagcggtgcccggcggggagaagggacaacgtgcggtgatggccgccggaggaggaggagatgcggggaggcgtaacggtggcagccagaggaggaggccgtccgccacgcgctgctcccttctttcccgtctcctccaacgccaccatgccacgagctccccctcctccagctcaacgactgccaccaacacgaagaggtatatgacgataccaaggatgagaagcggtggcatggggagcagtgccgcggctgcggcggcgacggcgtcgattggaagaaagagaaggggaagcccctcgctctggccggccgcagaggacaccgccgacgccatggagatgctgcggtccaaccggatgctcgacaccgccgccatcgtcagcccgtgcgccgccttggtgcatagtgggatctgtgcagcagcgccaactacccggaggccgacttccactgcgccttccgcatgtcccgccccacctttgacttcctctgtgccgaactcgctgccactgccgcacgtcgccccttctttgctactactacacaagtagcagtagcaaagaacactcttgtactacttccttttcaacggactgtccttggttaaacatgacatcttgacctatctcagcaagtacatataattattgtagcaaaaaagaatctataccagaataccccaagcatgaaaagcatctttatcactccagcttgcattcacccataaagcacttctgattcatccctcgcaatgtcactccatttcgtattcacccttgaagcagtttgatcggttcatagctaggattgggtttttttcttttgggacggagaggtacacattgtttccgagaaactacaattcatcacaaaacttgaatttcttgatcaaagaagatgcttcaatgcactatagaggtaaaaatcctaatttatctttcttatgagttagcagtgtacatgatatctatcacacccgtgatgcttaattgtcacacatgaaaaaggtgttagttgtgttgttattgctagaatgaggttaaaggtgagttttgttgatctgtcatggggaaaatcaaggaattgagcagttggtgggattgctcacagagtaacataacgaggctccaaataccagtaatataattgttcctcatgctgaatcaataaaaaaattgagttgatgcaaaatgatattaaattgaaggatgtcaaaaaatatttgagttgatcagagagaacattattgattttgaagactttttttcctttagtgcagcttcaatctttctacgatgtattggactggctgcaagcagaggaacgaaaataaagattagaggtggttttggtatgtttaggctgggccaaaatttggaagagtttttacatgggcttttcatgggccagagcctaagctggcccagaacaccactacataagctcgggaaacccagctagggtttcgatctccgcctctccgacctcccgaatcctcccaactccgccgccgccgccgcgaagcgcaagccgacatgggcgtgtacaccttcgtgtgccggagctccggcgacgagtggacggccaagcagctcaagggcgagctggaggcctccgccgccaccccctacgagctgcagcgccgcctcgtcgccgccgcgtccgccgccgactcggccgccggagtccagtcctccttctccatggtctcgcccagctccgccgtcttccaggtctgcctgctccccctcccttcccatcgcgccctgctctctgttccccccccccccaatcatctcttcgcgttcctgcttccgatctaactgtatgcttgcgcttgtctagttcttggcttcttgctcgttatatatgctatagaagaaatatctcttgcgattcatgtgctagctggatctgaatagcacatttgttccagatatgcgatattttgcattgattggtaggtaggttgatgtttcatgttcaatatatgtttggtgatattctgtccttgttatgtagccgttcaaatgcatctcgttgcagtttgcagtcaacagagtgatgatacacatatttttttagtctttgttgctttgtagtgtaattacaatgctagtttaatccagaggttcaccttctgatcatgtggtcaacattgccatcagcatcatttgttcgtgtgtatttttatttgggcaagattgtgccttatagctgcgtctagctgttttgctgtttatacaggtggatatggttcttggttagatcccagaaaatatctgtgggctttgacacaaagctcaccttagtaagagagaaaattgtttgactaatatgaataagctgaagcgactaaattgtctagccagataattgaaattggcatctgtagatttctgtataattcttagcatgactgtatgtggctctgtgatcttatatcagattcttatcagttcttttgctgtttatcggtaatttttgtcacaaagtaaccaatgtatatgtgaagtcaattctagcttgttggtagcatagcatgccattatctgtgtattgttgatgactagtgtatcaaccaaagctatactcggcattcataagtcataccattttatgtagtgctgaccacaattctcatacaggtgatcattggtgccgttggtggtggtgccgcgattggtggaggtgctgctgctggtgccgcctccggtggagctgctgccgaggcccccaaggccgaggagaagaaggaagaagagaaggaggaaagcgaggacgacctcggattctccctcttcgattagatatcacttcgcttgtatcccacaaatttgtcatggagttcttgcagtagttttgttgttctatgcatatgaaccagaggcttgtgaacctgtgaaatcttcttaagagaaattgtgttctggaatgctggctgtatctgcgttacttccgttcgacttcatatttctgttatgttgtattttgcatcaacagaaagttataatcagttacatgcaa

SEQ ID NO: 41146 - DNA, 19355 bp, Oryza sativa
catctagcaatggtgttgtctgaactctgtaataggaatgtggggtgcaaaatccacaaacatacatactgataagatgaagatcgaatgtcaggatgtattcaaatacaattgctaggtgctgcacactgtcaatatgtcctctaccgctctacgttgttcttcaaagaaacaaaatctgtccatgtattgccatgtaagtgctgcctcagttgacaatattactgaagatttccataagcatgtaaactctgcacccaatgtgtgaatcccgttgcggcccaacttatattggcccagcatgtaaaaatcctatttcggcccaactttgcttggtaggtgtggttctgtctatgaaaacagaaggatgctaaaatatagtacatcaagcacatgataattgagtttgagtgatggtaatatgggtaattgggcatcaatgcctgatgaaaaagacagataaacaggaactgcatgggtcaagtcaagtgggtgaactacccaactgagtaactgaactggccaccaatgaggcaatgatctctcttctcgactttgaaatggtaccatgtgttcataaactttattcttaaggtcttctgctttcctcctaagttcggaatataatgctttatataatgactttcaaagggaacaagttcttaatagtgacattaaaaatgaatcagttcctttaatttgtagtagtactatgcaatttctactcggttattactactttattagtgccccttgtagtccgttttctatgtttcatcagatatcgctgcatgctaccactcgactcaaacaatatgtgatatctgaaattctgaactatgtcatgaatcatgatatacacttactccctccgatttcattctaattgacgttttagacaatggcacggtctacaaaatatatctttgaccttatttttctattataatatacacaataaataaatgcatgtttacttttattatagtgctttgaaagataaatctatatatgtttttctagtttttttaaactaaatattcttaaagttattgatggtcaaaattataaaagtttgatctcaaccttgtccaaaacgtcaattattatagaaccagagggagtactgcacatcggtctctacagcgctctgcatattgatccatcttatatataaaaaaatgttaatgattttttggtgacatgtacagtgtacattctctctcgatgggcagaaagactttctcctcgagtggtcgccgtagttttttcatgaactttgctgttggaattggcagtgtgtatgagagaagtcattggccgcctttgaagacttttcatgaacccacattttcagtctgaccttgatcatctcccattggaaaaaattacaggttcttgcatgttcagagccttcggtgcgtctccatctcctcttattctagaatcgaattaatttgagacttgcgaaagggtaaatgaaaacttgggggaaaaaaaatacaatataggtgcaccataaaagagacagggacaagccgacagcaacgtagtatgtcaagaaattggccaagaagtttccaaggagctgtctgaagtctacttgctcattgaattatatgcaggttaatttcatggactggtcttttctttttttttaaaaaaaaagaatctatggattgtccatctgaatttttattacttttgttgccccctcttcttatttatttttttctctcctgccatcagttaactgctgttaaggccttccaaatacatgatgttttttgcataaatagtgtcgtgctacagtgattaatttgcagctatctggccatagcaagtagtaatgctggcgattttattgcgccttgtgtattcacattgagttcaatgtcatcttgctctactatctatatcaacgactgacttactttaatgctgtttaaggtgttgcatgattttttgttctctcaaaagattacaaattcattggatgctcacatgtcatatccaaatgaaacaaaaaagatatattcgattctcccatcccactcaagtaaaaataatccacctctttacagccaaacagcacaaaaaatggataaactatgcttcttttatacaaacatgacattagatgcctacaatttcaccctgaaaaaagagcttataatcctcctccccaaaacttttatattaattctcaaaaccactaaaaatgatactccctcaattcctatataattatcaccattgatcagtattgtggcaaactttaatgtatttttaaatgactagattattatgaacaaagttaataattatgtttaatatataatacacttcgataaagtgacatctatttaagtatttattattttttacaaaaaagtagtcgaattctaaatatgaatattgtttggtgacaaggataaaagaacaaatagatattatgcataatgatgctattttattggttttggtagtcgttatcttttgtaacattttagatggcgtagcacctgtgtaaccatttgctaatttttttatttgttttatcttttagttcaggtagtcattttgtcagaggagatggagacttttcccatcactcgatttttctcatttttgactctaaagcttattggttatgtgtctatttacataagccgaaaacataaaaccatttttcactataaaaaagagtgaagtacgcggatggtacctaaattgtacaggtgtatcatcaacatccataaactttcaaaatggattttcgggttcctgaacttgtctttgaagtcatataggtccaaatagtattcaaactgctccatacactgaaatggcatcacagtggtgcctacacgttagtcacatagaaaataaaaacagtaaaaacttatttctatatggttgacatgtgggtcacactgacatataagtgccaccgtgatattgccatgtcagcacacaaagtgaattgaaacttgtttgaacatactcatgataactttggagccagaaatgtatttttaaggttcagacacacaggtaacatacccacataattttagagaccatccatacacttctctaatgacatagggactactcctatatatgattgttgttactgtacttgccaccggtttggaaggaaacaggtttcaagttgacagtgtcaagaatttaactttcaaaaaaaaaattataaaaggatgagaaaaacgatgaaaatttgccagaattgcccctgctcctctccatctatctccctttcttccctcgcctcaccctgtctgaactctgaactctctctctctctctctctcctcctcttcccggcggagtcccccacctcgcctcccctccctgcgcgcggcaccaccggcgggaaggtctccggagtgcgcggcggtgtggacgtcttcctaccctccccgtcccaaccccgcggccgcttcgttcttggtcgtcctcggtgtgttcttgttgttgttgttgttgttcggatcgagttgatttcgtgcccctcccattatggaatcaggtttcttcagggtttctctgatgtagggtagaagattgtttggagaggccaagaaaaaaaaagttcttttggagttcagctgaactcgttgttaggtcgtttgcccctgatttagattcgattctgaggtaataaagttgcggaattgtggatgtccggaggatatccgagggttttatccgctcaatttgatgtgatcaagcaaaaaattcgtttctttttatgtttaaaggccttaatactacacaagctagtagtagtttgttttcttctgctctactgcaaaagtaagtactccttgtttgcatcccttggtggctttccagtacctaccatctgatgttgtagctccttggaaactgcttgcttatccctttgtcatgataagaatgtggtgtgaggaagaaacctgtattctttgtagttatacgctttatttgctttccttaaactctgtctttgtctgatttaatgtaaatacaagctgtcgcgcgaattcgttatcttgtcatgacttgtcaagaacagaagaacagtcctttctatgaagaagttttgagcctattgtatgtgatcggtagtgactaaggaatgctgatttggatttaccttcttgtacttgtgacattgcagaagatcaaccgtctggccgggagcctagagttgttaactacggtgtttcagagtttttttgttatctcttctgctgttgtgctgacttctaatgggatggggaaacaccttaaccaggcgcctcaaagtcttttccatggccttgtttatatacttcgactataaggtgtggttgtatcacttcttcatgctgttctttcaataaaaagtctcaatccattctactagtagaagcagattaacatcttcttgaggtacaagcaggcagttcagaagagagttaaatgggttggcgctggtaaaaaggatgctatatggacaaaaacacacgagcgaaatgctcgtcgtgttctcaacctgatgatagagttagaaggtttatgggtgaaaatgggacaatatttatccacaagagcagatgtgcttcctgaaccctacataaatgtcctcaagcagttgcaggactcgcttcctcctcgccctcttgaagaggttcatcctcataactaattttgcttcatctgtagtcaatccaaatattaacatgtagctaatcgtagtcgttaactcaattcttgtctctcatgttcaggttcgtggaaccatagagaaagaacttgggaaacccatgaatgatctgtttgctaattttgtgctggatcctctagcaactgcatcagtaagttctgttatattggaatgaacttctttcatctgatggaaattcatagtatgttttttttgacgaaatcctcgagcaacttgctaattttttttgtcatggtagtatgttcatacgagtcttcatgtacttttgtcagatagcacaggttcatcgtgcaactcttgtagatggcagagaagtagttgtgaaaatccaacatgatggtatcaaagatatcatattagaggtttgcctctattctgaaaaaacggacttatgtaaaatgtgcaggattgctatatcattttcttaatgttgtcaggatttgaagaatgcaaaatcattagttgaatggattgcatgggcagagcctcaatataattttaacccgatgatagatgaatggtgcaaggaggcaccaaaggaacttgatttcaaccatgaggcaggtaattacccctttcagttctcatactcctctctccatataaaagaacatgcatgctcttgtgactcatccatattttttttaaaagtaaaggtctagtcactaatgaacatatcatcctgataatgtatgctataaaatccttaattttagagaacacaaaggctgtctccagtaatcttagtcgaaaaaccaattgcgagagtggtgctgtctctagtgctgttgacgtactgattccagaagttattcaggtctgagttcttttacttcatcctgtttgtcatcgtgtcagtttttccggttcagttgacagatcatctaatccattcttctttgtgtaccagtcaactgataaggttctaattttgcaatatatggatggaattcgtttgaatgacaatgattcgttagaagcatatggtgttgataagcaaagacttgtggaggagataacccgtgcatatgctcatcaaatatacgttgatggcttctttaacggcgatcctcaccctggtatttcaattttatgtgccttgaagagatcttctgtcacctcaatttttttattctccatctgtaattcttgcaaattcatttgtgctgacaatgcattatttttctgtaggcaattttcttgttagcaaggaacctccacacaagccgattctccttgattttgggcttactaaacgcatatctcaatcaatgaggcaggcactagcaaagatgtttttgtcatgcgctgaggtttgacactttgatcttctaaataatacatacacaaggaaacaaataatggagttaatcaaacatggttgtcttgttggcatctacaagctgcagccatttccattggagtagatgcgatcttttattataacaagaatggatttttgtttactttccgatctttttgtatcctagtttagtcctatctttcagtctttactcataagtggtattgcaaagtggcagatgaatatcacatttaacaagctataagaaaacaaagacagaatctggaactaatctttattttcttctctactatgctttggtgttccttgaatcaactttgagacttagaaagtgcactggaacgttaagtgaccacatgcactagtattttgacgtgtcaaaatttgataattaaaattttgtgagatagggttcttcggtttattctaccttttgctgtttgtgaaccagttgctcatgctatgattaaatttcttaaactacatttctgatatttaacatgtcaatgggtagggagaccatgtggcactgctgtcagcctttgcggagatggggcttaagctgcgggttgacatgcctgagcaggctatggagatcgctacagtattttttcggcagtccactacagcaaatgaagcaaaggtaggaggctaccactactgtaatctgtatccctcctcttgtattaatttggaagtttggattaactgtttggttatgacttttctttaggagaacataaagacattgaatgaccaaagagaacgaaatgtcaaggcacttcaagaaaagatgaaaatgaataaaaaggaggttcaacgtttcaatccagtgagtaggcatgccttttacttcatatgtgtttagtttgtcaaccaagaaataggtgttacatgaacattttctcgcctttaggttgatgctttccctggtgatgcaattatattcatgagggttttgaatcttcttagaggtatgtttttcattctttcctttgaaatatccagtatcatggtaacatgctctctattatctgcacttatgcagggctatcagcatcactaaatgttaggatagtttatctagacatcatgaggccatttgctgaatcaactttgctagggtgagatgcctgtttatctactgtttgcaggagccttagagtaaagcatcttttttattgcttatttatgccttcgttgatggtaggagtatgacacgtgggcccacagctaacagtcagtggatttatgactcacctgttaactcagaggtggagtctaaactgcggaaccttctgcttgagttgggaagcaacaaaattttaggaatacaagtaggttgataatctcatgcgattcatttacatgctatgactttgcttcattggtgccttacaaatcttccttttaccaggtttgtgcttataaagatggaaaggtcataatagataccgctgctggtacgttagggaagtatgatccacgtcctgttcaacctgattctctctttccagttttttcagtgacaaagggtatcactgctggcatggtgcattggcttgttgacaaagggtgagtgcttaatcacaatgccaagttttttttttcttaacatgctagtgtaaatatgtttgcaggccgtcgtattacagtacattatactacctcagattccaaataagtcgtttagacttatgcacaagaattaagaaaacaacagaactgactattttaccctacacttatactacatgaaagatatgaatcatttatttgttgagagagctagcatttatttgccaaggtcaagcatggaagagaagatgaagaagtggctagaagttccaaaacgacttatatttagaatacctcatcttagtagcttactagtgtatcaaaaataatatttggcctaacagtaacgagcatggtagtatgccaccctgtttaagtaggcctcctcttgatctactaacattctaacaaaataaagatattccatctttatatacatggcaaagtcactcacatgcgcaaacaacttttattctgaagcatcaaattgttgtaccgtatttctgtgagtctatgttgaacaataaaaatggacatggagaatgggtgccagtgttcccatgattaggctgaaccatgttagtgcaggtggcaatccttcacaattatgacatgtgagtcactgttgaaacataaaatttagattggtgcagtgtagtttcctgcagttgcatccacgttatccaggtcacaatatttcttgatattatctacattctagtgcttaaaaagtataaagcatcagattcttgtataaagcaagcaactcctctaaatctctaacagtgatggtactacagagaacattgagcatcttttccctgctaccttaggcttttatgtgcattgcaatccattagtgacaggctgagaaaggcctggggtcttctggctagcaccacaagatgtgggctagccgacccaggttcaagcctcacccctcttgataaattttgatatgagaatctttcctctcatatccagtgtttttttattattagtgacaggctgacagcatactgttatctttcaggaagttgaagtatgaggagactgttgccaatatatggccaaaattcggaactaacaaaaaagagctaataaaggtactagaacttctttttttgttgtttgttgaaacactgtttcttgggattaacagactctgatttgcaattttctactaaaggttcatcatcttctgaatcatacatctggtttacataatgcattgggagatgtgatgaagagtgatccgttgttggtatgtgactgggaagagatgctgcaccagattaccaagtgtacgccggaaacagaaccgggttctgaacaaatgtatcactacttatcctttggttggctgtgtggtggaatcatagaggtatgtctctcccgagcatcacatacaccgagttcatttattttcaatgggagtactgaacctttttaactggatcagtggatctttatggcttcacatagttatactaatttttaatctggttatgggcttaattaaatgcacagcccaccaagttatatttttttggttatgggctattggcaaagtagaggtaaataactgaaaacaacacgtgtttgtatgtcactgttctgtgtgaacttaatttcatgaatcctaacgctgatatttggtgataatagcatgcgtccggaaagaagcttcaagaggtcctagaagaggccattgttcatcctcttcacattaacggggagctatatattggcattcctccaggtataactaacaaaacttcccagtttagctttcaacaaaataggtgtacgcattgatataatgatggatattttttttttctacaaatccataaacatattaaccttttcgagacgtgttcatgtcatataagtttgatgagtgaaaaaattgcgctagatacttaccttttttttgcggggtgctatattcttgctattattactgttccaaagattatttgaaaagagactacaatgcatatgtgaagtacagtcatgagttcgatgcttgtccaaagaacgcattttctctgtctctggcttgttttgacatgttccataaacatactcacccacgcttttggagatgtgttccataggtttgatgagtgaaattgctgctatattcttaccgttgtagataatatcctacatgtgaatatgtgatgttcatcgattttccgcccttgtcaggtgtcgaatctcgccttgcggcactgacagtcgacatggaggagctcgagaagctgtcaggattcagagcaggaccagacgtcccacaggagctgctcagcaatgtcgcccagatggccaccggcctacctgtcctcttcaacacgctcaacatccgccgcgccatcctccccgctgccaatggccactgctcggcgcgcgctctggctcgatactacgccgcgctgggggcaggcggcgccattcctccgccgcactccggtggtggctccaagccgccactcggcagccatgtccacacccccaagttccccaccatgccgtccaagaagaagaagaagggaggttcgaagaatgatgtcggcgtcgctgacaaggacgggtacacccagctccgcaccagcgacggcagcgacgaggggtcgacggtgtcagcggtggtggccgggaacggcagtggcagcggcagcagcatgttcgtcgacggcggcaccaagatgctcgacgcgttcatgggcgtcggcgacttctccggcatgatccacccgaacggcaagttcgggctcgggttcaggaggtacggctatggcgccggcgctggcgagaaggtggcgacgacgacgttcgggcactccgggatgggcgggtcgacggggttctgcgacgtggagcacgggctggccatggccgtgacggtgaacaagatgtcgctgggcggcgtgacgcggcgcgtggtccggctggtgtgcgaggagctgggcgtgccggtgcccgacgagttctccgtcgccggcgacaagggccccgacatggtgctcaacctcgcgccgccggagtagcaccaacctgccaggccactactactgacatttcatcatacactttgatacatatacacatgtagctaggtaagagtaaactcatgatgatataacaaaatgaggggaaaaattaatgttctttccgggtatacgtattagtacaatatagtagtacaaatttatgccatttggatgtggcttcgtcatatatactccaaattatacatgtatacaagatttttgtttcatttttcctgtttacatttgcaactgtgaggtgccaagtgatgccatgttggaaaattcgaatatgctgttgtaaatgatttgagattccagattagaacccgtgagtctgcgacagatgtctgaatctagatgaggatgaactcagcgcttgcaaaacgtgaaagataatgatcagttaagttttaattacaataatcctaaaaaaaatgtatttatttatatcttaaaagaacttttacatattgtttttccaaaagatataacattgtttactccctctgggctgataatacttgtcgttttagacaagggtgaggtcaaactttagaatctttgattatgaatcatttttaaaatatttatctttcaaatatggtaactacatatatagattagtcttgaaaagtactttaataaaatttatatatttgttaacactttatatatattataatagaaaataatggtcaaagttgttttttggagaccgtgcccttgtccaaaacgacaagtattatcaacccggagggagtaacagtttaaaaaaggtgctctaaaatctactagctcaccaaaatacagtaaaacatgctagataaaatctagtacggccgtgtttagttcgtgaggccaattttttttaaagtataccaacacatatttgaaatattaaaaacgtagaccaataacaaaacaaattacagattccgtatgtaaatggcgagacgaatttattaagtctaattaattcgtcattagtaaatatttaccgtagcatcacattgttaaatcatggtgaaattagatttaaaagattcatcttgtaattttatatgcaatctgtataatttataattgatttttttcattcacatttagtgcttcgtgtatatgcccaaacatttgatcggacggaataatttttggaagtttgaagtcttacggggcttatcggcggcggccaccaccgacacccggcgccgtgggggcgggcccacccgccgccgcgagcgctcacgtgaaagccggggaatgccattgccaccgcgtcacccgttgttcggatgctcgtctcgtcgccgaggtggtggatgtgggccccgcgccgcgcccaccaccaccatcatcttcacggatcgatcgggatgagttgcagttactactcctaattgatttgggattcagtttatccaccgattcctccgcaaaaaaaaatataaaaaccgcgactttgtgagcgatttgggagacggttttgttgctcccccacttctgactccacacgccacgccacgcccgcgcgatggcttccgacggcgacggcgccgcggcggtggcggcgctggggatctccggcggcgggggcgacgactgggcgccgccgctgcggcggaatctcccgctgctcgcgccccacgaggtgattttttggcttgcaacctgcgacgtcctgcgttagatgtcggatggatagattgcagttttctgctagaatcgcgttgcgtggccttgcggctgcaaatttgatttttttttgggtgattacgagtcgtaagtttaggtccagtaccagatgatttgacgctagaacgaataactacctctgtttcgttgggattttgttcgacaacgtagtcttaactactttgcttctactcctgcaattttcatatcaattcagtccccaccctactagtaagttctacgggaacacagtacaaagtattggaaaaaaaattcctgaaatttgtgcttacaactgtttactcggaatgggtaatgtattgtttacttaccatatttgagttgtgttttccataatgcttcctgcctggtggtgattgtaggttaagcttgcaaaattgctgctgagtgaaggacagtcacatttgtttgaacactggccggaaccaggtgttgatgatgacaagaaaaggaacttctttgaccaggtttgtcccttattcacaaaacaacaatattttttatagaattttactgatactaacacaaaggctaaaatactttcttcttgctttcttgttgggattgcctcatatgaggcacctataaaccttctttttttttgtcggcttactctaagaagcaccatgtcctcttaccattgttgatatcatctataggccaagaaagctgaagaggcgcttaaataaccaaattgttattattattttgaatttctgctaaaattgtcattgttcaggtctgccgccttaattcaagctatcctggtgggctggcatcgtacatccagaatgcaagaaagcttttagcagattcaaaggcaggaaaaaatccatatgatggcttctcaccttctgtaagtcttgatgtgtgctgtttttccatgaattggattcgtggtgtcataactcctactgcataatctttctaatatatggtgtatagctcactattgtcaaatctgaatgatgttaattcttcccttttctagtctgaatccgtgtgcacttgcatgtgcatttttctacaatctgaaatgactacatggtgttcacagaggtaccataattacaggttccttcaggggaagtattgacctttggtgatgacaactttgtttcgcttgaagaagctggggtaaaagaagcccgccatgcagcatttgttcttgtagctggtgggcttggtgaaagacttggttacaaaggaattaaggtaatgtgaccccagttggaaataccattcttgcaacaaagcatgaaaatagctagcttcttgactggtaactccagttaaagattcccagttatgacatgttgtgatatccgacccaagttctagcaaacaaaagggcatatatttattacaattccaaagtagatgctgtggtagtagaactagtgttttgcagtcatgaggatgtagtatgattgtgctgtttggttgaaacatttcacctccatgcctcttattttgctaagatatattcacattaattgctgaatcgtcctatcacaacatcatgcaccacaattcgtatatgaaaactaagatgttaatgaaaaaaaggaagaaagtgattacatctccacagttccagcaaatttcagtgagcttggaaattggataggatagcaaatgttttagcaagtcaaagtgtacaggtagtcaagttgatcttgtgtgcttacaaactagactgtccatcaggcatttattttgatatgattgttagcaaatccagaaatgggatcatgtaatttccctctggacattatattgttgtgctaaattcaccttgatatcaagcattcatgggtaatatcattgcgcaggttgcacttcccagggaaacaactactggaaaatgctttcttcaacattacatagaatctattctagctttgcaggaggcgagctgcaaattggtagagggtatgtggactacattatatgtgcaatgaactcatgactaacagcagggatgatacttcttgttttgataaactaatcttatcaaagtatttttctttctaatatcgctgtggtatttctggtaggtattgcctgtgttagcctttagttatttccctttgaactgcttgtggttgttgtgaatggttgctcgatatgtgtttcccactatttagacgttctttggatggaaagactcaaagacgattcagatgttgatttggttctgattgattttgttccttgagcttgcaggtgaatgcaatacaaagatcccatttgttattatgacttctgatgacacaaatgcactaaccgtcaaacttttggagtcaaactcctattttggaatggaaccatcacaagtgcacattcttaagcaggtagtcttctatcttgctatctcttccatgtatttcttagttaaaatatattcttcagtaggcacaaaagttagtttcgctatttaatgctaatgcttattattttttcaggaaaaagtggcatgtttagctgataatgatgcaaggcttgcattagacccaaatgacaagtacaaaatccaggttgctaattttgatacgagatctctataattaagatttaaatatatgtcacctattgttaccttttcttttcctggaggtttcttaatttcatttttgtgatttgacagacaaagccacatgggcatggagatgtccacgctcttctttattcaagcggcttgcttgagcaatggtaaattaattcaacattcgtagttagtcgctttttgccagtttgaagaagattagaagtaatgtacatgaattaaattgctaaaataattatgctaagttcaaatcaatgcatgtcgatcttgtgtgttttatactacttttttgtaggaagagcacagggcggaaatgggttctctttttccaggacacaaatggattgctcttcaatgtttgtactcttgcttccctactgtcttacaattgagagcttgttttttagacaaatgctggaatgagttgacatatggtatctgttaaattgatatagatcttcccactgtatttacaggcaataccatcagcattaggtgtcagcgccaccaaaggttataatgttaattctcttgcagttccacggaaggcaaaagaagccattggaggaataacaaaacttactcatgtcgatggtaaattttactaccacctactcatggattaagcagtggattcatcgttctgggatcaacattgtaaatagaaaaaatataattgatcgatccatagtggcatctaatcacatcaaatttaacaatgttttttttttcactttctttttccacttatattgctgttttgcatttgtcaaaaattgacatagaaccattcttatgcataggtagaacaatggtcatcaatgtcgagtacaatcagcttgatccactccttcgtgcaaccggacatcctgatggagatgcaaattgtgaaacagggtactctccataccctggaaatataaaccaggtactttctgccaactgaccatccaaaccccgacttgaaagtttcaagacattttaaaaacatggtgcttaacatgagatgttgatcaaatatgattttctgataaatctatttacttgtcgatgtgcatattgattagaaataaacaacactcttctgttagccatgcatgttttgttgggaccactgatttttgttctactgattctgtgcgttacacttctgcagttgatactggagattggaccatatatggaggagctccagaaaacacacggtgccatttcggaatttgtaaaccctaagtaatttttctgcctacttactccagtgaaactattgcacactgcttctgactcccattttattccaatagtgggtttttaaggaagcaaaacttctctcttgtttgtatgcctctgatttctttgtgcacacttcttttccattttcacttcatactgctgctacatttgttgtgaaaatatttcccctcactaatgtcagctagtcagttccaatcgatgtgctgataatcatcttatcttcccagtggtatcaccaattcttgtactattgatcatggaagttgttcttagttactatgcgacaaggtattcctatagtaccattaaggtactctgagctagtgcactgacaaagtaaacttcagaacaagtttgcagcaaacctgcaaatatttcgtatagtcaacggagtagataagtcttgttttgaattttgttagatacaagtcagggcacttcaagattttgtgaataagttcctaaaatacttttgttttcaaatgtttaaccccaatctgttatcattttttcaatttaggtatactgattctaccaagacagcatttaaatcgtccactcgtcttgagtgcatgatgcaggactatccaaaaacactacctccctctgcaaaagttggatttacggtatgggaatgcaaagttcatattgagcgagaatttttccgataattaatctgtctgttctcactttgctcttcttttttccttgaatgctaggtgatggatgcgtggcttacttatgctcctgtaaagaataatcctgaagattctgctaaagtatgatttcactgcctttcgagactgaaaatttatattataatcattaaatatttatgctcgcatatgaagttatgcattgtgagaactggccctgctttgaaatttatgccggggtcaatgaattatgattcaggttaaaagttgttcctataaatcaataggcctgttgtcagattcaacttgcccttctttgtgattcattgaaaactacatttcatccatacttctgaagatactagctacatacctgatctgtgttttgatgacgttaagaggttatgcatcagtttgtagttttataccaactgctttggttcagttgctttacatcagcttcccttttcgtttccagtctaatactgtactgcgcatgtggtcttctatcttctaatatgccttctgcaggttccaaaaggtaatccttaccatagtgctacttcaggagagatggcaatttacagggcaaacagccttattttaagaaaggtgatcactttagaaatattctttttggataggaaattgtttgtgctccagcttaacacaagctctcttacaccttttccaggctggtgcacagatagctgaccctgtaattgatactttcaatggccaagaggtagaggtttggccacgcataacctggatcccaaggtggggtcttatattcaaggatgtcaaagccaaagtccatagcaactcttcagtttctcagaggtcagccttggtcatcaatggcaagaacatcaccattcaaggcctctccttggatggcactcttatcgtaaatgccaaagatgaagccaaggtaataaaaatacaaacgcattcgaattaccaactcgtaaatgacatgaataccgaaaacgcaaacaatttagtcatatttgactgatggattattcatacgacacccgttttcagttcaatgttacaggtcatatagagaataaaggctggactatccagcacgtcgatcacaaggacacctcggagaaggaagagatcagaatccgcgggttcaagttcaacaaggttgaacagctagagttgaactactagccagggaagcattgcatgaacaaatcatccctggtttacatcatctgcaaccaaaatgttcagttgaaaataatccacattaggtggccatatatgtgataagctgatactattcgttggtctcccaagtgataaataaggagctaactgcttcaccaattaagcaattatcaatcctaagtgtaaatttttacagtagccgttatttacagccaagtcattttaatgtaaaataactgaagttacgtaggatgcttgtactgaacacttagtattgaagcaaccaagatgccttgaaatgtccttgtcacttgacgtcagatgacaagaacaaaactgaaccttttcttttctataaagctttggactttatattatctccaaatctagacccatcctgtctacacaaagttctaaaactgtttattcaagaaaaagagaaggctacaagttgcaagctggaattatactcactctcatataataccaataaacttgtctccaaatcttagacccaccttgtctacacaaaaagttctaaaactgttcatttaaaaaagtgcaaaaattgtaaattattatagaacatgcttactctcatataataccattaaattgtagtactatctagattgcaacacagctttctataagcgaatcagatctctccttgttgaaatgttggattttaactcggatttgctcccgtatcatacacaaattgttgtaaaatatccgaaacccaaagagtggaacataaaagcagcaaacacgaagaaagctgtacagctacaacttttttattcaagaatttgtatttacacagctatggaatagtggaattgaaaatgtggcagaagcacaaacaaaaatatgcccttaccagttggattacaactcaaaatttacctatattaattgcaaaactattctatatataccaaaatagttgcccacatgataaaccaaacatataaatttttcaacaaataattttagctatgacttttctttgagtatttgttttggtgtaaaggaaacaatgcatcttaagggtgtgttcttttcttccctttcacaacttctatccctcattttccgcatgtgaattttcagaactactaaatggtatgttttttcaaaaaagttatatagaaaaaatgcttttaaaataatccatttttaaaactgttgctaataattaactaattatgtgccaatctgccactccattttacatgccgaagagaaagggtttccaatctgtccattttaa

SEQ ID NO: 41147 - DNA, 9776 bp, Oryza sativa
  unsure (1)..(9776): unsure at all n locations
tttattccctctcctctcctatctcctccacgtgtttatagctgacttagagtaagtttaatagtatagctaactactagctccaaatcatctataattgatttaatagccaattcatacaatagttatctataaacatatactacactatgttattatacctgctcttatactctgctattgtatttgctcttaagaaaaagtaatagcaatatataattctcatacagagaaccatatagagtggagagacacccaaaaaagaaaaataaaataacaagaggcaggctaggaggaatccttgtttgagacggcccacggcccatcgaggcccacagtcggagaaaccctaccgcgtcctctccctcccttaaaaggcgcctctcgccgccgtcgccgaaaccctcttgtttctctctcctgctccccccccaacgccgccgccaccgccgccgccgccgccgccgaatccgagacccccatctcggattcacctctcccgcctccggcctccgtcaccgtctccccacgcgcgtcaggtcgagatcccccacccctcccaccccccgatgattctgttgctcttttccgctccggctcgtcccgatctgtgcgctttttttttttttgggttgctcgtgagatgtcgcgtggatctggctctcgcgcttgggctggatctgtggtagtgataaacaggtctagccgtagcttgtgcgcggtggaggcgaactctaggtttaggtttaggtttttgtttcctggaggaaaagttgggtggatttttttttctattattattatgtttgatgctgtagtggtcttagtttggtagattcttgggtttgtaggatgctcagtgtttgtatttttgtctgagatgattgtgggggattcgtcatgctcagttctgtgcttagtgatgctatactagatgttttttttgtcactgtttatgtttattaaaatattattgtgaaggtagcaagctcgcagagtcgagttctatctattggtgctgtggctcgtgccggtttttggtgttgaagctataagggttagtgtggggtgtattgtatattgtcaccttgctgcgattatgcatttgttacgtggcagaatcttaggacgccatgtccagcttattaatgatgttatgctacttgcaatgaatgcttgagtagacgtatttgttctaggtagcaatctaaaagcatgggattgaatgctttaattgaatgtgttgttgcctgcggataacctcttgcttctgtttttacgttaagtgtcaaatagtaattattgttaatatagtcggttgtatggctagggaactgatgttatgctcctagtttcatgtagtggcataatctaagtctttagaatgtgcatggttatagttgatgttcagctgtaatgtatttttcaagcaagtgatgttatttaatatgtagaacaaatgtgtaatatgtagctctgtgaaacatcacccataccgtttgcgatgtatcttcttcatatattgctttgttttcccagttcatgtgcctagttaatttacttttctgttatgcgcttatcttgttgctaactggaactagcagatatctccatcacgcatgttctcctctgtcctactttctgttcttttggctaacatattatcttattaccacagtcatggcgggaatggcaccagagggatcccagtttgatgctaagcactatgattctaaaatgcaggagcttctgtaaggaatcttatactgatacgttttatctcagccatcattgtgtacggcaatgtctgtctatttcctgtacaggatctaccgcttactgggtagtcttttaatgcaggaaccaaggtgaaaccgaggagttcttcacatcttatgatgaagttcatgagagttttgatgacatgggtctccaagagaaccttctcagaggcatctatgcctatggtaggtttataatctttcgtgctttttttttgtgtgtttgccatttgaactgttattcatcagacctttttttttgttttataggtttcgagaagccttcagccattcagcaaaggggtattgtccctttctgcaagggtcttgatgtgattcannnnnnnnnnnnnnnnnnnnnaaagactgccaccttctgttctggaattttgcagcaacttgactatgctgtggttgagtgccaggccttggtccttgctcctactcgtgagcttgcacagcaaattgagaaagtcatgcgcgcacttggtgactatctgggtgtgaaggttcatgcttgtgttggaggtacttctgttcgtgaggaccaaaggattcttgcaagtggagtgcatgttgttgttggaacacctggtcgtgtgtttgacatgctgcgtaggcagtccctccgtcctgattacatcaagatgtttgtccttgatgaagctgatgaaatgctttctcgtggtttcaaggatcaggttagcattatcttagttgtttgtattttgcatttggtttgcggtttaacactatttagactttctgagagcatgattcattaatgattgtacaattcttaatatgattagagttagatttcctgggagcatgtttcattgatgttatacaaagtctactaaggttgatgtgtcaccaaagatctcaatttgatctcaacttagctatcctttttgtgttatttaagtaactaattcttttagaatactaagcagcaggaaattgaaagtagttaagccagctgtatacgtttcatctctttatgttatgttattggactattctgaaaatctgtttgacatgtttctgttattccttctattacgtgcttcatatctatagtaatattaatttcccttttgttatttgcagatttatgatatcttccagctcctcccgtcaaagatccaagttggtgtgttctctgctacaatgccccctgaggcccttgagatcacccgtaaattcatgaacaagcctgtgcggatccttgtgaagagggatgagctcactcttgagggtatcaaacagttttatgtcaatgtggagaaggaagaatggaagcttgacacactctgtgacctgtatgagacactggccatcacgcagagtgtcatctttgtgaacacccgccgcaaggtggactggctcactgataagatgaggggcagggatcacacagtttctgctacccatggtgacatggaccagaacactagggacatcatcatgagggagttccgatctggttcttcccgtgtgctcattaccacggaccttcttgcccgtggtattgatgtccagcaggtgtcccttgtcatcaactatgatctgccgacccaacctgagaactacctgcatcgcattggtcgtagtggtcgttttggtaggaaaggtgttgccattaactttgtgacccgtgacgatgagaggatgctgtttgacatccagaggttctacaatgtggtgattgaggagctgccggccaacgtcgctgaccttctgtgatcaagttcagaagagttatgttaaggggcctgataaggattgtttttgtctgaagtatcactgtcttatctggggggggggggagtgataaaggtgggggttctgttttaaaagtcactgtggtcgtagacaatttccaaatttttatgccatgttatgggaatttttgtagttgctaggctgtgctatgtgctggtgaggagggaggagtcttttacttttattatatctattgttaaaactatgtatgaccgaatgatgttatttatttgtgtcatggttgactatttgccatatgtattctgccaccggtcctgctactgccactggtatctcgagtgaaaactgtttgctcctcggtgcaataagccagataacatgtcacctaccggaatgccgttgatgtctagtgatgttttatctgttgatatgcatgtttggttggatacttgcctggacgattataataattttttgagatgttggcttcattttggtgagtgaaaacattggccagttctcttcacaagggaaacaggttttctgtccatatttcgactgaaatggtacaccgtcaatcgcttgctgtaatctgaagcattgtaaattattggaagcatagatgtcaaggtacaggtaatctgtatcctgttagatcagcgccatctctacattctactctgtaaataaatggttgcatgagttgaggtcccagtaatagctgagaaacggaaataatagtaactgactcttttttactcatcatcgctgccaaatgaactgacgaaagtatccggaacaatacttatatgactgaacattgctcaatcttagctctatgggaaatttgacctcttgtttttctgcacctacctatcataactgctaaatggacagacgctaaccatgaaaacatccaaacatttagcttgttggaaaattcaccttaacttttctgcactcgtagaacattcagcataccctgccaaatggagcaagctaaccatgaaaggcatccagaatttcagcagtttttctccctgaatttctgaatcttagctagtttggattcaccttagcttttctacaccaccagaatttttcccctccaacttaacaacatttggatgacctccttcggtcatcccgacaaaaaaacaccaccagaatttccaatgtattatcctagagtcccgctccggtgctttctacttggaatagaaagcaatctgagccgttcatcatatttaattgtagggttgtgatctatttctactcccaccagagttagtggtagtagaaatgtgcaagggtatattcgttcagggataataattcgtgcaggggtattatcataatttatcagtatctaactcatcttcggcgacgccaccgccgtcttccagcactgcgacatcgtcgcacgcctccccctccgcggccagcagaacaccatcaccgcccagtcccgcgccacaggcttctcgttccaggactgcagcatctacgctgacaccgacctcctccgcggtgcccccgccggcaacagcgtggagacctacctcggccggccgtggcatccgatcctgagcagctcgccattctccgacacagtggaaaactaatggctgattcctccgacactatggcaagaacttgccatggagctcaagaacaccctctcgacctcttcagaggcatctctgctaatcaagcacatgacgtactccatcactgatgcatcgcacatcaacgtgatcctgccatcatcgccggcgaagccaaattcctcttgagacatggcgaggagctcgccgaaaaccaccgtgcgaaggtacaccaatggcaccctcgaaccgtgccccgtcaatggtgtacaccgcgctgtggcccttgtcggcgagagacgacgacaccatgctgcagcaatcgcctgtggtgcctgccgtgcccatccaccgaacctgatgcgatgcgaaccgaacaaaacatctcatgccaaaattacccctaaactatattaggagattacttacctgcccttttaaataaacggtcgagattaattctacttgtagtagaatactgcaagtagagtgcaccggagcatcacccattatcctaatgttgggttctgatcacatatgagagcctgtgagtcagtgagccactgctttgcagcagttgatgctactacaatgtctcattcctcaaaaccatgctaacatgtgggctggttcataatgttaatgcaccactatatgtacacatgatccacaagtgcatgtgtagtgtgtctgcatgatctgactgactgaactgattgattgatttccagatgtttcatgctctagatcatggcagattgatccatatgttgactattaccttccttgtcgatgccgacgatgatccgtaacctcctcttcctcagcatcctcgtcgttttcgcttttttaacttctttatcctagttcatcttttgattttctcctttgcccaactagctttccttaattcattcatccatccacgttctttgtacagtagatatagagctctctttttttctttcttctttttctttgggatgcataaagctctctctactccaccaattaatccacatatgcagtcaccatcacacgtaatcttgtgcaaacgtctggtacaaaccatttgaacattctcttgctatattttgcgtgtgattaactttttagcttgttatatattctcttgatgaacagactagatcactagccgatagctgccttggatgtgtagacaaataacatgtcacccattttcttttattttttgctgaagaatgtagtaataatgtatgcatcgatgttgatgtgtaacttccatgacaacaaaaacccggcaatgctggaaatttgtcaaacactcaaaactttttatatatatgctcttcacatcgaataggtcagattcccaaccgaccacaagctgcaaaaaggcaaataatatcatcttctaagattttctgctgaaagttaatgaaaaatgtgagcatcaatagatgaaaatgaccaatcacatgtatgctcttcagaaggagagaaaagctgaatttattggtaccagaattagtttcagagttagccccactgcagatggggatcaaggaggctatagcttagagatgacccaccctaaatcacatccaaatctcaacactgctttcataatgaacagtcccaacagtagagctgtttcattcttgtccctctactacaaattgatgatcaaagtctcaactttagtttcaacatctcttttgaaaagaaaaaaaaaagaactttaatcccaacatctcttggttggttggactgatgcatggagtggatcatctttctatatatatcttcataaatttgattgttcaattcatcagctggaaaatggtaataaataattgatttaccatagttttcctgtgattaatctaattgtccttctatatgagttggctctatttagggaagctggagattgagaagctgctggtgagtatccagctagagaagctaggaaacccaatgttatgctaccagttcattttttgctacccgttttaaatgttattcttttttcagaacttttgaaattacatgcttgtaggcacctacgtatacgcaaggcagttagctagtgcgatgtgttatttgattttgatatgctgcatgattcatcgtcctcttttcctagcttttattttactttcttatatatatatatgtacacctaattgattctcaactatgttatatatttcgataagacaatatacctttcacatcacagtcaacaatctgaattaattactatatatattagcttttttttggtttgcctgatctcacaaagtagcaggctaccgagcatatgaaagcaacttgaaccaatgtgtatcctccttttgggaagatgggaaaaatgaggaagaaatatggtggtggaagcatgaacttttaaggcagttgatagaaagattcattttagtaatatattgcatattgttgctagtgggctaattatcagatcacttttgatcttgcagctagcactactctgaaagtgcttacccttagctgataatctttttggcttgttagcattagctcattagagtagatatatcatatatataaggcatatagctagtactaataatgtactagcaccaatccaatgatatcatctttaagttgatttcaatgagatcaactcatctctgatgtcacatcatagggattaatcggtcaatgcaatatttcccaaaatgcattatgcatgattcatgccttcaatgcttagacctaattagtccattacctgaacatatatataggatattaggctcccatcatgtcacataacatttagtaagacaaaaggaaaaaagttcataaggatccacttaactcttccaaaagtttgatcatttcaaccaagcatcgattctgggcaagaatcaattaaccctcaaaacatcaatgccgttagctttacatcattgacaccaaaatcacagtgatcccagagtcaaaaaccattctttctgaagcttgcagggatggacaatggaatttctctgaaaacaaaatatttccttggaattgaaacatgtactgtatatattcgtgcatgcacattgtcatgtctggttaaacatagtactgcaaattaatctcgttccatgcttttagcaacaacacaagttgtattattggcagctttaatttctaacgcatttacagatgataattaggccccaaccatgtgcatggtttggtcccttcaggctacctgacagtggatttgccggccggccggttgcaaattaactgcatatccacgaatatattagatggagatggtgctccaatcaaattaaatccagcttaataaaaagctagctagtactagtccaacacacactccacttaatttgtacgtgcagatcgattatccttgtcatttagatattcttgtcactctgtcagacttccaccatgcatgatatccatgtctgaatattggagtccctttttacagctcaagctgtaacactgattggccattaattctgctatgtggtaacctttgatcatcccctttacttcattatatctcatctggctatgattaattgttatatttttaattgaccgaaaggcgttttgatcgatcgagtccatgtctgcatgatcgaatgcagctcaaatcattctgcactgactcgtttttctttctgtttatgtcgaggccaactaagtgtagtggaatggttaattgataggtaacctaatcaattaataattgggccggtggatctctgatcaacgaaccttgaacgaaaaaataatgtcaattaatctatatatacgacatactccttccgtttcagaatataacatgtatgttttggtttttgtctgaagttaaactttttaaagtttaataagcatacagaaagatataacaacatatacaatatttttataatgtatttgtttggtgttgaaaatgttacgttgttgtgtttatttaaacctgattaaactctaatacgtttgacttacaaaaccaacatcttacatcctgaaatagaggagtaattagtcaggagtgcattcattttgcctatttccttccggacttggatttccttaatttggtcttatttaggaaaaagttatatgaattaaaaatgtgatgcatatatgaacagatcatggagagtatatatcttccaactactctctgaacatgcttgcctggaacaaagtcacaaactatagtgtctcagcttgcagatgattgtccacgtgcacacgattatttatgatgcacttttagttgattattattggagctacctagagccttggagattaattaattattgtccagcccgcagtttaattaattaattaattagcacagtatatatactactctaggtgatgtacgatcaagtcgctttgattagttgtttctggtcctggcagaatcatctacagctcgacgctttattcctaggacagatcaagggacaaggagaaaattgcatatctaccatcccatatgaatggcttcgctagaataccattatgaaaacgggcttcgctggaataccatcctcaatcagagtgtcttcgccaaaatgccatcccggacggaaatgcccctggctcttcttcttcctccatc

SEQ ID NO: 41148 - DNA, 14959 bp, Oryza sativa
cacacgcgggatggaagaggaagaagagccatgggcatttccgtccgggatggcattttggcgaagacactctggttgaggatggtattctagcgaagcctgtttttataatggtattctagcgaagccattcttataggatggtagatatgcaattttctcagggacaagggatgcatgaaaaatacttaatttccactggtcgatatatacacgcactgttggtgtgtatcttaattaattaaatacggagaccgaatgcataagtttttttttaaaaaaaatacaaacacggacgctcacacttcgcgcacactcaacattataaacacacgtacaccttataactatgaacatctccggaagataattaattaaatacggagaccgaatgcataagttttttttttaaaaaatacaaacacggacactcacacttcgcgcacactcaacattataaacacacacgtacaccttataactgtgaacatctccggaagactagactgacatatcttgaaattgatgaaatcattacggacgccttactctcacgagtatgtcatctaccactaaaagaataattagttataaatataagcattcatgtcaagtttagaacttgaattcagatgagctgatttcacaacaaaaatctaaccaattaaactactctcaccttataacaaaagttatttattataattaaataagtcaaatgtttcaattggttatatgtatgaaaaaagaaatcggtcactgaaacactggaaaaataaatatatggtgaaacatctttgagaagtgaagtacaacataaaaaataaataaaaaggagaaatatggtcgaatatcaaataaaacactttaacccacatatgaaacattgaattttaacagttggaacatcaaataaattttcttaaaaatcaaaaactggttaataggaaacacttgaaatattttactctcatgcacgaaacattttgctctcattcatgatatgttgaatgtcaagtattgaaacataaaagtagtaatatactctcaatggtctcaagaaaaattaaattcaataaagcaagaaatgcaaggaactaacttaagggagtgaagaaccgatattgcagtatccataacttcatccattagggtttaaattttagtgctcatgaatatattatgtatacgtaaatagcttttgataaaaaaaatagcgatgtcagtaatatatgtctgccgttaatttttatttctttaaatatatgttagggaacatattcgtctgcacgcgtgtgtgcgtacattttaactgcgattttgtttttaaagaaatggggtagctcttcttaatttttgttgctaggtggcctagcttttttatttttttaagaactatgtggcctggcttgcgtgatgcatgcttccatccatccttgtggcacaatatcacgtcaggtccgatcgatcgactcctccagatgcatgaatacggtgtgggcacgatggagagaagaatactttattactcatatgacactttacaatacaacaaatccggatatgtttattgtccagatttattgtactataaagtgtcccatccagtcctagatttctatattatgggacggaggagtcaatttggatgattaaactgatacttttatatatactatgtagaacatacttctaatcttactcccttacatcctaaaaaattcaacctacgaagagacatgacccattctatgtcatcttctaaaacaacaaatctgaacaaaggatagtccaaatttattgtattaggaagggatttgatcctttgttaagtttatttgggatggagggattacttcctctaaaaaacgaatctagaaatatatcacatccagtattagtttggtttttatgggacgaagggaacacgtcatacatgcatgcaaaggccgtataggcaagtacaacgcgtggccggcaaagtggttgaagttcaccgggttccggtgaaaagctgtaccggccgccgccgcgtgtgcgccgtcgtgtcaccggcgggatggccggagccaaggtcgacgatcagagagacaaattcaagccgaatttttcatcgcctagctgatgagattttccggcggcggccgaccattgctgtaggaatttaatctagtatgcatggaccgacgactcactagtcaatgtcgatggattgatcggacagatcttaactactccctccgcgttgactcttttaaatatatttaattgtatattttatttaaaatttttatgaaatatataaaactatatttatatatacaaatatatttaacaataaattaaataataaaaaaataattaataattacttaaaattttaaataagatgaacggttaaatatacttaaaaaaaaatcaacggtgtagagacggctgaggtactattattccgacagatagtagcatgaagtatttcatgctgaccattgaccatccacgtcaggtacctgcatgcatgctacttctcgatctgctggagtactacgtcctttccaaaatggacttctcctccattggtttatataatacttcatccttcttattttaaatacaatcatatatttctatatccaatatttgatcattcttttgtagaaatattctttctattcagcaaaatatttctcaaacttctaaagcagtacaatttttcatgaaaactttctatataaaaaacttttagaaaactaactgttttaaatctttttctactttatatatgttatttatttaacttgtttatattcttaaataattatcacaaatcattccgctattcagattttccccccaattcgggttataattaacacacggtatatagctagctattcaactgatctccatatatctgttctgacgtactgttactgtcagcaggtagcatcttttagtttggactacaagtactcaagtagtacaatcttggtcttacttggtgtgcaaacgatcgatgtatcatgtatgcatatatatgagagaacacatatatgcatgttactgtcatctcctatcagtatcagtatatatagttcagccatgtcgttgttagataagatgcatgcatgcatatactccttctgtttctaaatatttgacgccgttgactcttttaaatatatttgaccattcatcttattaaactttttttaagtaattattaattctttttctattatttgattcattgttaaatatacttatatgtgtacatatatttttacatatttcataaaagtttttgaataagataaatggtcaaacatgtgctataaagtcaacggtatcaaatatttagaaacggagagagtatatgcgactacttgtacttggaagatctaccgatcgtcgacgatcgttgtctagctcctcgtcctatgaatttcaattattggatagccctgtactgcatgtactgatttgatgattctttagacaaattaatggagaaagaataaattgaattaattgatagtagctagtagcttgtactgttgtcgttgtcaagaaaaacttgagcgttttttctttttgtcggaatagaccagcactcgctcattcgtgcgtgcatggtagtgatttctttgataactaatggataacccggccgtcaaccagcaatgatcatatatatatctcggattaatcgagaattaagtcaaccattttatgttcagataaattactataactacatgtatgcatatgatcgatcgataaaagaattaagcacgcatcagttgatcgagctcgccctcctatacactcctcttcgtcctggtgatctttgggatgtttggagttgagatgagttgcacggctgtggttcctttgtcagatcggaatatgtaattacgcctagcggttgtcgattcggtgctaaatttcttctttgatatcagcgtgtgcgtctttctattaattaattataatcttttgggttataatgttttttacttaacttttgggttataatgttgtatttttttcatattatatcaatataaaatgtttttaaaaaaatgctaccaatgtttgtccgatgctcctatatgtactccagtcttccatttaacactgtacacatgtatgcttgttcgaaataattacagaagacttccccaagttcttttgcatgcatgcattttgggcagtttcagccaaatgcaagtggccaactggacagacaggctactcgacccgaatttaattaatttgcagcctgtcagttttgaccagagctaggtacacgcatgacgatagctatagtatagatccatccttgcacgccccaaactttatttttcatcgattgacatatcaatcaatttacctctctctactgctctctcaatctcataatattagacaaaacatttgaccaacaattattataataaaaattaaattttattttctaaaattaacattattgaattgacatttaaatttacttgaagatggttataattttgttgcaataaaccttatagcatatgagaattatgagtcaaagattagttttgaaaactgtgctaagtttaaccatgtcttatattatgggatagaggaagtatgtagaagtactaatctacacatcatcagcctaatattaatcatgttataattttctcttgatcgagtcttgtgtatctatgtcctgccacgttgcattatcataaagaaatttctaggtctgaatagagaatattatctaactacttttttttaatttttggccattgggacttactagctagccgcattaatttttgcaagaattagttctcaaatgtgcaagtcgtaacagcattgatttgaccaagaagagaagatagccatcaccatacatatacaagatgcttgcagtaatttttttttcaatatctatatatcggctcaaactttttttattaatcggctcagtctttcaaaagtgctcgatatatatatatatatatatatatatatatatatatatatatatatatatatatatatatatacatatatatatatatatatacatatatatacacatatacatatatacatatacatatacatatacatatacatatacatatacatatacatatacatatacatatacatatatgcatttataaagatatgagcgtgttatatttaagaaagaatataaatatacctgctcagttgctctcaattaacctccatttttcttaagaaagacatgctcctaattaatctcactaacaacgtaattaagcatatatataatacaaatctgtatcacacatatatggaggagaccgtctccaacttgggctctgcgcccttcccgttggcacacgtgccgtccaaacacatatattcgcacgtgggagaaaagtaaagctgaccgtcggatcaatcaatctggacggactccggtcgtgtcccatgccttgctgcgatggttcccagctctttcacgtttcactattctcttgtcctcgtgcgaatgttgcatgcatggtcaatgtcctattatgccatcccaagtaggcaaagctgtagggcacatgcctcctttactttcgggcccaccaaaatgaggttcttgtgttcaaaaaaggccaccggtttttgggtgaaaaaggagggcgcataaggctagaaacaacactgtgaagcgagtagcgtcggagcgaggggcgctagcggtcgtgggggacaggtagggcgtgtcgccgcagcgccgcccgctccgaggtcgtcccgtgccgccagatccgcgtcgccggcctggggaggagggcagcgcggcggcgaccacggtggcggtgacaaagccacggccacggccatccacgtgccgcgccggacgagccatcgccgctggatctggcgagctgccacaccgtacgtcgtcgagactcgtcgctgccacgccgctccctaacgagccacgacgcgcgaggaagacgcggacgaggcggcgggggcacgcgagaggaggggaggccaagaagttcgccgccgtcgagcgccaagcccgccgccgccgtcatccccagatccaccgacactccgcccggtcaccccggcaccgtctctgctcgtcgctgctccgcccggccccatcgccgtcgaggccgccgctccgctcgaccgccctagcgtcgtctccgctcgagcgtgagaggagagatagggaaggcgtgagagaggggaagaagacaatgttgggctcgaggaaaaggggggagagagcggaaaaggtggagaaaaaaaaggaaaactatatttttgtggaccccacttgaggatactgcattgtaaagcttgtgtctatcaatgttcctcagcccatgtggcacctcaggtccagcatattacgtgacgcattgctattgccttttatgctcgtgtcatttttcttccccgtcatatctcacctccttgtcgtcatcgtcctccttctctttaaacaattgagatatccgtgtctaatttaaaaaatttatgaattttttttaaaaaatagtcacccataaatcactgttcatgttttatcatctaataacaataaaaatattaattatatttttttttcaaataagacgaacagttaagcgttggacatgaacaattgcaaaactgcacttattttgagatggagggagtattatatagcagtatgtggtacttctcgatacagagaacctgcgctcctctctaaagtcattactccctccttcccaaattgatcattatataatataatctaaaaaattgcagtagccagctagagaagatgcatgggaaatataagcgatgatgtgggaagggcttattcctggattgcacacagttcttttattaattatggttgtattgcaaattgaaaatgaattagttgaaagtcaatatgttgtttcattttttaagaaaacaattaatttgttctctgagtgtaatgtatatgatttttgtgaagttgatacattttacctcaacgaatctaaatgagtggatatcctccaattgaaatgttattgcgttggattgagagtacaaaatcacttgcactgcaagtcaatgtacaaaatcgatcccttgaaagttttaaaaaggataaaaacaagttgtggtaactaataatgcatggttatatgtcggcatatcttccttatagtaaaacgaagggaaaaggactgtacaaacaacgatggacagtggcatatcttaattatattatctttcacggaaaaggacggttactgttaaaaaattgactatagaaacaccaaaataaagtatcaggtcatttcacgtcgtgcatggcttttaagtgaaagctcactaataaatatattaaatttcaccataatactctaatatatatttaggaaatactcttgtctaataaatatcagttggtgtatataaggggtctcttcggcatcctggctgcggctgcggctgcgccgtgtgtgtgtggcactgttggtgctggttacgccgcaaccacgaaacagacagccgaacagacccaacatcacttggtttagccatgtgtcggccctaataagtaaggcttgcgaaatcgatatccatatgactaactttagaggtggcgaagggcattgatcacgagcctttaggtctataatttatatattaacttaactctagctctgtatgaaattacgaaaatccattatacccgcgtgataaatcttttatacttaaaaggttatagagatgtgaaatttgtgacacatagctaaaacttctttttgtcaaaatatatgtgaatatactcatgtataaatctgggttccacatattgcttctatctcagaataaatcaacctaaaatatgatgagatataacataataaatctaaatttagataggacgggtattatcctatcccatcctaaatttgattattttgggacaatagagtatatatgtgcatctccggtttatctccacggattctgccaacagcaaaagaaaaaataaaaaagaaaaggatggggttagtaaagttcgagatatgctgtgtgctttgagatgacacgtggacaatgagatgggcagatggaagaacacgcgtgaactaacagccaatgcaaaattctcttccttaatcagtatataaatctctcctagcgtaatccctcttccactttgctaactgagcacgcatttatcttgctaatcactcggcattaaattagccattagggtcggtgctaatgtacatgggagtgtcactagcagttgttaatttagcagatatactaagatggtgtttggatccagggacttaactttagtccctgtatttagacactaatttaaagtattaaatatagactacttacaaaactaattatataaatggaagctaatttgcgagacaaattttttaagtctaactaatcaataattagagaatgtctactgtagcatcacataggctaattatggattaattagactcaatagattcgtctcgcaaattagtccaagattatggatgggttttattaatagtctacgtttaatatttataattattgtctaaacatctgatgtgatagggacttaaaagtttgtagtcccatttaaacaaggcctaaggtttaaaaaagatttattttcattcgtttaagtgattagattttcattacttaggttcatctctcaaacacccgattgcttgaaatatttctatgtgttagaatcaatgtgctcttgaaatatttaaattacggtataaatttaaaatttaaaagttgttatattttaaaacaaagagtgtaataaatactacccctgaagcccaaggagaaccagctaccagccattcttcttcctcttcttcccttcactttctcctctggccgtcgccaccgattttgagcaatgtctctgatcaattaatgaaccttaattgaaagaaaaccaccactagtagtaaataatcaaatcttcttaattaatcatatactcagatacttgaattcatctggtcttatttaaagaaaaagttatatgaaaatgggatgcatgtgtatgcacagatcatatatggagagtatctcctggccaactgctctcaacttgcatgtctgcaactaaccatatcgtctcatactctctgatctgattgtccacgtgcacacgattatatatgctgcactagtgtataatgatgttgattttaaaatattttattgacaacttatcttaatacaaaattatgtaactattatttattttataataatttgtcttatcagtaaaggtattttacgcatgactcatactttcacatattcatataaaattttctaaataaacatgaatctaaaagttaatgatatcatgtatacatggaaaacgatgaggtactgaagctagctaggtagccagctttggatagttagttggatattaattaattaagtattgtcaggccggcagtttaactaattaaattagcacaacactactccatgtagtatgaacgaatctctttgattatatgattctctttgacgcttaatttattcctcggacagaacgatcaagggaataatatctctgtcgagatatgtgaaaaatgagcacttttttcgtccatcgaattcaactggttgatgcatgcaattgttagagtagatcatagtagcacatacatatatcctttctctgtaaaaaaaaataatgcaattttatgtgtctagattcatttctaaattgaatttttttaaggaacagataaagtaaacattatatttttcgatgatcgacagataagagagaaattaaagcaagaaaagaaatgcaaggaactgacaattaatttagtcaggtttctggccgaatccttcaaatgcatatatacgtgtggacacgaacaatttagtcaataaattaattataagttaattaattaatagttcatatatagacgatcatgccttccagcacaaagaggttctccacagagggacctgtcacgaaaataaagaaggtaacgacaggaatccagaaacgtctctcgaagctcatctcttagatttacatttttatagttttctcgttcaatttttttttatagttttcgtttctacatgtactccctccgtcctaaaataagtgcagccatggttttcagcgcccaactttgaccattcgtcttatttgaaaaaaattttaaaaaaattaaaaacataagtcacgagtaaagtactattcatattttatcatcttataataacaaaattgctaagtataaaaaaatttcaaataagacggacgatcaaagttgggcgcggaaactcatggcttcacttattttgggacggaggtagtacaaaccagtgtttacgattctgatgaaatccgaccggatttcatgaaattttgacgttttgatgaggctcgaaagtaaaaaccatatgaaatttcgagaagtttcatccatatttaaatttgaattgataaaaaaagaaaacaatcaaataaaatcttataaatactatgataccatagaacctattgagatataaagtttcaaaaaaatgatgtatcgtgtatatgtactgaaacttacatcaggaaagaaaagaataaagaatttaaaaaatggaaaacatttacatgggccaaaaccgactggtattaaaaaaaggaaaacacttactgatcgaaatttcgtaatttcgccaaaaccgaccggttttcaagaacttgttggaaaactcagggaatttgtatccaaattttggtttatgaaatttgttcgaaatttaccggttttctaccagatttcacgaaattccgaattccgccagtgctcgaaacggaagggcctgtcggaatcgtaaaccctggtacaaactatatatttactcatgttttctctatactattttaaatgatattagtgattatgtcgagtctgcctccaacatcacaaactgacattactttgaatatatcaattaactatgcctaaacaattaactatgctataatttattcaataaaattgacacatctaatatcggttccttaaaaaaatccatgtcatatgcatgcaaggttgccggtgtgtaagtacgtggccgcacaaagttggcagttttcagtgaaaggttacatcaatcgcagtggcgtgtacaatgttgtcgtgttaacatgatcttattaattactttatccattttaaaatataaaattttttatgtgacataacatattcagattcataggtatgttttcatccaaccaaaatcttttatattttagatcggagggagtactcagcttttcaaccccagctcatcaatctgtggcaattcaccccaaatttcgatcgtcaaattatgcatttgcacaaatgactacatacatattttgttcgagaataattaaacacagggcattatattcgtgcagctaattaatataacgatgtaaaaaaaaaaactaaagtccaagaggcagacatgcagcagtcaaattaggctttgaaattaaaccatgcagctagcaattgctatagctcgcaaaactgaaaacaacaaagagagaaaattgaacacaacttcgttagagtaacgcaaagactttcttataagaggaattctccgttttgccatatatataatagatccttaattcgtcttctggggctgatcacaacgacactgccagattcttcaaacaactgagcaacgacagaaatagatcttagtatagccatcgaaccttgaccaggtttttggattttcatctgaatatatatatagagtggttcatacatattgggaaacttgcagtgactaattagcaaatagttaattattccgattaattaagcattgttgatgttacggtaattaactggagtatgtataatgtatagtatatatatccttatcttgatgaataattaagcattgttgtcagatatttcttcatgcagcatgcatacatgcacaataaatcaattggaggatcctcccaattaacttgcatgcatgacttttgacatattttcgactaatcattttatttaagataatatgtaatgattattatttattttgttgtgatatgtttcagcattaaatatatattgagtaccttttatatttatataaaatttttaaacaagataaatagtcaaacatttatctaaaaagcgtatacaggcgatcgtacatgcatgactgaagcacgctagctcatccgatacagatagatatatgtatctctaccatctagatcacatcaacctattattgataatcatccgtccccaaataactatcattctagaggtcaaggggtaaattaagaaaaagataaaatgacctatatatatgtcccttattaattaaatgataggagaatagttgggggtatggagacaaatttaaatgagatgagatttaagtgaacaactagtacttaggattacactatttgaaggtaaatttgtattaggaaatccttattattttgggacggaggcacggaggtagtaattttctcccttgatcgagtactatatatgtatatatccacccatatcctgccacgttatattaacgggaaggaatttttaagtttgagaaaatgatataacaacactgttaacttagggcaggccggtgcgactttaattaattgccttgccagtatatttttttatcagaattaactcacaaacgtccacatcgtgtaattaagattaatttggtaaaggagaagatatacaatcaccacctcacatactccaaatgaaccagattatctggaataaaagtatatgttattatcctgttctgctcaacttctaagcgtacttactccatccaaaaataaaacataatattttagatttaataaaacataatatggtatggatatagagatataagatattcattgtactatgttatatccaatcctattttagatttaattattttaaatgaaagggagtggatcgatcgcatatatatcgatccatcgtactcctgttatgtcctttatgtacgttttttttaatttccttgtctcatctttcatcgagccacactcatagatgaaggccacacacagacggtgcaatgtactataatatgtcatatctagttatagatttatttgtttgggacgaaggaagtacatggacaattagcgagtgatgagtacaacttgtagagaccggatcgatgtgtccaaattataccacattagctaaataacgaatattgaatataatatgcagctcttttttcttccgtttatatatatacaattgtactttgtaaaagattatcaatttacaacattagaatttggtcatgccctatcatctagctgcatagattttattttttttccacttcaataatgtggtaatttggtctagtggcggacccagaaaaattacactggggtgtgcccattctagttatcactccaccgtatatttttttaaaaagaaaacacccaattccgatggaagaatttttgcagattttggtcggatttttcaaaattctattgtaatgtggtccataattcatgtatattgggaaacttgcagtgactatatgtactctcagatatattaatcgaagtcatcgtttgatgttaaggtaattaactggactatgtataatgtactagctgaatgcccttgcattgcaacgggttattcaaaataggaaaaacataaaaaaaaatcttgttgaaagaaatagcttctacttggttgaaacaagattcttcatcttaaaaaaacaaaaataaaaatacaataattaagactatatttctcaatgtgagatataaaccaatgtgattttcagtacttaaatatagattgatggctacatctgtgttaacgaaatgtctatttcatatggtaatgtaatatgtacttattaataaattgtgttgtataactcatttaaaattacaatagaagccataagatgagaagaagcaaagcaatagaaatttagagagaaattaaattaaacaacattgccagagtaacgcaaagatcaactttcttataagagaaactctccgttttgccatatatataatagatccttaatttgtcttgtgggattgacaacgatattgccagattcttcaaacaattggagcaacgacagatcagagatagataatagtatctcgccatcgaagcttgaccggtttttggacttccatctaaatatatggactagttcatgcatattggggaaacatatccctatccagattcattgtataagttatgttttattttattctatatttgaaatattttgaaatgaagggagtacatgatacatcgcataccgatccattgtactcttgtcgtgtccttcacctgtgtttcctttccttatctcatcttccacctttatcgtcatcattgttctcctcgagccactcttatggttgaaggccacacaaccgatgcaatgtactcttttgtgtcgatctttcattggagtactatggttacattacatacatgtgcgtgttaacggttactgtttctaggtttgtcgacctcttatatgtgtcttggtcatctctaagccactttttagggaggaaggtcaactgtgtttcacttttatcgtacgtacgtggacaattagtgagtgatgagtacaattggatgtgtccaaattatcacactagttagttaaatatctctaggattgaatgtaatatacaactcttttcttccgtttgtgtatatacaattgtactttgtatgtaattaattatcgctatcaatttacaccattacaatttggtcatactgtgatctatctatatagaattcattttgttttc

SEQ ID NO: 41149 - DNA, 11746 bp, Oryza sativa
atgtaggtagatagatagaaacgatctaattgtttttttaatttaatttggaaaacacatctttcaccaatatgtagatcatttttttgtctagcaaagtttttccctataggtttctaaaacataattatcgaaccaaacaatgatttcgctttttgttcatgtattgttgtatctaaagtatcacgaggcatggagtctacgttgagatgtttattcgtcttttcttgtaatataatctacattgttctgaaatatgattttgattcttctgaaattctagaagaagtgcattcgtgggtatcataatttaaacattaccgcaatgcttactgcaataaatactaaattggtttatgattttacccaaacaaggaaccatatctagtagtggggaggttgaagaaaaaaaagcggaagaagacaaaaacatcgaccataagccataaatgtatatgatttgtatataaatgtctttctatttttcaaaatgaagctccacgtaaaattgcgcgaaaacatctgttagacaaacataaaacccattttttcatactcacgtgttatccctattttaaaaagttttaaaaaaggttttaagggaagggtaatatatgtcaatttgtgattatactgtttttctgaacggttagactgttgccgatgttttatacaaagaaaaaaagtgtcccactaattagaaaacgtaaccaaaccctagtgtctaattaattagaaaaactgagcgaaaaccacaactacaacaccgtcaacgcggtattatctccctggattatagtgttaaaaccttgaactcatttttggtcaatgtaggtggacagagatccgcgatgctgtatctgcggttttatctccctggattctgcccaaaaagaaaaattaaaggtaaaagattattattagtgctaataagttggagacgtgtgcgtcgtgctagctagagattagacacgtggacggtgatgaggcgatcgagcagttgcaaaaacacgcgtgtacaccaactagtagtagtagttaaccataatccatatcctcctcccttattaatcccctcccccaaaatcatcaatgcaaattaatctcccctcttcttcttcttctacctccttttgggattaatcactggtaattatagatttataggtgattaatcactcggcattgccattagcggtggcggtgatgcttgtcttcgtcatcgtccacatctcgttgatgcgtgctgccgactgccgagtgtcaccgaatccttaataaatactcctcctcgccaccttcgtctcctcctatccccgattcgcacagccaatctcttcttgcttcctcctcctcctcctccagccgccgccgccgacgacgattcttggtagagagattcttgcgttgttttacctgcgtcttgttcttcttgggagttgggtggatcgattgatcgaggttttggaggttggaagaagtgtgtgttgtggtggggggtaagtgagatggagaactgaattcactgaactcattttctttccttttttttttggtctgacaagaagtaaaaattcctgaacctgaaaccaaccaaaggacaggttggtcgacacgccaagattgcttttgctgctgtgtccttctcactcttgttcttgttcttgcttcttcaggtttgtagagagagagagggcaaaggcacgcaaagagggagagagtgaggagagatggcggcggagggagggaggtgtcagaagagctacttcgacgtgctggggatttgctgcccgtcggaggttcccctcgtcgagaagcttctgcagccgctggagggcgtccagaaggtcaccgtgatcgttccctccaggacggtcatcgtcgtccacgacgtcgacgccatctcccaatcccaaatcggtgagagccccccttttttcttttttgctttccgagtggattgattcatctccctttcgtgattaagatcgatctctccttccatcttgacttgtcacttatcattgtcctgtgatcaatgaatgataccaatcatgcaaccggtgactgagccatcttgtgggatttgtggagtttttgggtgggtcaagaagtcacacgagactagaccagaccagagtctcagtaatttgaagaaaacgatcttttttattttctttgtcatggctgcttgtttgttcattggattttcgatgattttatttctgttcttgctagtttaatcagaatcttactttaattatcgcaagaaaaattggatcttaacatatatatagcgtgttgagcgatggaaagcatcacgcaaagttgcttgcgtttctcattctgttcttgctgttcatgagttgttccagtatctgtattttttttttgtttgtttgtttgtttgttcacaataaatttcatttctaatcgttgcttgattcaataactagccagccaagcaaaggtggtgtcatgtgttcgtttgttttcatggctcgaggctggggaccacttaccatgtcagaaaataagtgcaaaatttcatactccaactctactaaaatgggatgtttgctagcgacaagtgaaccgtcttggcagtggtcgctattgttcatgacgcagggagcaattactgatacgattggacatatctcttgactcgttaattctgacctcagcacccccgaaatcctgctaattttgcagtttctgtcacgagaattaaggaacttgattactgtacaatactgtcacactcaatgaaaccgccagtttttcatctttggttcttgaaacagtcattacataattttagataaatgttactgtccttgaggaggtataccaattatgacagatggacagtaaaatcaatcacgattttagcatgacaaaactcttgaaagcttgatttgattttgatatttgctgttttcagtcaaggcgctgaatcaggcaaggttggaggcgtcggttcgggcttatgggaacggcagtgagaagatcaccaacaaatggccgagcccgtatgttctcctctgcggacttcttctggtcgtgtcgctgttcgagcatttctggcacccgctcaagtggttcgcgctggtggctgcggccgccggcttgccgccgatcgtgctgaggagcattgcggccatccggagactcaccctggatgtcaacatactcatgctgattgctggtaagaacagcctataattcacctgtgacattaatgatgtttcctgttattggtaccttgaaaaaaaaagaagctcccttttgttggaggatggccctgaccatcacctccgacgatcgaagaccctttgatctttaggagataactgaattataaaattttaaataggcttccttcatctggtggcctaatgcatgcattttggcttgtaccaaaacctactttctctctttaatgaaatgaaaagcagaggtcccaccatactttttgaaaagaaatgaacgtttaaatagtatcgaatggtagcaaacacatctgccattaaggatatcctccaattgaatagtctcatttgaaataagaaaacaaattattgacacagcttagtagtagagcattgagttttaacgttgatgccatgggtttgaagcttttttttctgtattaaaagggcaacagtatacttgttcctttttttaccatagtattctcttgtgtgtagaagacacaaatacaacaccactttgggtaaatattcaactacggattgaagttgtgggtattattgatacctgttctaccagtgtgacaatgggttgtgaaaaaaaaagagacaaaagcaagtttcttcacgaggaccaatatggtgggtgattagtgggagagcagaagcagaaatccatctctcaaaagtttatgtctcacttgcataaacttttgctttcttttcttttctagagggtccctcactttccatcacatcaaaaggatatgttgctgtgatgctaatatacgtgctagatgaacaattctgcttcttttcctccatgtggcgatgtcacctcagatagggcatcagattccttttagaacaagcaacatatttcttatcaagaagctacacatatttcgaataattctttctagactaatatcgtggcattgagatagctctattgtgatatgcatatgggaatatgggatacatgaaagaatcatcaaaagaaacaagaaataccttgtttcaaaaagaaaaaaagatttggaagatttggtaaaaaaaaaaggaaagtgcaaattttctttgtcgtatgttgacaacatttctggttttcttagttaggtgaatatatcaaatgatttctgtatataatgttttatttgacacggaagtgaagtgaaaaagtggggttttattggtactactaagaagaaggcaaattgtatatgtgaatatcttatattttaacaaatattatcatgaaccatgatttctatatccttttttcgccgggtgatttctatatcctttttggcactatcttcttatcttggatgacccatgctatcttgccagcacctatgggtagattactttctacatgccattaaatccaggcaattttggtaggagatggatgacaacacaaaacccagagttttgtatgtctgtacttactttttttgtttggtgcagttgctggagcaatagctctcaaggactattctgaggctgggttcatcgtcttcctcttcactacagctgaatggcttgagactagggccagccacaaggtctatttccatctcttttagctattttattttgcctcactattcatgtttgattgctgaggtcatgatcaggccactaaccgagaaggatctattgtttatgacgtgtcacatttatgggcacaaattcatgctaatgcagcatactgggcctatagatttggatgtgcactagccccactgattggtggactgatgaactggttggaccagaatcaggcccatgttactcatatatcatcagttatcagtttatcatcattttagcatatacccccaccccaaaattgtcaagggaaagacaaataaacttttgtatctagtggactcaaacatgcatctacactcataatgcgtatataaagcatgatctaggaaagcaaggtgaatctactaaaacaatagtcttcaaaaggcaataatagtcagcacacatgtgtatattggtattagttatatttgttctctttacttaatctctgtaattaaatgttcctttggcatgtaggccaccgctgggatgtcagctctaatgagcatggcaccacaaaaggctattctggcagagaccggggaggtggttgcagcccgggatgtgaaggtcaatacagtaattgctgtcaaggcaggggaagtcattccaatcgacggtgttgttgttgatggacgtagtgaggtcgacgagagcaccctcacgggggagtccttcccagtgtccaagcagccagactcccaggtctgggctggcacactcaacattgacggtaatatatgatgaactgtcagttgatttgatgtccctgatatgcctaaaatttcaaggtgtgctattgattctgtatcaattctgtactggtgatgtatcaggttacattgctgtgaggacgactgctatggctgacaactccgcggtggccaaaatggcaaggttggttgaagaagcacaaaacagcagatccagtacacagaggctgatcgacacgtgtgctaagtattacacacctggtaagctaaataaaagagactaggcttttagtaaaaatttagacaccaaaaacttggatcaggtgggtttcttactgtttacgttgtttgcacctgcagcggtcgttgtcatggcaggatcagtagcagcaattcctgcaatagcgaaagcacataaccttaagcactggttccaattggctctagttcttctagtgagtgcttgtccatgtgcactggtactgtccacacccattgccaccttctgcgcgctactaagggccgcaaggacagggctgctcatcaaaggaggagatgtcctggaatccttggctagcatcaaagttgcagcttttgacaaaactggtacaattactagaggagagttcagtgttgaggagttccagccagttggtgaacgtgtttcattgcaacaacttctttactggtgagactcgtcgaaactttcacttaaaatttcttcttgtgtattgcatttaattatatggatatcacagggtctcgagcgttgagagcagatcaagtcaccccatggcatctgtcctggttgattatgctcaatcaaagtctgtggaaccaaaatcagagaatgttagtgaattccaaatatatcctggtgaggggatttatggtgaaatcgacggagcaggcatatatattgggaacaaaagaattttgtcaagagcttcatgcgaaacaggttggtgaaattaaaaggcttcctaaatgtggtagaacactgttgatagtttacggttagtcactgttgaatttgttgttaaataagaaaaatatcactccaacagtaaataaaattgttctgcctcaggaatattaagtagaactagtaattgtgaatagaggttttgcttcactttcttttgaccaaaacatgatctttgagatatcctgttgaacagtcttgcgtttttgtaactctcatgtttatctttttaattttttttttttgtagttccggacatgaaagatatgaaaggagttaccattggatatgtggcatgtaacaatgaattgattggagtattcactctatcggatgcctgccgaactggatcagctgaggccatcaaggaactgagatcactgggcattaagtcagtgatgcttacaggtgatagtagcgctgctgccacatatgcacagaatcaggtaaaataattttcagtgtgagtggctgtttttactgttgttcggttttgcatattacagcatctaattttgctcttgtttttcttttctggcagctgggaaatatccttgctgaggttcatgctgaacttcttccagaggacaaagtgagaattgttggtgaactcaaggaaaaagatggccctacgctgatggttggtgatggcatgaatgatgccccggcattggctaaagctgatgttggagtctctatgggtgtatctggttcagctgttgcaatggagacaagccacgttgctctgatgtcaaatgacatccgcaggattccaaaggctgtccggctggcaaggaggacgcatcggacaatcatcgtgaacatcatattctcggtgattacgaagcttgcaatcgttgggcttgcatttgccggacatccacttatctgggcagccgtccttgcagatgttggcacatgcttgctggtgatcatgtacagcatgctgttgctgagagagaaggacagtcgaaaggcgaagaaatgtgctgcttctcatcacggatctccaaagaagtgctgttcttcttctcatcatggatctcatgcaaagaaaaatcatggcgtttcccaccattgttcggatggtccgtgcaaatcaatggtcagttgcaaagaatcatcagttgcaaagaatgcttgtcatgatcaccaccatgagcataaccatcacgaagagccagcccacaagcattcttcgaaccagcatggttgccatgatcacagccatggccatagcaactgcaaagagccaagcaaccagctgattacaaacaagcatgcttgccatgatggtcataaccactgcgcagatacgagcaatctgcacgacaccaagaagcatgactgccatggccatgagcatagcacctgcaaagaagaactcaacgctttgcctcccaccaatgaccatgcttgccatggccatgaacatagccactgtgaagaacccgttgctctgcactctaccggcgaacatgcttgccatgagcatgagcatgagcatatccactgtgacgagccaatcggctcgcattgcgctgataagcatgcttgccatgaccatgaacaggttcatgagcatcattgctgtgatgaacagcaaactccgcacaccgcagatttgcacccctgccatgaccatgaccatgacaacctggaggtcgaggaagtaaaggactgccatgctgaaccacctcaccaccacaaccattgctgccatgaacctcatgatcaggtcaagaatgatactcatccagtccaggagcactcgatctcgatcgaagaatcatcagaccaccatgagcatcaccacaacgaagaacacaaagccgaagattgcggacatcatccgaagccgaaagattgtgctccacctccaactgactgcatcagcagaaactgttgcagcaataccagcaaaggtaaagacatttgctcgagcttgcacagggatcatcataccagccaggccagccggtgctgcaggagctatgtgaaatgctccaggcccagcaggagttgctgcagccacagcatagtgaagctgcctgagatcgtagtggagtagtaggaaattcagcaatgtctgcacatatcatcagaaaatatagcaacctcgtcatcggcgaaatgtagaaaaagccgatgctgctatgcgtttgatctttttttttttagtcgtgctgcttttgcttcagctaaagaaaaaaatgttgtttgtagaggtgtctggttttgagacgaagcaggtgtttgaatcatgaaatgtataagcctgctttgtggttttctttcccggttgtgatcgaggcatcatctcctgtaagaatctgagaaggtgcatgaaatctgccatttctgggagcgggaggactagctggtgctgggattaacttgcttccaaaaactctttagattttgaaacatttgaccaacaattagtcaaatataaattaaattctattcgatgaaaacaatgttatttgattgcctcttgaatttgctctcctatgactatatgattttgttactacaaaccttgtaccgtgtaaaattaatagttaaacattagttttgaaaaccgtgcaaagattcagggttttttagtttcacaaatatgaggaattgctggttttatttaagaaaagtttaaggttaatttgagattactacttgagtttactcgatctagaaatatcacaagatcacatctagtgaaacaactatcgacaagtagtattctaaaattctttatatttgtagacagatactctaatggaaatggttgagtttttttcagcggaatcgaatcaacgaagcaatataatggttcgttccctacaaactattctatataaaagttcttcaaaaaatcaaataaactcatttttttaaatttatattagttagtatataattaatcgtgcattaataagctttcttgttttgtgtgggactgaaaaccttatcctacttggccaaaggaatgcaccctagtccaacatctatgctagcgttggtctgcatttttgataatggaaaccaatctagcatatatatatctaaatgtgggggtagggggggggagtgggggtatgggtgtgtttcacgctaaaattggaagttgggttgaaattggaacgatgtgacgaaaaagttaaaagtttgtgtgtagaaaagttttgatgtgatgaaaaaattggaagttttgatgtgatggaaaagttagaagtttaaagaaaaggtttggaactaaactcggcctatgttttggaagaaatggtgatctttgatggatccgatcatcggattagaggaggaagatagatccagccaccataatagagaaagaaagtggatccagtcattggagcaaaggaagaaggtggatagtaacattgttgcacttctggtgtatttgagtgtttcatcctcttttgactttttgattagatattgcatacgacgagcgatgtattttatttgatacatataaatgttttgatgttgcaagtagctgttttttttttccaatgttgcatctatttgaagcattgtccactaagtgatgaaacatttttcattgagtaatgatacatttataataattttactaaaacattatttcatcgagtgatgaaacattcgtaaatatcttttatatacggtgtaacatcatttaaagatttgccatgacgtgtttgatctctattcaaattttgaactctagacaagtgaagggagagtatttaatactctattataaaatataaatatttttagcatagtgacgactgacgagtcaaacatttttaagtttaactattaatagaaaaaaaagattaatcatgtaaaattgatattactagatttatcattaaataaactatcatgatatgtaactctttgtatttacaacatcttagttttatatatattcttagttaaataacatctcagagatcgtgtcggagtttaaaaatacttatattttgagacgcctcggtctcattaaaaaaccaacacagtaatagacacatcatagtactataaatctggacatacctctgttcagattcgctgtaatataatatgtcacatccggacctggatttatcttttttttttgagacggagggatcctctggcatgtgagcataataaatgtgtgacctactccctccgtccaaaaaaaaagacaaaccctaggttttcgtgccaacgtttgactgaccgtcttatatgaaatttttttataatttatattttcattattattagatgataaaacatgattaatacttcatgcgtgacttatctttttaatttttttcataattttttcaaataagacggacggtcaaacgttggacacggaaaccagggtttgtcttttttttttttgggacggagggagtacgtagcaaccacttaagatcaggaacacaatagtgcagaggatgtgttttcttgcccagtactaaatcaacataatcctagtatgatataacaacagaagtacaaccagctgagacgagcagttcaatttataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccgccagcctgcagtgcacagtgttttttttaaaaaaaaaaacaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgttcatatcatcacaggatacaatgatacatgctgcctcgttaaaaactttgtcatgtaaaaactcataggggaaaatgagagaaccatgacaaagaatagagtacag

SEQ ID NO: 41150 - DNA, 2366 bp, Oryza sativa
aaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaacgcacaggatatgttatcttgtggtcattccaccacccgaggacgttgaaatcttgtgcttcgtggtggatggcgtcgctgtccaaacaaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgtctactcacagctttaaacctagggttatgagattgctgaatgtaatgttcaaaagcaggggactccccaaagttcaggggtaaatcttgtctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaacggaggttctcgatctcttcgagccggtgtgtgtcgaaacacttccgctcgcggttccggaaaatccttccgaagctatcgccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaactctgcgatcaaactgttgaactacgaaactaattttgatttttgacaaaatttgagcaaa

SEQ ID NO: 41151 - DNA, 3997 bp, Oryza sativa
  unsure (1)..(3997): unsure at all n locations
tagatctcgccaagaactcggtaatcccaagccctgggtgagtgagatccagcttcgcaagaaggtgataagagtgattctgctcttgctacgcttgtcagttaaaggccccttttttttgggtttttgggtggtttctgcttgatgcggagatgggaaaggagggatttttagggcctctctcctgtgattcttgcctgcgttggtgtgattatgggtgttgtgtgtttgtgttcttgcgaggatttgtgatttgggagtgttgctaatattgtggagttgggggttttttggtgaggcaagaagggggaaggaacagttttttgttctgttcttgaaattattttctatctttttcttcggttagtgtttctttcaagtagttttagccctttgcttgcgcggaagcacgggaatttactgatttttcagtgaatgcttggaatctttaagtggttttgagaggtttcttgctataaaatacatgtgaacaggaaaaatgtgagatgttaggtttgctttttgttcagattggatagctcgaactagttcggttggtggtaattggtgaggttttaggggtttaagggggttgctttctcatgtgcaaaggggaatgtgggataatcatctgaaacacgcaggcagcgtgcataccttaaaatgcaagttacacatgttttataaaccagcaagaaacaaaagcaaagttgtttgttatatgtgctacatagtgtaagctataggctcaagatttcgtcttactgtggcttaatctgtgggctgaagatctgcaactcttcttgcagagttttctgtgcaatgatcaaaccctagattaatcctttgctttgtctgctagaacattagtcaatggtcaatgacagttttaggcatacattttcttccttttcacctaaggaataaggtctgctctcgaaaacaaaggagttgcatcttattcatctgagtcaccacaacttctgtaaaagaaccttgttccattatcgagcatatgcccataactttcatagaaagaaacacgagaattatagacaaatgctgagttgacatcatttttaggattaaagctgtttcataatctatacatttcccttatcattcggtccatattgttaaccagaatatgaaaaatgctgattgaaatcattaagctgcaattctcattccccatgtttttcaggttttgggggttcttgggcagttctgccaggagagtgacactggatgattgcataaatgaagcttgctgaatgtagattgtgaagttctcctttcctgcgtacggccatatacacttttatcatggcaccgcgcaacaggtcttcagctagaaggcctctctggattgtcatcttgattgcttttgtctgtgcagtaggcattggagcctatctttatacaccccagcattacacaccttgttacttggtgtcatcaaattcctgtagttctcggcctcctccagaacctgctagggtttacactgatgatgagattgctgctcgtattgtcataagagatatcattttggcacagccagttcagtcaaagaatccaaaaattgctttcatgttcttgacacccagttcattgccattcgagaagctttgggaaaagttcttcatggtatgatatttacgctattgtaataaagatcttaattgcactttttactcattgatgattaatcttgcattatgtaataattataagtagcactaatttcttcttatcaggaatgcatgttattgatttttgttcacgttttattttctggaagagcttcatgccaatctcatgaaagttataagatatgctcacttgctgaggtgcacgtggatggtactgaatccagatacttgggtgtactttcaggggcatgaagacagatataccatatatgtacatgcatcaagagaaaggcctgttcacgctagtccgatatttaatggcagagatattcgaagtgaaaaggtaatttgctagatttgatttagaggtgacctcatttttgcaacaatacgttttctcactttctctagtacattttgccccccaaaatagttggtgtcttgcctaatcgctgataggtacagaatcatagtcagatccttggttaaacattccttttgaatatttttcctagacaacggcagtgatttctgttctagtttgaaaccaaatttaattgtaacttccatttagattctacaaaaatcttcataaaacaacatataatagcaagtaggttttaaacagtaccaaaagagcgtatgccctaaggagcactaagctcccgttatccactggaaaaactggttcccaacaataacaacagaaacttttcttgtaggtagtctggggcacaatttcaatgattgatgcagagaggaggcttttggctaatgcactgcaagatcctgataaccagcattttgtcttgctctctgagaggttaatcattttcttttgttcttatccttaatcatatcttagatccataccctaatactttgttctcattacagctgtgtaccacttcataactttgattatgtatatagctatcttatggaaacaaatatcagctttgttgactggtaagtggacgcctttaaaccctgaatgttattacatgtgtagacacacttaaagttgaacagatgtttgattcaggatctccagtgcccctttcattcatgattgctaacagacattatagtttctccactgacacgccaactgctttttcttcagttttgacgatcctggtccacatggagcaggcagatattctgatcatatgctacctgaaattgttaagagagattggagaaaaggtgcacaggtatactttaatatgcataatttttctagaaagtattgcaaactgttgctttgccttttcattttcttcccttttacaaatgtttagagcgggtgctgtggaacttcaataatcctgggtattatactctaaagaattgctatattgtcatacagtctaacctcacacattctgatatgttttcctcttgcagtggttcacagtgaaacgtcagcatgcagttcttattctttccgatttcctttactatgcaaagttcaagcggtactgtaaggtaaaattgcattcaaatgggtaaagtgaatttaaaaggtgtattggtagaagtgtaagccattagataatattattacagacagcatcgtattggtttagtactagcacagtgaatgcattatggaaatctccatgctatttcattgcagttgtaacttgtactaggctacttgctctgtccttgtgatttttcctcagtgaatgcacatagaaagccccactttgtattttctgcacaccatgcagcattatatggtctagcactggtaaaccataacgagtgcaaatccccttactgcatttgttacacagtagttttgagttttgacttgtactactattgtttttaatcaattccgatgaccaatgaaatgctttggttcatttctctacatctttatgaccactgaattgctgttgtttcctgaattttagctctttactgatcttgtgattgcacttttgcagccgggaaacgaatggcataactgctattctgatgaacactatttgccaaccctctttaatgtaagaactctcaaaaactcttaaatgatgtttttcagttgtgtttacttcccagtgatttcaggccgttattgtacctgcagatggttgatccaactggaattgcaaattggtcagtgacacatgttgattggtctgaaggaaaatggcatcctaaagcttacagggctgttgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41152 - DNA, 14496 bp, Oryza sativa
  unsure (1)..(14496): unsure at all n locations
gtgacactatagaatactcaagcttgcnnnnntctcctcccacttcggcagcgcgatgctatagtcgcctgaccccaagtagtgatggtacttcttcttggcggcattttctttgtttctttccatcatcgcctgcccttgttgacctgtcttttatgcaacgaactcgtcccagtgatcccttagctttgggaatgtgtcaaagttcagtgtctgccccttcaggatatatttgtggtacaaatctcccttgaagctctgaaactgttctgccattttctttaaagtccaccttttcactttgttctctgtacccgcggaaaaggtgaatatctcgagcattgtggtccacagcatctctttctctgaatctgggacaaagctctcattatctccgcgtgcccttgttctgcgccagtactgacaggcacgttatcccacacaacccaaccgttgtgtcgaacgtagttcttggctgcttctgccggggcactaggtcggccgtcttcgtccacttccgttatgatgtgccaaccctctagcttcttcgcggcacctcgttgcccgcgtgccctcttctgtccagcggagggttgacttccactagcctcctcctccccgttcccctcctggttcccctccgcatccctctccacgttcccttcctcgttcaagttctggtttggatcctcgttcccctcttcttcgttccagtactggctgcttccctccgcgattgtatcgtacagtatctgttcctcatcacgatcagccatctgttcatagaagaaatagttatatatgctaagtctaattgtcgtatattagaaccctagacaatcatatatcctaagtctaattacaaatctaataatcttatattaaaactcaaataatcgtgtattaaaactctaataatcttatattaaaactcaaaaagtcatatatgctaagtctaactgtcgtatattagaaccctagacaatcatatatgctaagtctaattacaaatctaataatcttatattaaaactcaaataatcttgtattaaaactctaataatctcatattaaaactcaaatagtcatatatgctaagtctaattacaaatctaataatcttatattaaaactcaaataatcttgtattaaaactctaatagtcaactatgctaagtctaagtgtcgtatattaggaccctaggtaatcatatatgctaagtcgtctaagtgtcgtacattacaactctagataatcatatatgctaagtctaagtgtcgtatattaaatctaatagtcttaattgcattaaaaatctaacaatcatatatttaattacatcacttgcctgcgcgaattccttcgagagctaactaccactccggcttgagggacgacaacgacaacgtcttttctgcaacatatatgtcacagcctgaattttcgttttaggatttataaattatctaataaattattaatagaatttatattaaatgttctttaatttacaagtgaagttaaatgtgggatataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattatgttaagtgcttttcttgtttaaaaatccttaatttataaattgttgtctaaaaggaattattagaaattatcttaaaagcctagaagagaagatcgaatttttttttaatttgttaaatctcaatataaaagtgggctagaaaaaaaaatcattaaatactttacttgattctatagttcctagatttttctgggatttatttgagccaaggaagtatttttaatcaatagaatatcatttcatgaataattttaatagaaaaaggttttaaaatctttcttttggttttgggccgaaagtcagcccaagtctctctttctccctctcctcggactgcttgcatctggcccagccggcccagtccaccgcgcccctccctcctctctctcagccgctgacaggcgggacctacctgtcggggtcgtcgtcctcctcgagctgcccggccgcgcccgagccaccgccgctgcccttccaaattccgtcgcccctctctttttccggtcaaattgattgagggcaaatgatccttgagatctcctcttccttttctcttttggaaacatcggctaattttctttggaaaccggtggatttgagttggattcggattcatctctctcctctaaccctagactttccttctcgccgccggtcgccgtgggcctccgttgccgcctcctagccactataaaagcatccccgggacctcctctatccgccgccacctttgccttagcccgccgtcgcgtctagcgccgcctccgcgtagccctagctgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccactgtagcacgccggagcaccgccgtcaccgtcgacccaaagaccgccgctgcttcaacctcgttgccgtcgtcatccgtcgtcgtttgtcgtcgtccaagatctcggtgagttcgccgcgtcgccctctacccgttggtgtcctctgtttgcgtcgtcgcgccatcgttcaccggcgagcatgcgttgccaagctgccgccggtgatgacgtcatcgctgacgtcatcgtcgctgtccccgtagacccgctgtggaccgttttgatctcggccgcccgttttggatagaatcgatctcgggcgttcgtttccttagaccgtcctgtgcacccggtttaccgtggaccgcctttgatgacgcaataatcctcattttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagttagaatgaggccgttcaagtctcataattcatctaaaattatgatctacatgtttttttactttatatgtattgtttatttggtttttattagtctttttctttgttttgcatgttagcttgtcgtttccgtcgttgcgaaggttcgtgagtgcgtcgggagtgttcagaagattaattgaacaccgattattgcaaggcaagtcacacagatcctaaacacaatcctttgagcatgttgatcctatgtttaaattctctatttatttcaactgtgcatttattttcgaatgtcactgggtggtgtgaatctattcctttgttatggcctgtttgcattgattactctattccttgataccttgggatattataatttgactagttgagctttatatatattggttccactagatgttagatataattgcttagccatgtttagaaacattagctcactaatgggatgaaccatatatattacattattatttatagttatatttaatggtagctcacgatggttaatcgtgttatgataattaattggtaattaaaatatgattaatggtgggttgtgagcacatggttttgaaggtcgtgctcatggcaattaaggaccagttcgcgagctactgttgtgaaacattaaccgtgccaaccacaagccagcgtgggcaacggctttacattttgtatagcatggttcattgcggagcaccagactgagaagtggcggagataagcccacgggggtcgctggggagtccatgccttgtttataagggggtgattatgatccaggaacggtgcactgctttgagttgtgttgtgcgaggggtactgtcacagctcctttccgaggtaccgtggtggtattgaggcgcatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagcttctggtttggagttagatctgtacagccgggtatggttgttcaggatggttgggcctgtgcagcatgggtgtgctgttcagtgttgattaaaatttctgattaattactctactgttttactactcttaactctatgctaaatgctgcgctctatgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccctagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggactaggattttatgcacaaattagttcggaaattattagtgaatttccgggcgtgacaatataaaaaaatgtattaggataaacacaaagtaacatatattgtatttcacattcgcgttctcgttaagttcacgtttcgttcacgatcgttcacgtaatcgttcgcgttctcgttaacgtacgctaagttcatgtgcctatcacgtacgttcgttcgttcacattaacgtacgttcgttcgttcacgttaacgtacgttatgttcacgttcacgttcacgttcacgttcgttcacgttaagttcatgttcacgttaatttcacgttcgttcacgttcacgttcacgttaagttcacgttcgttcacgttcgtgttcacgttcacgtacgttcgttcgatttctcattcacgtacgtttcgttcgttcacgtacgttcgttcgttcactttcacgttcacatatgttcattcgatcacgttcacgtacgtttcgttcattcacgatcgatcgttcgttcacgtggcggcagcggagcggcggcgtggcggggcggctgcggcttggcgcggcggcggcgtggcagcgcggcggtggcatgccgcggcggcgtcggggcatcgcggcggcgtagtgtggcccggcgtcgtcggcactgctggcgcgatgtcgtcgccggtggcggccgcatcgaggtcggggtcggcatcgtcgagaagcagagtcgtgttcggccacgacgatgtcgacggcggcgtcggcaacgaggaggccggcggcggtttggggagagagagagagagatcgcgaggtcgtcgagagagagagagggaggcggcggcggctctcaccccagagatgcggcggcagcggaggcggtggaggcggcgacgacgacgcccgcgagacgacggcgagatacgacggcggcgttggcgcggggatgccctaggcagtggcggcgaaggagaagccgagagagatcgatcggggaaaaaacttctaagtgttggtggagaagacgagaatgcgcatcgggaatatatatacccctagatctttagtcccggttcgtaagaacaaccgggactaaagatattttcccgctatttccaaattctttttaaacccggttagggttaagaaccgggaccactgataaacgcaatgaatattgattttcattacatatgtgtttctaaaatagaaaataatacattaaaattttttaaagtcgaaaaattaatgacaattactttgaaaaattattgttgtctgtagtaaattaagtggataaaacgtaataatcaaatatatgatttaaaattaataaaaattctaataatcatatataattagcatatgcatgatattaaattgttaaaaattaaactttaacatatgtacgtaccacatgcatgattcaaaattaataaaaattctaataatcatatataattagcatatgcatgatattaaattgttaaaaattaaactttaacatatgtacataccacatgcatgatttaaaattaataaaaattctaataatcatatataattagcatatgcatgatattaaattgttaaaaattaaactttaacatatgtacataccacatgcatgatttaaaattaataaaaattctaataatcatatataattagcatatgcatgatattaattgttaaaaactctaattaacatatgtaaatgtcacatgcatgatttaaaacttttaaaaattctaattatctcatataactggcatatgcatgatttaaaattgttaaaaattctaataatcgtacgtaattaacatatgccatgcaataattgatttatatggataatcaatacattcaaaatagtttacattgtgtacacaataattacggcaatacatcggcggtgacggttgaccgcacgtactttctcctcactattgttccctccttgtgatcgctacgtgagtaaggggtgtttcatttgataggaggatgctagggtcaatcgtcaccgtgacgcttcggctcgtcaggccctctgcccattcaactgatcataatcctcatcagtcttgtcctcaactccgacgatttttcttttgcctgggagaaccacgtgacgcttcggctcgtcaggccctctgcccttctttcctttgctagacatgtccttcacgtataagacttgcgttacatcattggcaaggacaaaaggtttgtccgagtatccaacattgttaaggtcaaccgttgtcatcccactgtcattaatcgttgcgcctccaccagtcaacctaacccattggcaccggaacagagggaccttgagaggaccatagtcaagttcccatatgtcctcgatggaaccgtaagacgtgccagttgttcgatcgtgtcccatggcatcgatacgaatagcgttgttttggttcgtgctcttcatgtcttgggctctcgtgtagaatgtgtatccattgatctcatatccctggactgtcgcgatcgagccagatggtcccctcaccaggaaggccagttgttggttgatcgtctcgttaccaatgagatgttgccgtagccatgcggggaaagtatcaatgtgatgccgtgtaatccatgcatctgacttaccgatgtttctggcacgaactagagccaagtgctcctcgatgtaaggagctaccaatgaagattgttgcagaaccgtgaaatgggctttacggaataaattgttgtctaccatcattattgctttccttccgagagttccctttccccgtagtctcccttcatggcgtgattcaggtaccccgattgggcgaaggtcttcaataaattctacacaaaattcgatgacctcctctgttccatacaccttggtgatgcttgcctctagacgagcacggttacgaacatacttcttcagaacgcccatgtacctctcgaaaggaagcatgttgtgtaggtacacaggcctgagaatactgatctctttgacaaggtaacaaagcagatgcgtcactatattgaaaaatgaaggtggaaatatcaactcaaaactgacaagacatttcaccacatcattctaaagggcttctaatctatccggatcgatgaccttctgcgaaattgcgttcatgaaagcatatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccaggtgaaggtcgccgcgttgttccatatgcttcagatcattacgtgcttccagtgtatctttcgactttccatatacacctaggaagccaagaaggtttacgcaaaggtacttagtgaggtgcatcacgttgattgcgtggcggacgtccaagaattcccaatagggtaactcccaaaatatagagttctttttccacatcgccgcgtaaccatcttcgctctctataggctggcttccaggccctttccgaacactactttaagatctttaaccatagcaaacactgttttcccgctgcgatgtttaggcttcgtacggtggtccgccttatgttcatagtgcttgcctttcttctgtaccgagtggtttgtagcatggaatcgacgatgacccatgtacacaaccttcctatagtgcttaaaatacgtactttctatttcatccatacagtgagtacaagccttgtacaccttgttggactgaccggaaaggttgctaactgcaggccaatcgttgatggttacgaacagcagcgctcgtaggttaaactcctcctgtttatcctcgtcccacatggggacaccttcctttttccacaacagtttaagatcttcgaccagtggtcttaggtacacatcgatgtcattaccaggttgcttggggccttgaataataatcggcatcattatgtacttcctcttcatgcatagccaaggggggagattgtagatacatatcgtaatgggccaagtgctatggccgctgctcatctctccaaaaagattcatgccatccgtacttaaaccaaaccatatgtttcgtgcgtcctttccaaagtctttaaatttcctgtcgatgtttcgccactgcgaaccatcggcggggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagctgcccgtcaacttctcctggatcgtctcgtctaatcttgtatcgtagtgctttgcaaacagggcatgcttctaggttctcgtactactcaccgcgatataggatacaatcattcggacatgcgtgaatcttctgaacttccagtcctagagggcagactatcttcttagcctcatatgttgtctcgggcaatttgtttccctccggaagaatgttcttgacgagtctcaattaatcgccaaatgtcttgtcactaacaccattttttgccttccattgcaagaactccagagtggtatccaactttttgtgcccctgctcgcaacctggatataatgacattctgtggtcctctaacatcttgtccaatttatgggcccccttttcactttcacagtcctccttggcgtcttgcaacatctgaacaagatcatccggaacgtcgttaccatcagcatccctttcctcctcgcccgtttgatttccttcaaatccagcgtactgagcaaagtccggaatattgtcatcttccacttcatcttcttccatttcaaccccttgctctccgtgggatgtccaacagttatagcttggcatgaagcccgactcaaacaagtggaaatgaatagtcctggatgcagaatactccttctgattcttacacttatttcatggacaacaaataaaacccttatgcctgttagcttcggccactctcaaaaaataatgcacgccgtcaataaactctttggaccgtcggtcagcgtacatccattgccgatccatctacatgagataaaaaaaatcgaacacaaataattattcgtacaataatgacagtcataagataatacaaactctttcaacagtcatacaataatgacatatcattaatatcattattcatacaaaaattataaaatattacaccaaataattcttatttactatttctaaagttttaaactaatattaatgtgttgtacttcttttaattttcattttagtttgttttctattatttaatattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatgtaatatgacaaaaaaacattggaggatgaagttgctaaccttgtaggcacctccgatttgtatataatcaccaaaataaattcactagaaattttggcatgacctcccctcttttttgaagaaattttgaagcttgctcgggcagctggaggaggaagaagacatatatatatatatatatatatatatatatatatatatatatatataggggtgtgactttagtcccagttggtgttatgaaccgggactaaagatcccggggggcctgacaagccctgacagcatttgaaccaggactaaagatctttagtcccggttggtattaccaaccaggactaaagatcaaatatacccgttacccttccaggtttttattgcaatcgggactactgtggaattcggccgaccgacgaaagatggtttctccaccagtgtagcccatacatccacaagcattgtacatatttcaagaatacatttcaaatatcccaaggttacattcgttcagttatgcttttcaaatgctcaccaccttttcaattatgagaaggctaaatttgtttttcaaaaataatctttgctatatagttagttttagaattctttttacccatgtttaatgagtaatccaacaactatctcactgaccatatcaatgtttaaaatgacacactggaggatctatatgacgatgattttgcatatttatgtccttccatccataccttaaggaagaaccgaattttttttcaagtgtaacaaaatcatgtgatttgcggccgtgtgtattcaaaattttcccgaaatgcaattttagaagacacactctaatttcgtttaggctgcattcctagttacgttcattttgagtagattgggagaaaaattactcgtttttcacgcgcacactttctctctcctaaacgatggtttattgcaaaaagattttactttaaaagtgcatattaatatatttgtaaatctaaaataattaacactcaattaatcacaacctaactataactcttctcgttttacgtgtcatcccaatctttttcattttccccttccaaactccacctttacccacactgcaaaggtgcaaacgattttgaacatatatatatatatatatatatatatatatatatatatatatatatatatatatatctaatttgtatacaaattagatgagtttgatcacgtgaatatatattaaaatctctacttaaatctttatttttaccacttgttagatctcacttagaaataagtatcaacataataatagttattatagtatggtatcacttgttatggtatcactcttatccttatcatctccttcctactggcgagagcagatcgaggagcgagagcgagcgagcgaggctggcggagggcctgcgcgcaccggagccgggagggcaggcggccgggcggcgggcgacggcatggccgtgcgcagccacgcgcgatgggcggcggctggtggtgggcagcggccggcggaggacggcgaccggcagtgtggccgcgctgcaggcggcaacctgcgcctctaccggaggggaggcggcagcggcatggatttttttttaagaattttttattcattgcatggatctgagatgtatttgatatgtatgcgatgtgaatacatgatgtatttgtgatgattttttagaaattgtgatataatttttttagaatttgtgatgtatttggagatgatccatttgagaatttggaaatatatccttttgttctgtgatatgtaatgatcgatttagagatgatttgaggatggagtgaaatcaatatttaatgttaaaaacaataaaaaatagcaaccagacctagcctgactctatctttatttttaatctcgattatttcacccaagactaaagatggatatctttagtctcggattcgtggctctggttgcataaccgaaactataagggaggtaccaaccgggactgatgcccctttctccagcagtgtacagaagaaacccacaacctttccacccgacgagtgatagttttgcccgttaagagacatgtaaggataaaaattgaattatacattgctcctaattaataaagtaaatactcgtcaggttccgggtttcaggccccattgtcatctctaggttggtctatcctactaagagcaagtataatagtaggctataagccggctaaatgctgaggtggaggagaaaagagaggagagagaggagaaacgggctgtaaacttacagccggcttggacacaagaaccaagaaaatctgtgaaagggacaagtgggccctatattaattgtaaagagctaactattatatgggtaggctaagagaaggctgcaaagaaccttatagccaacaggtcagctgtattattagccttgctctaacatgctaatacgtgtggggggagggctgtgggcattgggcattgagcatatcacacaccaaaggagtacttttttttttgagaaccaccaaaggagtacttggggtgggtgcagaggcatgacataggtgcattcatacagagtttggattggtttgcgtggagatgaatcgaggatgggagagattgtaacttcagaccgcgcatatggtgcacgacatttgttcgcatcacgaacaagtgatgttttgaatagggtgaatagtcaaagtggtcctccaagtttcatctgaggctcagtttagttcttgatgtttcaatctatccatattagtccttcaagttttcattttagttcaaacttatccttgaaccaataactctcttcataaatgacacttatacccctcatcattcacatatataagagaaaaattgcatgtttgaattttttatagataatacatagtatattatgtaaaacaaaaaaaaattatgtactaacaagtgtatacgatagcaattgcttaagtttcatgtgcacatgttgaaataatgggaagtacatctgtaatgttgtttattcatgttggctttctcttttctagtatatagatgtatacaaattaagggcaaacaagacattttctaatagaagtattgactagaaatagccatatggcatattaagtggacccaatgatggtttcaagccaaaacaaatatttgaaggacctatgtggacaaaatgaaatatgaaggaccaaattgagccttcgccgaaacttgagggactaaattagctattcactcttttgaatacgtgcagtttgcaatgatattttttttatatttctaattcaacttttaaaaatgggaagactatagatttgtcttcaaaatagtttcaaagtgttataatttgcttgtatgttttcttaggttttatactaatattactaattaataatatccaggtgaccatgtcaatgtttaaagggttaaaacgccacctatatatatatgtcatgacaaaaatatatgatggtggtttgtcatatttatgtgcttccatgtggccatgtattatgtatattcgaaaatttcccaaaatacaatttaacaaggccgatgcagcattctgaattaggaatcttgatgcagcacattataatgttttggtgaaaattgagcatccttttaattgcacaggtacaatgatgtctccagatatcgctgagatatttgtgaaagacatgatgttggctagatacatgcatgtaccaatatatgccaacaatgtgatttgaagaaaaaaaatacaaaataaaagttatcatcaagatagactgatacatgtaacaaaggtgcataactaggcgtgacccatgctatgtagatatggtatatctagatggacccaacctgctaacatgcgtgggagcataggcctatagatgccccttgagcatcacggataaaaggagccgagcaagagtgccccatgttgcaagagttgtgcgtgaggtgggcacggaggcatgatatagaggtgtaagtggctaacccgcgaaacccacttataagctaaaatacgccgcgagcccgcttattagcctataagtgggttctgatgagctactgt

SEQ ID NO: 41153 - DNA, 7417 bp, Oryza sativa
tacagtagctcatcaagggtaaatttgtttttcaaaaataatctttgctatgtagttttagaattcttttcaccaacactatattggtaatccaacaaactatctcgctgaccgtatcaatgtttaaagggaaaattggaaccatgccattataattttgtaaaatttgagatatgccatcctgacccacatgtcattgactcatgtgggttctacatgtcattgagataccgatgacatatctcaaactttgtaaaattataatggcatggttccaaattagccttgtttaaaatgacacattggagtaagaagcacttctcgaccagcatatatgatgatgattttgtatatttatgttcttccatccataccttaagaaacaacggtatttttttctagtgtaataaaatgtggccgtctgtactcaaaattttcccaaaatgaaattttaaaaggcacactctaatttcctttaggctgcgtttctagtgtagttcgtttcgagttgaccctgagaaaatttactcaatttttcacgcgcacactttctaaactctcctaaatgattgtgttgtttgcaaaaagattttactttaaaaatttatattctaatacctaattaatcatactctagtaataataattcttatcgatttacgtgtcatcgcaatatttttcactttccccctcccatactccacacctttacccacactagaaacagttttgctagtcccactccaaaaccatattgccctagcgaaacaatcaaacggtccaaacccattgggcccccaccaaccaacccccccttccctccgaccccatgggcaactcccgccgccccgccgccgcggccaccgctccgtcgccgtcgccgccggcgtcggacctggaggtagggttcgccaagcttcagggggaggacttcgagtactacatgcagacctactccatcgtcctcggccgccacagccgcaggaggaaccagcccgtcggcgtcggagtcggcgttggcgtcggcggcggaggcggaggcggaggcgacgccgccgcggacgacgtggacgtcgacctcgggatcctcggcggcgggatgaacgtgtcgcgccgccacgcgcgcatcttctacgacttcccgcgccgccgcttcgcgctcgaggtgctcggcaagaacgggtgcctcgtcgagggcgtcctccacgagcccggcggcgagcccgtcaagctcgactcccaggacctccttcagatgggggacgcccagttctacttcctcctccccacccgctccgtcttcgccaccgacgccgcgcgccgcgcctccgccgccgcccggcgcgctgtcccgccgcctccctcctcctcctccgacggcgatgatggggaggaagaacgcgaagcggcggtggctaagcggccgaggaacggagacgccgggtctctcgctggtcggtatcagaatctcgcgattcttcatttctatcggattattattatttatcgctgttggattgtgcgacctaacattatcttatcaaataccagtagaatttgattttgatatgttacatatcttatcctcatagggctacttgcaagcgtcactcaattccgttataaataagatacaaatacatttggggatacaggggggctgcttgtgtgttactgtggcaattgggtggtttctgggtggaactttgcttcctgtttgatttgattggataatacgaatgactgcttctggtttcaggtgaaaaatgaaaaaggttaatggacacggttttgaatgtgtggtgatgcaaaacaagaaatcagggtgttcgttaagtttttgctaataatctaatttgctatttttttgtgcccacaaattcagtttgctgtgggcattatgtttcttttatgatctttgtaagaacctatttgcttgcctgctgcatattgagtttgcagtttctgatcccgtgccttgtgttgctaatggttctttatgtcttatcaacatttaggacttagaagacgtgagtggtgaaaattagcgacttatgcaagtgatttgttcactaaactgcagtttacatgtcattagaaatttataatatgtatgttgagcaatctaagtttgttggactgtcttttgcttccttcatggatacataaaagtgatatgcaatatgaaagttgcaggggatatttggataatagatttttgtcttattcatgcaaattttggttacttagttatgataatttgcatatgagatcatttgtcaatttttcctcttaccatttctttacaatattggcatgtgtagcttgaatagcatgtctatctataagctatttccatcatgttgcttttgtcacttcatttttctttgaattacgcaacaatcctctcatcagaactcttacattgatacattctttcctattttttgaatagcccattgtgttgattttgccacatttatctgttaaagtttccaggaaaatttggttctatcttatattgatttgtaagttatgttcttacctgagcaattcaaactctatgaaatctgatcttagtaattactgtgacaacctttagacgttcctgtgccttttaatttttatcctaggtttttgaatgcaatctactaaaggaaccacatacagttttctatatttttggtttttaaataatctcaacattgctatttcctttagttttagtatatttgtgaaggaatagttcacaggcttagtgtatcagtcttctgaaagggtggcaattcatctaactaatgcatttggatgggagtggttgaatagtagctaatgttaccaatttggcatcgatgaaagttctatcatcattgtatatagtactacaggacatatgctgatatcctttatatataagttcatattaccctcaaattactttgagcatgttgaaaataattaatctatttgggtattttgtacaggaaggaagtctgagaagggatcaaaaggttacagacaatcagataacctacaactcttgcagttggaagagaaagatgttatctcatcaacagctactgtcttatctgatctctgtggacctcaggaatgggtgcctatggacaggcttcatgaagtggtaactttctcaatcttttcttcattcctcttgacgaaatgatcacatgtctaaacatagcatttggggtttttttttctgtttgttacttaacactgcatgaattgataacaacatgcctgctcctgcattttgtttattcggctcatttatgaaaacgataatacatttttctagcatccttgcaaggtaataaactaaacttacaagataaaaatatgatcattctgtttttaacattctaccagagctaaacaaatggcggaaactggtgctttttcagaagaataaatatttgtaaaatttgtgctctcctgctaccctttcatcctttatccaggaaggccctgtgctatggtctatggcatcaccttacttgtccactgtccatattagcttatttatgttctactggtggcaagttttgaaagggataagtccttattagcccccttatctgtcacgtttgtctaaaagcaaccctaactccaacattgggtattagcgagaaaaaagaaagagggaacggagagaggtggaggaagaagatgaagaaggttgtcaatgacatgtgggccctactgtttgttttagacttattggctgacagtaatgtcacgctagcgtcatgtaggcaaaaatccactctggtgactgagtgtaaagtaaacggtttatggagttacctttcttttgaccttaattgaggctgcctaaatgttcagtgatagtctttctgacctgaattgaggctgccgcagtctttgtatattgcagccaacagttaaggaaaaatacttctcaggctatgctactctcctaagcctggttttcacaatatggctctttcatatatcttttacacatgaatccgggaccacatgtctgtaaggcactaaggcataggcaacattgcctgtcataatgcaactgatgtttcaaattttggggcacaaatttggccattttgtttgtatataattctccctcagttcacaatattggtcaaattatcctatttagagatttatttgtttgttgcactacacgattgccttgactagcatagcatcaatatatatgtatggagtactacttcacaattcttatttttattccagtaatccataagaataaattttgccaagatcgtgttacccaccacatgatgtagcttcttagtagtagtgaccagattgaattgttactcatctagaatcatcccttaaaatgatgggttaccagcaattcttctgatcacaaattaccagtgtaaaatcatttctcactgccttcttaatgacatagctgcataagttgtagaaatatgttccaattggtattttcggtttcagctggttgaacagtgcaggcttttagttttgttttcatctgatgattacagcataaacaatcattttgaaagaaatcgggctctgctagaaactgtatacttggtagttcaagttctttggttcttaaccagtactctcttggtttttagttctttagttgaattttgtttcagggatagtttgtgttcgtcttgcacctgtgctaatgagtttgtcataatgcaatttcctgtaatatgaacatcgtgattatgctgtacaaacttgttagattgttcatatatgctctgtccatttcgttccatcctgacgatcatactccttttttcagatgtttgagaaatatggcgacttgtggcaccacaacagggtgcggaaatatttgacatcagaagactggcccaagagcgaaactgatggtagaccgtggcacgggctctctctgctgctaaggaagtaccctgagcattttgtgataaacataagaatgtcaggggggcggagcattgagtttgtctctctggtttcgctgcaaccctgactagttcgtagtgagtcgcatcctgtgtgggacaagctttggagcgtatgtttcgctgctcttgtaaacagcaaaactgaagttagcaacagggtaggaaagaatcctacaaaggttttgtttttgttttctcggcggttaaattggtagatacatagagtgtagggcaattttacctgtgcattatcagagtgcgaaagtttacctttcatttctctcttttgttgttgttgtgtgtgatctgcctcttggtgtttaatcgctcggtgcctggtacatgctgagctgagatggagggtgttttcctgttccagttggtctctgtgagggtcagagcgcagtgttgcatgtgaagtggtcagcaaatggggcctaatttggcaccgttcacccttgccctgctaaccatgcgctacaatcttttcaaatgtttttggaaatcaattgtagcagtagcatgacggatagattgagacataggaagtggatgtcaaaataattacctaatgtctgcacactgattcaggataagtaaaaactccagcttctcaacaaaaagaagaaaaaaagatttcacatgcctgattttttttttattttgtagtcacataaattccactatagtaagatattttttgcagtgttatgtagtctgctatttcacttaattttactgcaatcttgttttttatatgtatttgaattttgtaaatctttatcaattgaagatttattttaagcataggtttgttgtttgacctttatctaatagaaaaggaattttaattagggaacgggggagtgatgtgacctgatgagagtggctagattggcatccatgttacaatttcttttagtcacataaattccactttactaatctaaggctatctttgggaggtgagattgggtacttcaccttccgcacacgtaaaacggagctacgtattttcttataatcaattaattattccttacacttccattctggttagaatcccgtgtttttcctgtttcttcgttttttattcctgttattaaaagaccctaaaggtacaactttatgtagtctgcaattttagttaattttactgcaattttgttgatgtatatgtatttaattttttataaatctttgtcagttagagatatatttgaagtataggtttgttgtttcaacttttcgtaacaaagaaggaattttaattagggttaggggcgggaaggcacgacaaccgctatgccaaatcctccgggtggatgagatcatccaattttcttaacatcaccacgcaggccagactgcgagtctaacaaaaattattccaacaaaatatcgtacagacgcgggcttaattgttggcaccaggattactcaatcagtggactcacagaacaccaaacgttggtacgatattttcagaatgatgctagaccaaacaatatgttggtcattaattatgtagcaattacgtacgtttatcaatttttcattgaattactggaacaagaagagaagtttagcaatctttaattaattatttaattgtttttttacttatactgtctttatataaaaatcacttttttctatatctacatggttactatttttagtagcaaaattatattttctaccattaatattccggagttgaattttatttatttattatgcaccaaaatagggagtcttttagaatcccaaatttatatttcctattagtttcaatccaaaattatacattatatgttgtacataaatagtgtcctttccaaatttattttgtttataaattaatacggaatgtttttaaatataaatatcaattttaatatgaatggctacatttattcaggaatttatctttctatctgttcgttcactaattttagagcattgagcatacttaaggcaattttaaattcgccttaaattcatcaacataacacagtaaagagtcacaaataacaattgcacaactagcaggaatatatataagcccaaaacatgttaaaaaatggtaaattttatagggaaatttttctggaatacttttgactagtgagcattgaagggggcaatactgctactactagtggctaagcaaatgcaaaatcagttggaaggggcactggcactaggccatgcttaaatgagcagccagctttcacattggtctcttgattattggtgccaacaaaattaattggtggttttcaatgcacacccatctacaacctccaactaccttcccaagttctggttggctggataatgaccagcaaaaattagtaatttacatatgcaagtttttagtaagaatgattcacagggtaacaatactcctactgctaactgtactaggtgttacaggt

SEQ ID NO: 41154 - DNA, 11484 bp, Oryza sativa
tacagtagctcatcaaatggccttttgacgtctcataggatttttttttctttttttacattgaatgtatctaactgattagaccgagaagcgaggttcgagttcaagtttggtttcctccaaactctgggcatgtttagatcccctgacaaatttttactgtctgtcacatcgaatgtttggacatatatatggagtattaaatataaacgaaaaaaaataactaattatatagattgcgtgtaaattgcgagacggatcttttaagcctaattgcaccataatttgacaatgtggtgctaaagtaaacatttgctaatgatggattaattaggcttaataaattcgtctcgcggtttacaggcggattctataatttgttttgttattagactacgtttaatactttaaatatgtgtccgtatatccgatgtgacacgccaaaactttacacccatggatctaaatacagcctaagtttaaaaagaaaataaatagaatctctagtaatttttcatatggattagtcatcttatcatatggatcttgttaattcatactagtatggagtagtcatcttatctaaattaaatagaatctctagtaattttacacccatggatcttgttaattcatatggagtagtcatcttatctaaattaaatagaatcttagtaatttttctatgaatttaaaatcctctgaagtgtataagtaaacaaatattgttcaacatactcaacatacacaaaaaaaacaactattccagaaaaaggggcaatttttgctagagtacacccaaaatatgtgcaatttgttgatagacgtcgaaaaaatatgtcacggctgaagcacgtcctaaaaaactggtaatctgctagagaacactttcggtttaattagattgataaattcttaagaaagaagagaatgctcctaagaccacatgtttcaaacatgatgttcgagtaaaattttagaaagcatgcaactctaattttgccgtcaccccaagtacattactagtataaattatattccatcttcgctccagtttcagcccaaaggcttttgaccctatgggcattcttgtctttttgaaaaatttctctctaattgagccaaaagtgtcatctggaaagttatcagttttttatagtctctcaacaatgacatgtttttacgatatctaccagtaaattacataattttttattgtcctatagcaaaatttgccaaaaaaaatcaagaaacaactaaaactatgaaacataatgagtaattcttttcctttatttttctatatagcttagtggtatctcacttctctttttattttaaggatcacttggaagtatgacaatataggtgaaattttgactcttattattattatcacttcttttgatgtgattattcgtattgttattattgcatcttgcatgcgaatgtcttcagcaaagtttcaaagtttgatggggactctacgctaacgagcacgaatacatactagggccgagtttagtttcaaactttttttttaaaacttacaacttttccatcacatcaaaactttcctacacacataaacttccaatttttccgtcacatcgtttcaatttcaaccgaacttccaattttggcgtgaactaaacacaccctacctctgtttcgcgcgtgcgcgtgggggggtggggggttagttttttctgagcgcattgcttcacaaaaccccatatttcaaacgatgtattttgactggtgacatataacctcatatattatgatcctaaagtaccgctatgcatgttgagtatagatttacttcaaattttaaaatgcagagtgtatataacattttaaattattgagttcttgactaacgttaacaatttaactttttactacttttaaaaatattgttttagatatgctcaaattactcgagatttgaataaatggggggttttataaaatgtttaggccacaacaattatagttatatgccacaagtaaaaatgtgggactttctaaaaattactctgtttgtttacatggataaatacatattagctcggtttggttctttggcacaacattatcataaaatccaaaactaattttgaattttagttctaaagaataatttcaggtatatttttagttgtcttcttatcaatcattaaaagagagatggacaacgaaagtggcaaatgaacctcctaaaatccatccaaaatggaactcataaaatttagaatcagttgcaaacactatcaggcacccactagatagtagaaacacacaaccatcaaagggtaaatacaacactcgtgcctgccctttggtcatgtgacaatatcttcctcaccaaggacaaattgtctcccatgaggagtcatatagctgtaagaaccatgtggcatgggagacttgaatctctagctgcaccaaggacaaaagttgggtttgaattgtactcggcattattgactgtttgaggtgctaaaaaaaaactcattcatatatacatatggaaatatgatgttttttttgcggaatatgtacataactcccgtgaaattaccgtgttccgaatatcgcaagagtgacaaatggttgagggttaaagggttttacatgacaataagatagggtgggacaggcctggagctccagctagactcagatcagatgtggttgtgcaggagctcatgtgcattgcctgatgaccacaagagcacaaatcaatggtcgaggtctcaatttaataccgaactaatttttttggtccatgatgccgcccagtactgttgcagtgtcctgaagaagctggcttagaaatgccatcacagcgtgaaaaaaccatatcctgtagggcacgctctttttggaccatctatccgacccgacgctcaatctgataatcttgctggtattttgtttctctctctctcagtgatttgcgctctgttcaccccctgaggttattttcctataattagttggagttttcgatttttttcagcaaattcgagcattggaaatggctctaaactgcaacagaaacttatgatgtcgatgaccaaatcaccatgctcatttttgtttattcactgaattattggtgcggattatttagtacatgcttcgaaaaatatgatttttgaaagaaaaataatttctactgcattgcttaaaccacttgtggcaagctatttatcagatttataacatataataattaatccatcaacattaatttatcttcgaataatctaaacagaaaatctgcagaaggcaactatggatggtttaggagccaaatgaagtgtggacaagtcctaccctaatatacttattttcctttctatgtctcaatgacattgccatagtggcatggactgtcaacaaagacagcaaacaatataaaaaacatatactaaaatggacagccactaaccacaacatttactttcattgaagacggtagttaatagttattgtgtagtactgcacaggagaattaaagaaggaatgcatccctcaggacagctgattaaaaaatttgatagaaaaggcaaagattagctgatgtgcaatatcaaagtgtaaagtgcaaaccttcaaaatcagataggaggacatatgctaaggcagagcttgaaatgtagtattcaaaaggaatttcagctggattgaaaacgagtcaagccagatgccaatatcatctaatacgaactggcccttaattacttcagtacatctgcttgtcctagtcttatactttataataggaactacttagactaaaacttactcaaatgcatcaatctaaaaagtttcctacacaaaaaacatacttctacaagaactgatcagagctaacttttgttttttttttttttgaaaccttgcacacaaattcatcagattcttctccaacagtcagagtcagaataatattcagttaattgtgctaatagaatcaggtggacatcacatcaacaaggcattagaactgcaaaccaaaaactgtgcaacagaatgaatgctagattgcatcaattaaaagcataacaagaaaggaaacagaacttgacattgtagatgatattatgattgataagagtcgtgctgcatgtaccctgtatctatcgctgccgcattccacgcatcaccacatattaaacatcagttgtacacatgctagattcaatcacaacaaaaccaaatcaggaaaacaatttttttctctggtactgaacagaaatccaccaagtcacccattgtctctgagaagaaccatactagctctgcaatatgaatttgaagacagtaaactaaagcggtatatattacacgaccactaggaagaatatgcgtaacaatacagaacaaattcaattttgtttcaaatataccaagatactaattaattatatccacaattcaataggcaccacattaaccagtcaccccccaaaatggggaaaaaaaaactaaccaaaaaacatccatccatccatccatcacaaagctactcatagctaccaatatttccactcactacaactactaactatatgatccaagtgttcttccaatcccaaacaaatttcttcttagcatttctcgatttggcaccaaccaaagaaaaatcaaaaagagaaaaaaaaacaaagagattaaaagcagcattaagcattactgttttttttcttttacttggggtttcttgcctgattttcttggctgatgtgctgtgctgcatatctgctagaggtggcagttgaggcagttgcaggttcgcggggtgaaggagcagacgccgaaggggcggttcgggatgttgcagttgatggcgtagcagcagggcgccgggatgcacaccccgtgcgggcccccgcagcaggtgcacaccgcgcatatctggaacctccccaccagcctccgccgccgcggcaccatcccggcggcgccgccctccacgtacgtcttcctcagcctcggcctccacccctcccccgccgccgccgtatcatttccctacgaaaccgaacacgaacacggtcagtacagttcttggtttcttgaaatgcaaagagagagagagagtggagatgggagtggtacttggggttggtgttgggcgagagcttgcgccgcgaggaaggcggcggcgacggcggcgaggagggagacgaggaggaggagtggaggtgaggaggaggatgccatcctgtggtggctgggtggcagagggagccagaggaggagaggagggggggttttgtgggactcccacagtgggagtgtgctgaagagaagagagggtgcaattatgttgtacaggaggattatttatgggagggtatgaacaatctaatattgcattttcttttttagaggtttagaaatgtaaaatctgtttattgtgcggattgaagcttgagctgcaatcaatcattcaattgtgtggatattctagggttttttttttcttttgtggcattgattgggatccaaaaggttggtgctggggttgtgagatcttgcgacgtagattccatttttttattgggatacatattttatcttgattttttagcataattaattttcactattttgtacgaaaattttatattattctattttttaagtttgaaataattaaagcttatttaatcatgtattaatggctttctcgttttacgtgtctgtatttaatctttatcttttttctgcaagatttattgatacacgtttggacgatatacaagaatttataaacattgagtgtcaatttatctttcgtgaaaaatacatttatattgtacacggtaaaatcaggcatatacaatagtcttgaactccaatatcataacttaataatttatagaatttctgaatatatctcaatcaatattggcggcacaagtcgcaaaatttgtgactccataaaacttcacatttccataatagatttcacctagtgttgagaataatactcactccgtctcaaaatatagcaacttttctagtttaaactttgtccaaatattagcaacctagtattggtaaaatgagactattagcactaaactacttatataagtttactaccacttgattttattgtagccccaattagtccagacctatgccttatatatttcgaagaggtaactgagaatgtgtcgaatgaaaacttagtgtattttaggtctggtttagttccccaaattttttttcaaaaacatcagatcgaatctttggacacatgtatggagcattaaatatagattaaaaaaactaattgcacagttaggggggaaatcgtgagataaatcttttgagcctaattagttcatgattatctattaatgctacgataacccacatgtgctaatgacggattaattaggctcaagattatctcgtagtttccagacgagttataaaattagtttttttattcgtgtctgaaaaccctttccgacatccggttaaatatctcatgtggcacaaaattttttatttttcacgaactaaacaggccgatggagcgagtaacaaaaacccatcaagctggcagagctaacaattaagcacagccctcgtctaaacgcaatcaccaactcaccagcatcctacaaacagagaaaaccgtagataggataggagtacaataatactatgtgaatacgtcagtgagccaaccccaacgcagcagcagctagcttcactactgcagaagatctccttccgtgtagatggggacatcgacggatagttggccggcgttgggcagccattaaatctggagcagttgcatcctgcatgttactatccagctagcctgcctcctgtgcttggatgcccagttagctgcatacaattaagagccatccacccatgcattttacatattttttcccctaaaacctgtagggcatgcttgttaattttgaatttttgcaacttaaattttccaatctatggtttttctagtcgtttttgttccttagccagttttcgaccgcgaagagcataggtaggaaagtcttacctaaaattataattagtcttattcctcgttattgtgtcttcgcggcttataattagactagcttataattagactgcagtgcctttcaagcaagccctacgttactgcactattaagagcatatggtacggatgttatggaaacttctacaagattattgcatctctatacattgaagacaatcaaacacaaaggattacaagaagtttgatgggtaaattcagaacttgtgtaaatatgtgttggaggagtgtgtgtgtgtgtgagagtgtggtcctttaaattcctgaagccccacatggcaggctacaaggtggcagaaaccagaaatggctgcctgccttgttactgtgtgataacagctacattgcttggcttatgtgtgtttgagagggtacaacaatttcgatggctgcctttggttgctacgtttggttcatgggcatttgttggcctcatcccaaatggcatttgcagccttggcaggggtatctgatgctgaagggctgccttcattggccccccttttgtgtcatgggcaaggcattggtgaagatctgattacattgttgattgttggctgtcttctctatgtggggaattgtgaaatggtgaaagttgcaacatggacagcttgcaaataaggtgaaaataacactcactgcatgtctgtacacaggcaagataaggagtgacacttgccgtgaaggtgacacgacacaacaaattttcatgtttttagtaagctcgatcggtgagcaacttttattggtggcatatgcataaatgaccaagggaacatggtactgtcatcttgattcgtcagacacgacgtgtcatggaaattgggacaattccaggcaagattttaaatgtggggtttacgtggtgtttgggagaggagggacttattttagtctctctcacaaaagcacaagtcccttactaaacaccaccttagaccctggcctcgtattccagccaagttcggcttcgtgtgtgattgagatggacgaaggccatgaaacagagggtgagttgtagttgtgactccactaatagactcattctggttccatgtctgacaaaatttgttacatgatatttaaaatttgtataatttactgttagacatcgtaaaaacgtgccagacattgttaaaaactggtaatctactagagaacacttttggcttagttgggagagaattttttcaagaaaatgaaaatgccctccagtaaattactatgatggaatatgatgtatgttagtggtgtacttgggttgatagtaaatttagatttgcataatttctaaattttactctcacgccatatttgaagcatatggtcttggggcaatctcctcttttttaataatttatctttccaattgagccaaaagtgtcctctaacaaattactgatttttaagtgactttcagccatgacacgtttttttatgtctataagcaaattacacaaattttgagtattctgtagcgaatacaaatgctcatatgcacacgagtttagttctatgtacacatgcacactctactctcaatgtatcaaaaagggtacaatattgtcaactaaatatatataatatatttgattctcacagacagaattgtgatgaaactaaatatatatttgattttttattgtgtgcgtaacgtgaattaattctgtgaccattttatttcgtacaaatatatttgagtgtgtgtactctaggtccttttattgagtgccggatgcagcttgttctgatttgttgcgattgtactgtacaaacccagaaaccctgcgctggcatgtatatacgtcgcttcaagttttggtaaatgaatgatgtacatacaatttgcctgttgcattaagtttggtgaatgtacggggtgaaataaactggggattgtatttgacacaaatatttttggagcggatgtaaatgctaaatataaagtaaatttcacaaaagccgagactatctctttgctacaactttgagggagtatttcataaaactgtaacaaatagcaaacggttttacgagaaaattaattttatcctcaatgcatatggaatgtggaacaactcttattaagagagtgcgagtattatccacgtactagtacctgtgtgataagtaggctaaattcgtaaggcaaataaataatgttgtagttctctgaaatatttagctaaagctagaacataattctgactatttaccttttttaaaaattgctcttaaatatatgtcggtatattgagcagtaatcatatatatagaaattgtgatataaattaggcatatgctcaatttttattccgtcgtgggtacagtgacaacctgaccctctctgtgtgaaagagtagctttttcagcgtatgtgggccttgctgacagattcatagggaatggtgtagtgatttgcaggtgcgaatacctattcgatctggtggatttcgacacgatatatctttttttttccatttgtaaatgatattatacatatccccgcaaaaaaaattatacatatatactctactccaatttcctcagaacttctcctaaatgcataaggttgaagcactgtacattatatcatctggggcttgttcggtattttcgatggatgaaaatggtcggaaaaaccctataccatttttattttcgtattttttttctcaaaaatggaatcggaacaatagactcggaaattgtaacgatatcggtaatatcggtatatcggaaacgggaccatcggaacggaatataccgatattggtcggaagtcaaaatttaatgtcggaatcagcggagtgtggcatagcacgcatttaactatgcacgtagatgaatttttaacttaatttttgcaccatcacactccacataacaccgttatatgataattggtgatacgataataagtttgacaaacaacataaagaaagttcaacaatacttcatacttcaacatcgataagttgaggagactaaagttcagcaaaatccacatgccatgtcatagggttaacaatattttccctggtcacttccccttttattatgggctgcaagcctaccgggtttctttcattcatgggcttccgataagttgaggtggctgagccgctggggaactttcggaattttgatggaaattaccgtataaatacggttaccgacaaacggtcggaaaaatctccatcccatttccactaccatttccagaagaaattaccgtttccatttccaccacagtcggttactgataccgactaaaacggtcggtgaaaactggaaacggcagccagaaatcttaaaaatttccataccattttcatccctagtattttctacgcaccttaatggatgctgaattaacctcctccaatacctatggaaaggaactagcctaacaaggcctttggatgggagcaacatgtttttcagttaattaggagagtggagacaatctttatattcagttactttttttttcgatgggaatacatgcaattaatttcaagcatgttttttgattcattatctttggatgggagcaacatgtttttctttgataataaaaattcagcaaaatttgctacatgacactcaaaaaacttgtaattggctaagacatcataaaaacgtaacatagctgatggatactaccaaaattgtataattagttgtaggacaccagatacaatattttataatttttgggtcaaaagaggtgataaaatttttaagatggcgagattgcccttggcgccgctcctctccagctcactggccctatcacatagcgcggccgccgcttcgcacgcgaccgcctccgcctcgcgcgccctgagctcccgtaaccgcctactgctctagaaccaccgggaccggcgagtggcggcgtctgagctgctgttgaggagcttggcagcgacgccctcgaaccagccccgctcggcgatgcgcacggcgatgggtagcttgccgctgagctcctagttctagtccaggctaaggaactgcacgaggtaggaggggcagccgatggcgatgggcatcacagcagctaatgccggagcaggtgaatccatcggtagtgttgtcgccgccggcgccgagcacaggggtggtcgccaccacgctggtgaacatctcgctgaccgggcagaggagcaggtgccgatgatgttggagttctccctggcgagcgtggcctggacgttgcaacgggcgatgggcgtcgggcagcggatgggttcgccgtcaagatcaatgaggtacccgtcatggagggcgaatcatggcagccgtgggtgccgaccttgcgtgcgctaggagcaggacacggtctgcgggaggaggggggggggggtggggggaggg

SEQ ID NO: 41155 - DNA, 26217 bp, Oryza sativa
caaagtaggacccacatatcagtggcacaactgcaaactaaacaaagtcagtttccaccctatacccattgcttattttgagactgtgtcgaaggtggggataagtgtcagaaccctccagcagtgatggcttctattggaacagatgtggcgcctcctcccccaagaattttttgcatgaaaatatttctcttgtaaaattctccggtatcctttctattaaaaaaatctattttggcctacaatataaaaacatataaattttgaagtatagaaatttgttgtatgagacttttatatctatgagtttctaatgcaagatattagctaggtgccagttgcacctaatagacactactgaatagatatcattactattgaatacacattctcgcagattatgcaataggtggcagtttcaaacccgatataggtattggttttggaaccgtcaccaatcatccagcggcaatgtcccagcatcattggccgtaataaaaccaacacctatgtactctttccaatttaaaaaaaaaggagacgttggtatgcttcgagtggcccccttcagacagctcgtaatcccaatccacaacacaaatcaagaactccaagttgattggcaaccaacacacccaagccctgtgcttcgtgagttccaaattgacagcattggaaatgaggttaaataaatgtacgtgaggaaccaacatactaacatagggcagaaggtgttttaagacaattcacttaacagtgacagaaaatttcccggacgccttccaatcctagaggaaacatcggtgctgataatctcgatagatactactggcaatattgttttcaaggacgacttgctctttatgaggaaaacacaaagcgactatatagcattcattcctacgagcctaatatatactccgttcatcccattagttacggcttaactaccctggacgcagagaccagggaagcagttcgatgtgtatctggtttatacatggccagctgggccgcccggcacggcacgtctctatatttctaatacaaatatttctagtatctattctaggaaaaattttatgaaagcgtttcattcgctgatgtcttaaatgcgtgcatatgtatgcaagggaactgaagagagcatcaatgcttgcatgtgtataaatcggagccgagcaggtgccgccctatattctgggatttgagccaaattcagttacgcctatataatgggatagaggcactagcattctcgaaagctatttcatcggagacttcagcaccaacatttgtatttatttactgtcggcatgggaggcactaggaatacaagcatgccgtgctttaaatttacggttcgttagatggtctgcatctccattttcaccacaattgcgcttgcaagttatgcaagttctggccactgattgcaagtgtgagacgacataccagaagttagaagtatatcttcacaattcgtgctggagatcagcgtgatcgatcagctcgaacgaacggttaatctaatttgcatcgtgtgtttgttttaggttcagaaacagatgagcatcttctcatctatgctactgccgtgtatatagtaggttcagttgaaaccctctttatgtgaggaattaagattggtgaaaaaaatccgaagaaaaggttataatcctgagcaaatatttgtcctgagccttttagtagtgcaggacggtgtcttctccaaatagacccttttctctgtccagttgtaaaagcttcaaaaatatgtgtgaacttatttagattgggggtccatcaactcaatgatgatttatagtttgttctaaaaataaatttgggagccaaattttagtatggatttgctgggctgagaatttagcattccaagttactccctccgtcccataatataagggattttgactttttgcttgtactgtttgaccacttgtcttattaaaaaaattgtgcaaatataaaaaacgaaaagttgtgcttaaagtacttcgtataataaagtaagtcacaaataaaataaataataattccattttttttaaaaataagacgaatgatcaaacagtgcaaacaaaaagtcaaaatcccttatattatgggatggagggagtaatattttgaatagacaggaactacttttcttgactgcgtatatcagtgtaagctataatgtatatttgtggaaaacaaattacactactatagaaatctttgtacacggctggaactagttttcgcgggtgggtgctccaccagcctggcaccaagtgtatgcgaaaattggcatttccatgtgaggccaccacaatggcatacaaaaaatcattttcgagaaggccgcttgcaaagatccttttttttttgctagcgcccagtaaggatacccgactaaacgattaaaaataaaaaaaaaacaaaagaagttaaaaaccctagcaaggtcctcaccgggcagtgcaaccgcaaagtgcgctcttcggctctttcgcttcccctgttgctggcggtggatccaccattctggagcctaccggtggcggatccgctgctcctgagtccgcatgttgccaccgtggttgtggtcgccgtgctgcctttcgcctcatctccaccgcacgtgagggaggatccattggtcacaagcccgtcagcggcggatatgccactcctgtgcatgcatgccgccgccaccatggtcatggttgctgctctggtgccgccgtcatcacggcacccccccacctcctctctgccaagcgtgagggcggattaaccgctcccgagcccaccgatagtagatctgcccttcccaagcctgccggtggcggatccacgactcccatactagcatgtcgccaccatggtcgtggtcaccgctcccgctcccatgggctccagaggctacctctgctccaattctgaagcccaccgtcaccgcccggacaagtgaggatgctggccggccgtttgggagtgagaggggaagtaaggtggaagagtggggaaaggagtagtgagtgaggcaagtgggaggaggaggggaagtgaaataaaagagggaatcagattaaaataaaaaggagaggatgggggagtgtgtgactaggtggcggaggagtcttaaccaaacactacccaaatctttttacatggggacgttattttagtctgccaacgataaactaaggggcgtgtatgcaaaagtcgtttttttatagtgttttaccatcgttgggattaattttcaacaaattagagcaattcatcaatctatatacccaattatccatccattccgtctgggtgatttgcatctcacctatgctgattctgtagagcgttttgtatctggttgatagcgaacttctataacgttttattttcttcataagattttagtggtggggtgctagcatcggcaaacaccaccacggcttgctttaaaaggagtacaaaagcacaaaaacctcgcggctgactgccaaggaccccgacttgcccttaatttttgctgtcatagtttttgaatggaaggagatgcaaactatcaaagtaacaacttgaactaaattttacattcttagctaagagtccatgtaggattgagaagcattatgtatgcgtcaactactattttgttgtataattcatatattctactctaggcatgtaggcggactagcgttcatatgtgccattattgtaatgtcttacgtccaaatactcttatgttttctctagtagggctagtttagcgatgttcaaattaaacctaataagtagaagaacaatggatcgcttatatactgctcgtgacaagttctagaattattccaactatctccgaataaaaatagagacggtgcaaagtttttggtgcaacaaaaccaggtataggagtaagtgtccatctagtaaatgcgatattaagtttgaaaaaagtggttggtcgtccatcattggcgtataaaaaccatggacgtttgcaactgatagatagctagctgttgctaagtgaaagctgccatgtagatgcagatgcagatgcatcttctgccaagccatatgactgggagtgggagtcgtcaggaatttcgataattgtgaaattgtgctacctatgacatcgggtacttcatttgggacaaataggagaattgtctcgtgaagagtaattaattgtaaggtctaccatcgggtttcctttgtgatgcatgagttacaagggtagagttgagagtgcgaggacaggagagctgtatgtatatgatctggttgtccgtttcaatgtaaacaggttggaaactaaattgcattgttaaagctggcccattgaaaatcctttaatctatttctttgtaaacatttctgttttcttataaataaaattataacgtaacgggcttccctgcttttatttttagggatgtggaaaagaaataatgcagtcaggcttgcttgtaatgagatcatgagataaatgtgttatttacggctaaacttgctttgaaaaatatgcattgtaaagtgaactgtagacacatataaatataaataaggaagatcactcattgtccttccatctcccgttgaactgcttgcaaagatgactaggttagaaaatggtgctcttgattcatggcagatatttctgccaaaatgtttcatcagagttcagacttcgaaggtagtagaaaaacaagacgtacgccatccttgttttgattcgcttgattgatttggcatctccatctccaccataactatgattgcagttacatctaatcatgttggattttgttccacaacggattactgtgagccaattatgcaagctagcagcatgtctcttcaccgttcatgttggagaatacaacgtgatcaatattcagctagaacaataatttttacgttcaactttacaatattagtataagtaatgcaaagggcaatatcacatagtccaatagggaaactaatatttggcaacattcgtaagacgaaaaaaaacccgacacatattagagcacataatgcaatagaagaactaatgaattactattcaattactatttctctaaaaaaatacaattctaaaccaaactgaatgaagaataagaaatataggatttgatatttgatagaaatatgttgaaatattatgaaaataatgtaaggacgatttgttatgcttgcttgtaataaattgcagatttgcatgttaaaattaatgtatcagttgctaataaatgataatgtgtcatgtttttatgtaaatatattgaatgtatagatttgagtaacttttttgagtgtgtatgcacgtacgctatttaaccgagagtaactacctgtattaattagtactccaatttgcaacttgatcttagaaattactccctccattccataatataagacacaaacacttttcttagatgttccataatactataaggcatgcatgcaagcatgcaattaactataacatcttctccattaaattattacttttttaaatcctccactcccatgttatctaatcctattggatgcgtacattatatttattaggatgatccaaactacaatataataataattatttcttggtctttgggttaagggtgattgtacattatattttggaatggagggagtatctggtaatctcagtacgtatatagcttgcacttaatctaagaaatttatatagaatcccataaatccaatggaccccaaaatataataagtgtttatgcaatgaaattcatttgcttgatgtccttctctgaggcatatatataaaaccggccatggcattttctctagcaaaactagttgtgcctcgaggagccacgcaggaacagcaaaggtggcagctataggacttgcttggactaggaggcatattgggaagttctcatgtgtgatagctggggaaatgtgctagcaactgtccctatatagctttgatcagccactgctgttgatggcgaagtaacgagggcggtagttgtcatcatgcagcaagtaatcgatcggtataaagggtgtgtttagttcacgttaaaattagaagtttggttgaaattaaaacgatgtgactgaaaagttggaagtttatatgtgtataaaagttttgatgtgatgaaaaagttaaaagtttgaagaaaaaatttgaaactaaactcggccaaatatgaactgggcgtaacaataaatgggcttgcagcctgctgatgggatttctccatgagagtacacatactcatcaacacggatggaaatacaaacgtaacagagctcatgtcaaaatatgtctaaaaggttgataagcagttgccaaaggtaaaacacggaagtttttttcgaacccgtaacagctttgctcgttaatctatctatatctatatctatacctaatataaaaatacgcaaggtttctgtgtttttttcgtccgttttttatgtcgtgttctttaacatgcgtaagagtacgtgcgcaaacggtaatgatttgttctttatttgcacgaattttctatcgttaggctggtagggattgttttttatctgctcagttttttttcataggacgaaaccctaacatcgccgctatgtcgatctacctcctcatacgttctttcctccaattgattgcaaaagtcgattccccactactcccttatcatttccccatatgattttccctttcaattccgctttaatttattggatttaatcaccatttaaaagtcaccattctatcctagttttccagattcgtttcgattttgataaaaacggaaagaggagattgagtgtatcaaaatccctcaaccaattgcagatccgtttcgattttgataaaaacaaaaggaggagattgagtgtatcaaaaggccttaaccaattttgggaaatcgagaaagattcaaccagatttgataggaatgatcagttctggcatcgtacggacacagaactgtcttccggaggttggatatgacagtcgaccatgcaagcggagcctacagctcccctttgggctacatcaaagagaggcaagccaagtagaggaagatagcggggtgggttgggactgaaaagtgtatagcgataaaaaatattttaccgttgcaacgcataggtattttttctagttatattaggaagataaaatttgtcatctaggatatggctgtagcggatttccgtgatgcggtggcctagctgcaaataaacctttatcagctagaaattgaaatagttgtgatgaagtaaagcgaagaacaagtggccttcctagccacgcaagataataatcaaagagtagtacttttagccctaacttacatagaatatattttctaagtttctctgatggctcttgtataataagtctgcggaactatttttctcttatgcagaacttctgccttttgttaaaagtataacgagatacagtgcaagaaaagcttctctgcagagggctcttgttcttgtacgatctacaataattatgttagagcaatttcttaggaactaactaatttatcgttctgcatgctaaaacaagtgactatttctagcaacaagtgtcagtatcagtgcaaaatcagaaaaaaaagcctcgtaccaaatcatccccactgattaatacaatattttctacttcctccgtttcatattataagactttctagcattgcccacattcatatatatgttaatgaatctagacatatatgtgtgcctaaattcatttacatctatatgaatgtgggcaatgctagaaagtcttataacctgaaacggaggtactacaaatcaatcacaaaatgggtgcaaaattgaatggagggagttgggggtacaacactttctacaaatcaatcacaaaacaggtgcaaaattgaagtgacggagtgtggagttctagggtcttcaatggtgattcaaccgaagagaagtttctgctggcgttcttcatctctggatctaccgcccgccgctaatacctctgagtccgctcgccaccgccgctagatctaccgccattcggggcaggtgtggagaaggagatgcaagaggaggggaggacgggttgtgctgccgcctgctcctccatgtgcaccgccactgggaactctttcaagggtgccgccaaccctatcaccaagccggcctatcgagaggagtcgctactcaccaattgtggtgttgaggacgaaggggcatgatccaatggcattggcggataattacggtgcaaagttttgtaaaaatgctagagccggagttgcagagcgaccttaaggccactccatccagttagttatattttctgcagcaatctggttggctctgctctattttttttgggtagagatggaccgtttgattggactccagctccaacaaaggtgaatctaggagctaggatcctagcaaacaggctcttattccatccgggttaataatagttgtcatttttgaaggatatggttaaggaaaaaacaattttaaccactattttctattataatatatagaaataccaataaatgtataattttattaaagtattatcttaatactaatctatagatatggtctccatatatttctaatacaaatatttaaagtatttattctaggagaaattttatgaaagcgtttcatttgctgatgtcttcaatgcgtgcatatgtatgcaagggaactgaagggagcatcaatgcttgaatgtgtataaatcggagcctagcaggtgccgccctatattctgggatttgagccaaaatcagttacgcatatataatgggatagaggcagtagcattccaagtcgaaagctatttcatccgagacttgagcaccaacatttgtatttatttactgtcggcatgggaggcactaggaatacaaacatgctgtgcttttaatttccggttcgttagatggtctgcatctccgttttcaccataattgcgcttgcaagttatgcaagttctggccactgattgcaagtgtgagacgacataccagaagttagaagtatatcttcacaattcgtgctggagatcagcgtgatcgatcagctcgaacgaacggttaatttaattttcatcgtgtgtttgttttaggttcagaaacagatgagcatcttctcatctatgctactgccatgtatatagtaggttcagttgaaaccctctttctgtgaggaattaagattggtgataaaatctgaagaaaaggttacaatcctgagcaaatatttgtcctgaaccttttagtagtgcaggacggcatgtaccagaacagaagtacggtgcctcctctgtccagttgtaaaagcatgaaaaatatgtgtgaacttatttagattggtggaccatcaactcgatgatttatagtttgtcttaaaaataaaaaccctagcaaggtcctcaccgggcagtgcaaccgcaaagtgctctcttcggctctttctcttcccctgttgctggcggtggatccaccattctggagcctaccggtggcggatccgctgctcctgagtccgcacgttgccaccgtggttgtggtcgccgtgccgcctttcgcctcatctccaccgcacgtgagggaggatccattggtcacaagcacgtcagcggcggatatgccactcctgcacacatgcacgctgccaccaccatggtcatggttgctgcttcggtgacgccgtcaccacggtaccacccgcctcctctccgccaaacgtgagggcggattaaccgctcccgagcccaccaacaggatatctgcccttcccaagcctgccggcggcgcatccgctgcttctgtgctagcacatcaccaccacggttgtggtcaccgctcctgctcccatgggctccagaggctacctctgcttcaattctgaagctcgccgtcactgcccggagaagtgaggacgctggtcggctgtttgggagagagaggggaagtaaggtggaagagtggggaaaggagtagtgagtaacgagagtgggaggcggaggggaagtggaataaaagagggaagcggaggaaaataaaaaggactggacgggagagcgcgtgactaggaggcggaggagtcttaaccaaacaattccaaatctttttacatagggacgttattttagcccgccaacgataaactagggggtgtgtatgcaacaatcatctttttgaggtgtggtgctagcatcggcaaacaccaccaccacggcttgctttaaaaggagtacaaaagcacaaaaacctcgcagttgactaccaaggaccccgacttgcccttaatttttgctgtcatagtttttgaatggatggagatgcaaactatcaaagtaacaatttgaactaaatttttcagtcttagctaagggtccgtgtaggattgagaagtattatgtatgcgtcaactactattttgttgtataattcatatattctactcaaggcatgtaggcggactagagttcatatgtgccatcgttgtaatgtcttacgtccaaatactcttatgttttctctagtagcgctagtttagcgatgttcaaaactaaaactaataaatagaagaacaatggaccgcttatatactgctcgtgacaagttctagaattattctaactatctctaaataaaaatagataaggtgaaaggtttttggtgcaaaaaagccaagtatagaagtaagtgtccatatagtaaatgcgatattaagtctgaaaaaagtggttggtcgtccatcattggcatataaaaaccatggacgtttgcaactgatagatagctagccgttgctaagtgagagctgccatgcagatgcagatgcatgttctgccaagccatatgactgggagtgggagtcgtctggaatttcgataattgtgaaattgtgctacctatgacaccggatactttatttgggatagataggagagttctcacaaagagtaattaattgtaaggtctaccatcgggcttcctttgtgatgtatgagtcacaggtgtagagttgagagtgcgagaacatgagagctatatgtatatgatccggttgtccgtttcaatgtaaataggttggaaactaaattgcattgttaaagctggcccattgtaaatcctttaatctatttctttgtaaacatttctgttttcttataaataaaattataaaggaacgggcttccctcctttttatttgttagggacgtggaaaaaaaataatgcagtcaggcctgcttggaattagatcatgagataaatgtgttatttacagctaaacttgctttgaaaaatatgcattgtaaagtgaactgtaggcacatataaataaggaagatcactcattgtccttccatctcccgttgaactgcttgcaaagatgacaagggtagaaactggtgctcttgattcatggcagatatttcttccaaaatgtttcatcagagtgcagacacaaggtgaatgagtttttttttcatactttccaccggaggggagggtttccctacctgaatttcattagaggaggaaagtacagtgagtttaggatacattagatcagagggggagagaaagagcccttttccaggagtcgacaatgattctgtcttcactacggaggcgttccgtccagagcgcagcgtcctcaattgatctagtggccaacccggacaagaaacagggcaaactaagaaaatcaacattgtgcctatgattctaaataccccaaaaacaacatcatgaatgagtacattgaagctttattttgttttggattgttgaactctgcctttttactccatgataaataacatgcgagtttttctctgattcgtgcgaggctgaacacatggaggaaaaatgcgtgtgaaactgacaggtttgatatggtccatagggccatatgaatgtgttttactatattcagtaattcaaagcactcgccatttcaactctagtactagtgcgcaaaagattgtttttctgaacatttttgcttacagtgaaaaaatttgcttttgaaagactacgaccagttctgaacaccttgctatgtccaaaagaaataaagattgttctgaaagcttgccatcgtcatgtactagaatttttcattcagtatttgcaatttgcacatggaactgaaaacggtgacatcgtagatcgaaaaccagcacaccgatgccctgtgctacatgaaatccaatttagcagcattgcagacgtggatagatatcattacgtgaggaaccaacgtacggcagggcgtgtactacgacacgtttggttaacaatgacagaaatatcccgtatgcctccaaaccctaaaggaaacatcggtgctcacagtctcgatagatagtactatgaggaaaacacaaagcagctatatagcactcctttctatgggcctaatatatagcagctactccgttggggtggtttatacaattttgcttagctttgagttaacatcggtaaacattttcagacgtgcagtcttatggcttatttgaatctccatattggaggagcatattagcagcacgtaaaacatgatggctcatgaaaacatcattaattaggtattgactattataaatttgaaaaatatattttttgattttctagaaaaacttctatatagaaaatttttgcgcaaagcacattgtttactagttagaaaaaaacgtgttaacgaaaatcgaggaagcttcagtttggagttggagtttagaacttagccttaatcacaacaaacttctagctataggcacagtggtacagccggttaatcagtaataaggtcaagtaacattaccaaatgcacatggacacattatttttcggaagaagaatggtactgttagtatgtcttgtgtatatttacagcagtaatgataacattaatagtaatagtagagacagattagactagttgatatccattgtttaatcgagaaaatacttaatcttatcctttctctaactaataatcctatctcaaatttaactaggatgggctgcctatgggcctagccttatgggttcatgacacatttttatatagtctagagtcccggatgtatgtacatggctattcatgcttattctttctttttcctcaaatttgtttataggagaatgagcacggaatcgaattagtcaacacttgtaaaatgcgaaggatgcaatcatatagttgtgaccgtaaaaaattaactcatcttacaatcgtaggcatttagccaatactaacgtggacctgcagagttttggtaacgaagatctattttattccaaatgtttgtaattaaacacaaatagagaaggtgtaaatgtctcttgcaacaaaataaataaggagtaagtatccaactagtaaatgcaatatctaccaagtataaaaaaagtgacatgtcattcatcagtggcatataaaaacaatggccgcttgcgaccagtagatagctagctgttgccaagtgagaactgccatgcatatgcattttagtggcatactggcactggtggagaaacgctttgtagtcccggttggtaaccctttgtaatcctggttttctaaccgggactatgaatctgggactaaagatcacaatctttagtcccggatcaatttttagtcttggttggtgttatctttagtcccggttcaaataaccggaactaaagatcgatatatagtcccggttggtaacaccaaccgagactaaaaatatggtcccggttgttgttactaatcgggactaaaaagttttggttttctttttttttcttttcctttcatccggttggccttttttctttttttgattgttctttagctttcgctcgtggatcgaatgaataaaatcaacaacaaagcctaaatcatagatcaaatgaataaaatcaaacaacaaagcatccatattctttacacttattcagatctacaacatcttcagaacaatgagcattcatcacagagaaaagagagagcatttaccacagagaacagagaaaggaaatcagcattcatcagatagcacagagaagagaaaaaaaaattctccgcctgccgccgcctcccgaccggcgccggccgcccccgacgcagccgaccgccgcctcccgtccggcgccggccgccacctcccgcccggcgctggctgccgccctctcgaccggcgccagccgcccccatctcgccgccccgcgcccgacgtagccggccgccgccctcccgaccagcgccggccaccgcctcctgcccgacgtagccaaccgccgccgccctcgacgcagcccgccgtcgcctccatctcgccgccccgcgccgggccgccggcggcggcctccatcccgtcgccccgcccagggccgccgcggcctccattccgccgccctgccggaagggaagggaggagaggagggggaggaaaggggaggagatggggtgagagaagaaggaagagaaggatgggaggagaggaggagagaagaagataagatggagaggatggctggatgggagaggaggagataaggatggaattaataggcgacttgcatacgcacccgtggatagaggctttgttttaccggttgtttaacaaccgggactaaaaatcctaactttagtcccggttggtaacaccaaccgggagtaaagatcacggtgatctttactcccggttgatgttaccagccgggactaaagatcacgggagggcctgacagccccggacaacatacgaactaggactaaagatgatctattaccaattgggactaaagatcaaatatacccactgtagccaccaatcgggactaaagatgatctttagtcccggcttttagtggaaccgggactattgtggattttggtcgaccgactaaagatggtttctccaccagtgtggcatgtatgactgggagttggaggcatctggagttccctgagtgaaaattgtgaaatggagctaaatgttgtctccactttcaccttattagggataagtagagcaagctcggatgtctgatgcagacttgcttgtgtgtctcatgcaggtggctaccaagaaagccctgtcatgtctagaaatactgccatgcatgtatggcatgctccagggatgaccaggtcaacatgtttctggtcatattacttcagtagtttgaaatggattgtattattgggcaaatttttccacaagaaaaaaaaacgtgtgcccaaaagattgtttatgtgaatagttttggttgaagtgatcagaatcacagaactataaattccaaaaactacacagtgttaaatatcctgctatatattttttaataagggattaaaacctggcctctagatctataatcaatatgtacacggccgaggaacgaccaagtatactactagttccaacttccaaataaaatagagattgtgttgaaggttgttgacatattttggagttgtactattcttcattctttattagcaattggcatagcagggagctggtaagggcgctaccatatataggcacccagcacgccttgaatcctataatattatacaagtgatccctacttagtccagttattatcaatttactgagctgtggataagccacaccatctacttgatttacagccgtttgatcagctctggatggtcatccatgttgcctatcgtaccaacgctgaagcgacacggagcgaaacgatagagccatcccggagagacccatatccatgtgccaaaagcccattagattgtttttctccctgtcactactccaagccaaagcatcgatcgttttctctgagccaacgcgtcacactgcacgccgaacacaggcgcacgtctcggccgcgccgcatgcccacgcgcatgcacggggtggccctcctcttgcaccacttctcgctgccatcccgccacctttcgcccaccctcttcacagacctcccgacgcgtgcgcgtgcgccgcaaggcccgtttcagccgcgccgtctcccctgcccagcgattcctcaacctcctcccccgacgattccttgcctggccgctccgctccctctccttggctcggcactacctcctaggctgctcgccttttgagagcaagtttaatagtatagcccattgatggctccaaatcatctatagctaatcttgtcgacgtttgatgtcacgactacggtatttggacagtatggggatcgttggtgctaggatatacacgagactgaggtaaaagagatggagacagggatttttatacaggttcaggcccctgaattgtcaggtaataaccctacatcctgttggccggagccggtattgcttttattcaccataatcacaccagtgcaatatgtggggtagcctatctaactgttgtcgacatggcggtatgaagttctgactcatagtcgacaacaaggtagccctcctcctcgaatccgtgtccggcgagattagagatagcgctttcgtctctcctgacagtatccggagataccgtaggggaatagccatgcctatccctgaagttgatatctggcgacttgtcttggagtatgttggcttgtatgttgtgacttgtgttgttccgtatattgtggtaggtgtgttgattgaggtggtcgtctgtgttgtccgtgttgatcgtgttgatcgtcaattgttcgtctcccctctcctcctaggggggcttgtatttatacccataggtgtcaacttgtccaagtagaattagggaaactaatatggatataatccgagtagtccttgtcgtttccatgtagaactatggttgtctttccttattcagaactccctcgaggtcagtttccgtataagacatggtatgtggtggatcctgccgagatttagtcaactactattaggtatgtggtatccataaccctgacagtagcccccgacttcgatgcaaataaacgagttcatattctcaatacgcagactttggaggaactgttatcgagctcacgtgaccgttctcggtgagtttagagataacgttagacttcctttatcagcctcgtgcgggtaccgaaagggtttgtctaagtcaatctttgatgtcgaccgagaaagtacagagcgtacgactaagtctcccgtcttgctgtaatcgagaatttggattgaagtcaagaaattttatctcggtgagtacacactacaccacaacactaaaaagaagacagtcgtctgtcagtagaaaaaaatttagatgtcactttgtctgtcggaaaatatcctgtcacacagtctgttggtaaaaataaattttaccaacagttctgttttatgttcagtcttgtgctaagatttttaattttactaatggggtagaaatgatagatgatggttcttactgtctttgtaaaaggaatatttttccaattggttgttgtcccatcccttctgagatgttactactcatgtgtgcttatttcaccctggcataaccaattttctaccttttccattgcagatctatcttcagtagttatggtggaatttgcttaattcttgtctacttgacctccctgacatatttagctaggtatggaagtggaactccttctctgtttattagtttatgactagggggctcctctaattatgtaagtaaagcagcagaccatcaaatgcgagcatccattctttgtctggatttaggtgtatagctgcctttttatttgtgctaacaattaacaaaatttaccttaagtgatatggtatctaactaacccattgtactgcatataaacagggtgactacttgattttgtttatggtatttcatctgaaaatacaaatgttcagtggcttaagtaaaaagaaatacagatgctcttttctgaacctgaggattgtcactcagattatttaatttttcaattgcattgcacaagagcaaaatatatcgcagaggttgcatttaaaattttgtatttattatccaaaaatgtagaaggtcttgctgagtaatcagagacaccaacaaggttggaagcaaaccagaacaaattaacaagcaaacgcacaactaaaaggtacatgtgtttcccttactctttgacatcagtttttcttacttctatgtggtttactaactacttttacatactttagtttttttttacacgatgttttgccttttgaatgtatgactagaatgcttgttgagcttgagagctatggcaaccatttgtgtttttgcagtatcataacaaatatttgcattttatattcagacatttagtatttcattataaaaggcaagcatggataagagatggatggatctgcctaggtacaaacacacaattactagcatggaattgtttagcctcactatcttcatttgtccaaactctaataatatagtatttcaggagcacaactgagtacagacgtggtgtcaataacttcatagaatttgcttttactcattcagcaaaaggaaataaaatactgtgtccttgcaagaagtgtgttaattgttcatggttggaagcaaacattgtaattgaacacctgatatgtgatggatttaagcatgggtaccggctgtggatttttcatggggaagcatcatcttctgcacattgcactacacatgaacaagttcaagtagaacagagggcagttgatcgtgatgaaattcctgaaatgcttagagatatggcatatggtttagatcaaatgggggaggggggtgctgctgatggcagttcaggggatgccaataatgatgtcgatgatttttatagattagtagatgatgcaagtcaggagctgtaccctggttgcaagaccttctctaaactaaatttcttagtctgtttgctgcatacaaaatttctaggaggatggagtgataaaagctttgacatgctactggacttacttagagaggcatttcctgaaggtgcagaactacctaaaaatttttatgaagcaaagaaggccgttaaatctctaggttttggctacattaacattcatgcttgtgaaaatgattgcatattattttggaaacagtatgaaaattatacttcttgcccaaaatgtaatacttctcgatggaagatggaaagaaagagtcttgatggaaaacgtttccacaaagttcctagaaaagttcttaggtatttcccaattaaggaaagacttcaaagactatacattaacccagagatggccaaaaatatgaggtggcatgatgaaggacgtacaaaagatggattgcttagacatccagcagattctccagcttggaaacacttggacacagtccatcctacctttggtaatgaaagtcgtaatataagattagcgttagctactgatggcttcaatcccttcatatccttgaattctacccatagtacttggcctgttattgcaattccatacaatgtgccaccctggatgtgtatgaaacaacctaatttcatcctatcactgttaattcctggtccaactgcccctggtaatgatatggatgtctacatggaaccattaatagatgatttggaatctctttggcgtgaaggcattaggacttatgatgcttctaagggtgaatttttccaactgcgtgctgcagtattaaccaccatatcagactatcccggcttaggatattttcatggatgcacaacttcaggtgaagttgcttgcactgattgccacatagaaaccggttatacaaggctatcaaagggcagcaagagttcttacatggcacatcgcaggtttttagatgctgatcatagatttagatcagatacaaaatcatttgatggcacaacagaatttagactagcaccttctcctctttctggtgaggatgttttgaggcaggaggagggatcaaaatgttgctgagaacaagcgcaggatacaagttctaaatctagaatctatgctaaagtctataaggactgaaggagctagctcttcacagcaagctaagaaaactagcaaggtatgctgatatgtttttattttttttgtgatgcattgctattaacaaaatcatagtggtttaacaagttttttgatattgtagaagagaaaatgcattagctctgtgccaattgaacctcgaaatctacgccccagactagcaagaattgatacaacaaatgagcatgtaggacatagtgatctgcaccctaggctaccaagaaatggaagtactaatggtcctgaaggacaagatgaaggtcctcaacctgtggctgctgaacagaatgggggtatggttttcttttatttttataaatatgagcaattcatatatttgattgactaattaactgacttgcaaatttcagattccaacagagcacaaccaaagaaacgagaaggaagaaaattcactagaaaggataacatatggtttagagaagaagacgagccactgatcaagatggagttcaacgaatttgatcagccagtagggaaagctgctaaagagtttccacatgttgttggtacacttgtaagaactaagggtttccctctcaatcatgatgactggagacatgttgatgaagattcgaagcagttcattatcgatgctttggaggtatgacaactaatatatttgttctattatcgtgctcacaatcaagacttcaagacatggtactttttttctttatacagatgcccttgttttattataataatgtagctcctgttattctctgctcttagctaagcttttatgtgctatatgtctaggtgtacaccatttcttcattccatattccttgtcgagatccagcaaccgttctcgagcgatcgagaaggcgtagagtctgcgacggagctttgtcgacatttgtcgtactcgtcttagtcgatcttggtgtagaaccatagggacatggagtcttccacaatgttgaatagaattttcctgaaatcaacgctcagaaaagaatatcaaatagaaatagcccctaagcgaacgctcaaagggtgacaatgttataatatgtatggtaaattgaaaatgaattaaatttaccgaccaatgttttgtgtatgagcgtcttctctcttaccgacttcgatcagtcagtttatagagtcatacactctccctagcccccaaccttgtcgtcggagaattgttctcaggggataaggctcttggacccttgacctgccttggttgaataagcactgatcctagcccccagccgtgaagttggaaagctcagtttccgattacacggcttggttaatacgcacggcgagaactcttacacgatcagatcttacatggtattttgtctctacaggatctgacaaggccttatcggctctgggcgtccccagccgaatatcccttaggttcctcggaggccttatcaagacggcgtaaagggacagtaggataggtttcaacgctaggtgtcgtcgtggtaagtgatctctgggtaaaacacttggagatattgtgtacctgttatcaactttgctgaaatagatgtagtaggagagtcgctacaccgctggtgggagaaacgctacatcgctggtcgaggatcaggcagtagtcgtaactcgaccacttaaagttgaagtagtgggagagacgctacatcgctggtcgaggaccaggcagtagtcgtaactcgaccacttaaagtggaactagtgggaaaaacgctacatcgctggttaaggaccaggcagtagtcgtaactcgaccacttaaagttgaagtagtgggagagacgctacatcgctggtcgaggaccaggcagtagtcgtaactcgaccactagaagcaaatgtatgagagatcactacgatcaactggtcgagaactggtgagtaggtgtctctcgatcatttggagtcgtggcacgaggaccgctacgctgccggtcgaagaccagtcgtagctgttcctcaaccatctgaagtcatggtgcgaggaccgctacgccgccgtaatcgtacctcgaccatctgaagttaaggcgcgagagattgctatgtactggttcgagaactagcgagagtagaattttctctcgagcactaatggaagttgtggtgtgagagattgctacgtactggtgtgagaaccagtgagcgagtagaattatctctcgagcaccaatggaagttgcggtgcgagagattgctacgtcttggtgcgagaaccagcgagcgagcgagtagaattatctcttgagcaccaatggaagttgtggtgtgagagattgctacgtactggtgtgagaaccagcgagcgagtagaattatctctcgagcaccaatggaagttgcggtgcgagagattgctacgtcttggtgcgagaaccagcgagcgagtaggattatctctcgagcaccaatggaagtgctagagttggtttattacatgtgtgtctcatgtggccagcatgactcacacacccaactcgtggtataaccggatgtctgttcgcaatcatgtcgggtgatcaagccgacggcgttcgcgaggatttatccgttaacaaccttttctcgagtagtccagcgatggccggtgctatgagataggtcgtcggtcttcgttggtaagttgggtgcgacgactccgcatttgtcgagaatgttctcgatagtggggtgtactcgactacaacctactcgagtgctcaaatgttcctgaaaaatattttctagaaggcaagacatatagtagagaatattgagtatgtactcaaaaactgcgtggatcttctagtactatcaggatataacgagcagatgtaagtatcaggcattatgtaaaccgtaaacgagcataatttatacagaagaaaatagagcgagcccccagcgttagaccatagttgacttaacatcagaaacactcacacaatagatattgtataaaaacatgctctaggtaaacataataaattatagatctgataatgctgtatgatctaaataggtacgataaattgcatataaaatattgcgtacctttgtagatacatgccgaatgtatctacgaaattagtagaccgatttttaaaaaatcaatctactaaattcctgatcacgggcggccgttgatttatctgaatagtcaacacgttgcaacttagacagccatgttggtcttctttgcaggtacacgtcggccaactaatgcatgcatgcctaagcacgtactgagtccatgcatatgcatgtgtacacgtcaggagcaagcatattagttggatctttgtcttgttgttctctcgataccttggtagacatccgtgatcaataatccctggaacacatgatgtcgggatggatgttctcagtatgcgtcaggggtcaaaaatttggatcctaatcggggtgtgagaacgatccgagtcccaaaagaatctagtgaatagatcgagatgttgattttggttcctcgatggccggtgttctgagcaggcagcggcattaccgaggttacaaaaaatcaattgatgatgtcgcttccgaagagatggagatcggagacctcctagttgataatatcaagtcactattctccgctgtggcgacgtcttgaagtttggtcgatctcgccggatcgaatagtcgatggtgatgatttcgatctctccacagccgaaatcgtcgagtagcttgttgtcagagagtccatctcttgaacctatctcgtcgaaatcctgaagcaccaaaatccccctacctggcgcgccactgtcgacgtttgatgtcacgactacggtatttggatagtatggggatcgttggtgctaggatatacgcgagactgaggtaaaagagatggagacagggatttttatacaggtttaggcccctgaattgtcaggtaataaccctacatcctgttggccggagccggtattgcttttattcaccgtaatcacaccagtacaatatgtgggatagcctatctaactgttgtcgacatggcggtctgaagttctgacttgtagtcgacaacagggtagccctcctcctcgaatccgtgtccggcgagattagagatagcgcttttgtctctcctgacggtatccggagacaccgtaggggaatagccatggctatccctgaagtcgatatccggcgtcttgtcttggagtatgttggcttgtatgttctggcttctgttgttccgtatattgtggtaggtgtgttgattgaggtggtcgtctgtgttgtccgtgttgatcgtgttgaacgtcgattgttcgtctcccctctcctcctaggggggcttgtatttatacccataggtgtccccttgtccaagtagaactagggaaactaatatggatacaatccgagtagtccttgtcgtttccatgtagaactctggttgtctttccttatccgaaactccctcgaggtcagtttccgtataagacatggtatgtggtggatcctaccgagatttagtcaactactattaggtatatggtatccataaccctgacaaatctaatagctcattcatacaatagttaactataaaaatatactacaccattaagacctggtcccacctctcatacacacttaacgtcttggagtctgtgttgcagccggctacaaatctatagccgctttcttctctctcttctattttcttctcgatatgtgattttagttggcttatagcttgctattgtacctgctctcaagggcaggaaacggaatccgccgacatccaccaacgagcagcctagatggctgacatgaagacaataagggcagtcccaaccctccacctagtatggtgtctatggtattaactacattgccatgtagaacttttaacttatgtggcactatattaattaagagagagagtgaagagaggaagaaactgggtctcatgcaagacacagctttaacacgagaacctatgcactagacactatcaagttttgcattgggagagaatagtgtcttcataatagatgaagaataaatatgattggtagagaagagggatgatatatttattaatggcccactttaagaaaaccatgggttgtagagtgtagtttctattgtgatgtcttgttgatatggcaccatagaaactacttatagacactatgggttgggacagctctaatgaggacaactctcctcagcttctttctccgcaaatccacatcaagctccatcgtgttggtgctgcaatatttgttcagcacgttctgaagcagaggaagtactggaagaggagcaaatgtgatgcaagattggacagctctttactactagcttgcttgttttgctttcctcaagtgatggatgaatacatcagtcgatatgcatacactggcttcctatttataggcttgataaaccgacatgcaggaagcttcaggacctagttagaggctagtacactactacaatacccatttttctatgtgggcgttttgattatcccgtgcggtagttcggcccgtctgtaaccgggtgtttgggaaaatcggcattttctcatgcgggcgggtcgaccgtacaggataatcgattatcctgtgcggtcgtgttataccgcccgcacggaacaaaaaaaaaactaaaaaaaatgcgaaaatcgccgccggccggatctgggcgggggcccgcccgctcgccgccgcacgggaatggaagcagcggttgacatgcatgacaaggacgaccaccaggaggagggccgccgtcttgcccggccaccgcctcgctcgctcgctcgccgccgcgcccgcctcgtcgccgcacgggatgggaggaagcggtcgacgtgcacgtcaaggacaaccaccaggaggaggtccgccgccgcgcccggcttgccgcctcgcctgcttgcctccgtgcccggccgtcgccgagcccggctcgccgccgcgcccgctcgttgcctcgcccagcttccgcctcgccagctcgccgccgcgcccggccgccgcctcgctcggccgtaacctcgcctgctcgccgcctcgcccagccgccgcctcgcccggccgtcgccgcggtccgctcgacgtctcgccggcccgacagagaggaagggga

SEQ ID NO: 41156 - DNA, 2960 bp, Oryza sativa
caaacttcattgctactactccatccgtcccagaatataaggatttctccactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgatgagtttttcttccaacccgtcactggtatcccctcacctgtgacgggccgatacattagaagccgtcagaggtgatgggccgccacctgtgacggctttcatttctagcccgtcacaggtgagcggataccagtgatgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctagtaatggctggtcggacaagagttttacagaactccttgagctgttaaaggatctgttgccagaggggaacaatttacctcagacgacatatgaagcgaagcaagtattatgtccgttgggcccggaggtcagaagaattcatgcatgtccgaacgactgcattttgtattacaaggaatacgctgacttggatgtctgccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcgataggatttaccaggaattctcaaatgacccaagaaacatgcgtttcgcaatgtgtacggacggcattaatccttttggtgatttgagcagtcgtcacagtacatggtcagttctgcttgttaactataaccttcctccctggttgtgtttcaaaagaaagtacattatgcttgccatgatcattcaaggaccgagacaacctggcaacgatatcgatgtgttccttgaaccgataatcgatgacttcgaaaggctatggaatgagggcacacgaacatgggacgcatatgcacaagagtatttcagcctccatgcgatgctgttttgtaccatcaacgattatccggcccttggcaacctttttggccaaactgtgaaagggaaatgggcgtgtgggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggttcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgta

SEQ ID NO: 41157 - DNA, 15963 bp, Oryza sativa
  unsure (1)..(15963): unsure at all n locations
actgcaagtagttcatgcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacaacatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctagcaaggatatgacataaatggatacacctttcacacggtaaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataaaataattaaagtagtataataatgaagtgcaattactactgttagtgaaataaaataattaagtataaaaaatatgtagtgtatgtgaaaatatgttaaggaaaataaaagaactaagtaaaataaaataaaataaaattgctctaggcaaactcacctgtgacgggctctatctgtagggccgtcacaagtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctccaccgccgtcctcgccgccgccaaatccgccgccctctcgacctctccgccaccctctacgccctcctctccaccgctgcctcgacctccccaccaccgcctcgacctctccactgccgacctcactgccgctcaccctctccgccgaccttcccgacgccggcctgcaccaccgccgccgcactcactctctcgaccgccaccatccatctccaccgccatctccaccgtcgccatctccgctgccctcctcgccgccgccctctctgccgccatctccgccctctccgccgccctcgccgcctccttctccaccgccgcctcctcactcactctctcgaccgccgccgtcctctccaccgccatctccaccgtcgccgcctcaacctctcctccgccctctccgccgccatctccgctgccctctctgccgccatctccgccgtcctctccaccaccatctccgccgccgtctccaccgccgccctcgccgccggtcgtcctctccgccgtccgtccatcgacttccccgacctccccgaccctgacctccccgacgccgggatccccgaccaccgccgaccgcctcgacctcttcaccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaattttgctgcagtggatgttcttttctttatggataagaacagattatctacacttattgatttatatacccttgttgtctatgaatagttgaattgttgtttatatacatgatttatatacccctgctgctgctgccacataaattattgtgggctgttttattatctacacttgccccttgctgtctatgtttgcccatgctgctgcctatggttgcaactgttagttaaaacttgaatgtgtagctagtttgcaacttggatgtggatttaagagccatttggacatataaccattcataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaactactatcttcttttctagttgggcttggttgctgaacaagcttcacaaagcgaggttgagtccgcgccgaagaggcgcgaagatgacatcctcacaaaggcgctcggaaccaaagaacatcctagccgaactcggggaattggtagcgatgtgccctagaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacagttgtgaagatgactcctcgtccaagtcgaccgacggagcttacacctcccaagtgtaagctatcaattgaggctccccgtggaccggcattgtcagtagctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgctaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcatatcttctatacttgtgatatgactggactatatctcctaattaaattagttctaatacgtaaatattttaaggttgtgttggatcgagagtcgtcgctatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaaaggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgacataagctcatttcaatatctacattgctattcaaaacgtgctaattaacctcttatttattaaacagaaatatagagctggcttcaagatctcacccatcaacccccccgctatcagaggcgaattgtgcgcctttattcttgcagaaataatgaacaaaaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttttccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattggggggtgatgtatctgtgatggatctgtgactagaatatatctgtgatgtttctatttttcagagggcatggctagcaaatcctgaggctagccaatatttagcatttattttttttctggaattaactcatccgtgacgggtcggaacaaaaatccgtcaaaggtaacataacctatgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttggacccgtcacaggtgaccttggccagtgtagtgctccctgcctctccctcccctcaaaccttcacctgcttcctcacctccaacaaatctcatgtgtatatattcctaggtatgcttcttactcttgttaaaccgtatatgttcattcaatctattggcctctatgtttcgtttttttttgagaggacctctgtgtttcgttagtcatgctagattgatgataaattgatctgttcctgttgtcccaagattattgaagagatttgatttgggttcttcttcaggtatttactgtccctgttcaaacagattgaaattcattcgatctttaaattttgttagatgagccaatatggcatcagaacactaagatcacatgtatgcataccaattttatatcattgctgcacctataatttgttttattttttgttttatttctgaattccggttgcaaatcattgctattagtagattgcctattatcattgtagcagcagctatgggctaccgctgaggtcaatccccagggcattcattcccacccaaatcagcaactacaacatacatgtacttccaccaatatgacacatctgtcaagaaaatatcaacaatatattcagtaatgcataattgcctcacattggttcatggtcactagcttttccagatattagtcatgtttggagaactagctaagagttattttgagagctattttttagtataaggaaatagtccttcaataaaatagctctaagttatttagatccaagggctattttgagagctatttggcttttaatgcaccttttcatggagagagatagagagaaaagacactttttcagtaggccccacctgaaatagccccaattagcactttttgggtgggatagtttttttgggtgggctatttccaaatagccctcaaatagctcacctatttggatctttttagctatttgggctatttgagggagggctaaaaaatatcccttggatccaaacagggccattgttatatatgcctatcctaggatacctgctttgtaagtaatttcttccataacaaaactatcagattttcaccaattgactatgattgattgaaaggtcaataccgtgattatttcagaagtgaacctaattcaggtacatattgttccctggatctgtccatgctaatcattgtttgctatatgatgttcatactttaattcaggtttataagatacaattttgtggttgacgtaacttaattcttcaaatttctttttttttctaattaactaaagtataaaggatgttctttgtcacagcacaattaaacattctccgaaacattgggagattcatcaggttagtgcaactatttatcttcagttctatgaattctttcagtccagaattatacaagttattttgtttccatcattacaatatttccactctaacaagtggttagtattctcaggaaagagaatgttattatgagatagggaaatttcttatggtttatttagacatggcaactgtattttgttacaagataaataaaattattttatggtaaagggattgcacaatgttaatcttatattcagtttaggggaagaggaatcataaagttagccaaaggccacctagatcattagcatgaatgcaaaacttgtcacgggaaaggattttgtggacaagaatcgggatgaatggagatagattggattatagtagataaaatatcgaggaacggtcctgaacctaaacggcgtgacgctctccgtcgcactgagaagacaggccgatgggcactaagataaatcttgatctaatgcctaattgacctgggataggatccctccttatatagatagatgactacttaatctaatcctaacaaacctcatctaatcctaacaaatcctaactatccaatgagcctaggacgcccgacccaaagaccatgacaaaacttttaacctctttagattttttttcaacaaagttgaagttcaactgatacgaatcaaaacgagacaaaatatttttgtcttttagtaggttacacataattacttagctcgacgaataacctctcctacacaaattaagctactgtatacatgaaaaatttctgcagccactaatcttctcagttctgttttgttgcctaccattcatttggaaccattgctctagcccatacctatattcgttcaattttacaaattttcattagggtcccagttccatttaaaacactcatgctcctaccagcagtcatgactagcatgtcttacataaaaaaaaaagagtctcttgcattgctattactatttgagatattctgtacctaactatactaatgttgattatgttcatagatttcatcctatgaattaataatggctactttttgctgaaataaaatatgatttcctatgtgctttctattacatctatctgccacctccacatgtaatatcctccatttctaactacgaagtttcgcagcaatgcgcggggcatcatctagttccttatactttttacaccaatatggccctttgcgggataaattccaaattggtagcattactacttgatatattggtttcaaggacttgatctctgtgaggaaaagacataagtggctacgtagctggtagcggagccaggattaattttcgtcatgtggttcagactctgaattagatgggatgattagaaaaataatgatatttatcaataaattatcaaactagtttaatttgtatggtatagatttgtggaagttaaaatctaataatacaaatgagtttctaactttcttgaacagctttcttgtttgtgtttgaattgtttttatttttgtagtattaaaattatatgtttggtattgtgtaaaaaccacttttggggtacagacgctacctagctgccctccgccactgtatgtagccttcctttctatgaatctagtctctactattataaaaattaaagatgtttttaccgatattttggtacgttatccgtgtatgaataggtttttaaccatattggaaaatacagttcgtttacttttggaaatacagatcagtatttgagtcgggttttaagttcgtccgcttttgaaaatatagaaggagtcagtataagaaatatcttaaaaaaactcgcatgctaacttacatgattttctagaaaaatatatatcgaagcaaattttcatagtgaatttcaaggtgaacaataataagattaaaatagccttcacccgttgcaacgcatgcatgggttttttttctatagtatatatatatatatatatatatatatatatataacatctaagtatataaacatattgcatccaacaattgaacacctacggtgtatttactaaaactcttataaactagttcttcatcaattcatgacaagagtcagcttggaaggtatagagaaacacaagcacgtacgccacccttattttgattcgcttgattgatttcgcatctccgtctccaccatgactacaattgcagcttcatctaatcatgttggattttgttccacaacggattacatgtgtgagccaattgtgccagctagcagcatgcatgtctcttcaccgttcatgttggagaatacaacgtgatcaatcagctcgaacacaaatggtttgtattacgtatttgtgtatgttttgggtggtaaacctgattcattttcttctcgtctgtaccactgccgtgtctatacttagcaaagttgaagccctggccccattttcatgataaacattggtatataattaaaatatgtggaagaaaaggctacgttcatgagcaaatactacatgatatcccacgcgttgttgtgggattttattgattgaattagacatctaacacacgagacatatgatgtgttacaaattctagtttaattttagtgtagtataaattacatatatttctatgacaaaaatttgaaggtagaacagcattttttgcgttcaactttataagattagtagaagtaatgcaaagggcaatatcacatagtccaatagggaaactaatatatgacaacatttgtaagggaaaaaaaaataaaccgacagatattagagcacaaaatgcaataaaagaactaatgaattactattcaattaatgtttttctaaaaaaatacaattctaaatcaaactgaatgaagaagagatataagatttgatatttgatagatatatgttgaaatattgtgtcgatgtatctagctttaattaataatggttatagtgagagaaataagattatttagaagcttaagatgccacttaagattaagatttttatgtggtacttgcttaaagagattgtgctaaccaaggataatttggcaagacgaaattaaaatggcaatttaagatgttatttttgtatgaaaaatgagactattcaacatctttttttagagtgtcattatgcaaaatttgtttagagagcagtacagttctctcttgatttataccttcctactaccatatctaatatgtttgatggttggcttttggggatagacaagaagctgagtaaactcatacttgtaagagcttctgccatatgttgggctctgtgattgactatgaatgatatggtttttaacaaatcaccatctatctcatatatgcaggtaattttcagggcaacatattggctccgattttgggcacagctgcaaatgtgtgaagatgatcgagagcttatgaaggttgcatgtcgtaggtttgagacaacggtcatgcagctctttgcaaactatggatggagattcataaatagactagaataaatatgctctccttatcttagtttgatcttttattttgttgggtgtgtttaattcatttgaactacactcagtgtttgggtgttacttctgtaataattggctgtagctctgatgagcaaaggccgggatgttttattccattatctaaaaaaaataatcggtacatatatgaactgcgcataacaacaaggctgatgggatttctccatgagagtacacatactcaatggatgcgaatacaaacgtatatacggctcatgtcaagatatatttctcaaaggttgataagcatttgtcaaaggtaaaacaccgagtttttttcgaacccgtaacagctttgcatattaattatattagaagaagataaaatttgtacaaatgtaatcaaaggtaaattacgggagtgtttttttttcacgatagagccgttaacatatgattaatcgagtatttaattattataaaattgaaaaaaaaagatcgacttgaatttttcaaagaaatttatatatagaaaatttttatatgaaacacactgtttagagatttggaaaacgtactcacgtagaacgagaaagttgtcgttgtaagcttctccctacgactcggccttagtctaggagcattgagtcgtcaccactcaattctgtcacaacacacaatcaccttactatagacaataaaaaaaaattatgccgaaagtaaatctatgagttttaataaaaaattgcaccaacgagagaaaaaaagaagaaacatcggtaccaatcttataaaagggaaacagttcttaaaagagtctcgttgcaactagtaccggtttttatttttaaaagccagtacctataataagaaccggtacctatgcatcttagaaaaagtgccggttattatttttccaccgtgtgaagatgggaaaaggcatatatgtgtcggtttaaaataaaccgacacctataaaacaggtctccgttgtaataattatgtgtttaagtgctaaacaacatgaatacatgatatccataatataaaaatacagctacgcaagtgtgacatgagacggtaaaagcctcagactaagaaatataggttaattaaatgatgaattaggccattggatagaccaacttttgttatatgcaatagataggtcacatgtgttggctatttcggattatctggaaaacggcctatcggataatccgtatccaccggattttagagataccatatcctatactatatacgttggatttctaaaatcctatactatatcctcgattcagacgaattcggagcggatcggacaggatattatccgatccgttttcacccctaccataaggagcacaatatgtccaatgtccccatcaacaagaaaaaagtaccaatctgattttatttcattcgtacattcgtacgacagtagctgcatccatatcatctggtccctctgcaattagtggtactgaaatttcacttgtaaagctaggcaaagccctcgcagtatgttctctcggaaaaaaaaatcacgtgtaaaatactccttccgtgctatactagaagttgtttaagttttcttttagtgaaacttcttaacgtttgatcaaatttatagaaaaatttagcaatatctacaacactaaattagattcattaaatatataaactttaatatatttcaatattatgtttgttttatttgaaatattgatatattttttatgaacttgatcaaacattaaaaagacttaactagaaaaaaatcaaaatgacttatgatatgaaacggatgtacactggtggagaaaccctttttcctcccggttcgtaacccccctttagtcccggttgtccaaccgggactaaagatcgctatctttagtcctaggtgaaataaccaggactaaagatcgatctttagtcccggttggtaacaccaatttatgggcccccttttcactttcgcaatcctccttggcgtcctgcaacatctgaccaagatcatccacaatgtcgttaccatcagcatccctttcctcctcatccatttgatttccttaaaatccagcgtactgagcaaagtccgtaatattgtcgtcttccacttcatcttcttccatttcaaccccttgctctctatgggatgtccaacagttatagcttggcatgaaccccgactcaaacaagtagaaatgaataatcctggatgcagaatactccttctgattcttacacttattgtatggacaacaaataaaacccttatgcctgttagctttggccactctcaaaaaataatgcacgccgtcaataaactctttggaccgccggtcagcgtacatccattgccgatccatctacatgaaataaaaaaaaatcgtacacaaataattattcgtacagtaatgacagtcatacaataatgataaaacaattacaaactctttcaacactcgtacagtattggcatatcattattcatacaaaaattataaaatattacaccaaataattcttatttactatttctaaagttttaaactagtattaatgtgttgtacttcttttagttttcattttagtttgttttctattatttaagaataactttcactaaattaatatattctttcttccctacataaattttctctctcatcaacttacaacaaaattttggagacaaaaaagtgtgcaaaacatagctccaaatgtaatatgacaaaaaaaacattggagtatgaagttgctaaccttctacgcacctccgatttgtatataatcaccaaaataaattcactagaaattttggcatgacctcccctcttttttgaagaaattttaaagcttgctcgggctgaaggaggaagaagacatatatatatataggggtgggacttaccaaccgggactaaagatctcaggggggcctgacaagtcctgactgcatttgaaccgatactaaagatcatctttagtcccggttttaattgcaactgggactattatagaattcggccgaccgacaaaagatgatttctccaccagtggtagtagcatccatatgatcaacaatctagctaactggtgatgagtttctctgacacaatctaggagccgaccagccaatacttttccagtgtttgcttcacaaccataacctaccaatcgatgccacttcgatcttcctcctttttcacagtttgcccatccagagtcaaaccattgtatctgtgccgatcaaccctaatctgtgcccatcaaacctaccacctgtggtcacttgcttccactacacggccatatggatcatcagcctgttctcacaaaaagaaagaacaccagcctttgaggccgattgagcgatcgccgcttgccacatgccgctttccattgcacgctgagtgctcatgccaccactatatgtagctcatgagctccacttgaatcacacactccaagtgatactcgcaagtcacaagatatagaaagaacctagcttccacacactaattaagcacaacaatggaagccaagggagtagtggtgatcacccttgtgctctcccttgcagcggctgcaggtgcggcccgcccgaaagaaaccacgatgggtttgacccgccgtggattggcgtctgagccgatgacgcacctacacttctacttcaacgacaaggtgagcaagccgtccccaacatctgtaagggtggtggactcggtggacccaatttcagagtcattatttgggtagttgtatgtcatggatgacgcgctgaccgaggggcctgaacctgagtcccagcccgtgggccgggcccaagggatgtacatgagcacgggcctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgagctactgt

SEQ ID NO: 41158 - DNA, 1506 bp, Oryza sativa
gagggggatgagaggtggaggagcacgagccaaagataggctgtgggagcaggaggcagccgcgctccgtgacaggcgagcgagctggagaggagaggtgccaggggcaatctcgctattttgaaaaaaatctcaccttttttgacctagaaattataaaatattgcatctggtttcctgtagctaatcacacaaattttgtaatgtccatcagccgtatcactttttgcgatatctcacaaccaattacaagttttttaattgtcctgtagcaaatttttcctaaaaataccatgcaaaacatgtggcttttgtgcctttcctggcacagaaagctctaatccaaatataggaagaatagattaattatacgacatgcttctatagtttataaacagtatgtttttcataaaaaacattatagtaaatttctttaaaaaattaaattcgttttaaactttataatagattaatttttcgattgtaccctagattacaaaatcattcagctattaaaaacaaggaaagagtacgaattaccccccgaactatcgcggtcatctgaattaccccctaaccaccaaaccggatattattcaccccgaactatgtaaaccagacgaattacccccctcgacccaatccgcggtagttttggtctacgtggcagtccattcagtattttatttattaaaaaaatataggacccatctgtcatactcctatccaactattcctctctgtcttctctcattctctctcactcacgcgcacggaggcaggcgggcaacagggagtggcggcggcggtggaggcgagcggcgggggatgaggcggcgagcggcggcggggtgcggcggaggagacgagtggcggcggggtgcggcgaaggagacgagcggcggtggggtgcagcggcggcatcgcgggccgcacggagccgcctcgcctcgacgagcgctgccacgaccatggtgaggcaggccgttgccacgtccggccggtcgaccaggccggcgtcgcgggccacgcggagccacctcgcctcgatgagcgccgccacgaccattgcgagataggccgtcgccatgcgggcgccgatgcgttggagcatcatgatgccgccaccgcctcgcctccttcgcccccgccgccgccgctgccgtctcgccgcgctcctgcctccgccgccgccgtctaaaggagaagagagagagtgagagataggagagagaaactgataggtggggcccacatattttttaataaataaattgctgactggactgccacgtagaccaaaaccaccgcggattggatcgagggaggtaattcgtccggtttacattgttcggggtgaagaatgtccggttttgtggttcagggggtaattcagacgaccgcgacagttcaggggagggtaattcgtactttttccaaaaacaacaataaaccctatacgaatgaggattccctgactttgtgcagtttgtagttgtgccactg

SEQ ID NO: 41159 - DNA, 27694 bp, Oryza sativa
  unsure (1)..(27694): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataattttgtagcttaattcagaaagatgacatatttgaacataaatgtggggatcgagactaggattaaagatttctcaaagaaaaaaaaagagtaaaattaaaagaggagcacctgtatgatgaaatcgatggggaccaatagggcagcaacctgtgtgtatttctttctgcaaagtgatgcgaaagtgaagcaaaggatgcattcgatacgacactttggactattgggcacactgcactttgcagggctgatcaagttagctaccactagattagcaaaagcttcctccccttgtttagccctgtcaaagatttgtgtttgtttagctagttaaacctgattagtattatttagtagtactttttttttcactgctcaggaggactactcctaggacagtaggacctccattttcagtgacatgcttatactacttctgttttaaaatatagctatttctagcataatatcttgtcccaaaataaagttatttctccacatacctcttcctctcatccaatcacaaacattctttttttttttgaacggaaaaacagcactagagtgccttttcattgaatagagcaggagaaaatacaaacccctaggggtaaaaggaaaacagagaaccactatagaaccactatagctgtatagtgtgcgagattaactcacgcaaccacttagctcctgctaaagccccaaaggctcgcctcctctttgattttcattagtaggaagttcgttgccacctatttgtgatcaaaaatccgccgattcctctctttccaaatttcccagacgactaacagaatgagcgatcgaagtccttttctcgggacactaggcgtgtttgcaatgttctcccaccactgtttgactgactgggcttcctcccattccgttgggtccatctgctgatagcccacccatgcagagacgaggtgccaaatcctcttggtgtatctacaagtggcaacaaggtgcaatgccgtctcaatctcgcggcggcaaagagggcaacaaccattgttctgccatcccctggtcgcaagccggtctgaagtccagactctgttctgaatgatgagccaagcatgaaatttgcatttccccgacgcccaggctttccaaatcaaggaattgaattttgtgctcggcgccccgcagcactgtgcatggtaagccgaggaggccgtgtagtgcccgttgtttgtgaacttccaagtaatctgatctggttctctaacgtctaagtgcacatttcggaccacttcccacagtgcggctagctgttcgacaaggtcgattgtgatagatgattgtgaatcaagcttcaaatcttgcacccaggtgtcctcctcctttccttgccgaaggggttttcctctgttttttgagatcgcatagacaagcggcatgaggtctttgggtcttcgcccaccaatccacgtggactcccaaaatcgcaccgtgtttccgtcccctattgttatgtttgttgaggcggcgaagaggttcctatctatttcatcacatggcgtctccagccccacccaaggtttggtctggtccttccattcatgccacaaccatctcaacctcaaggccctcgtgaatttgtccagatttaggacccccaatcctccttggctggtcggcatgcacgtctttgtccaattgaccttgcatttccctccggtaataacacctgtgcctgcccagaggaagcggcgccgctgcttgtctagctgcttgagggattcctttgtgattttcagagcggtcagaaggtagattggttgcgccgttagcacatatttgacgagcgtagttcttccagccgctgccatattttttcctctccagcttgctacccttccggaaattttgtcaaagataggttgcaagtccaccttccacagtcttcccagagctagggggaggcccaagtacttgatggggaaacttgccctcaccacagggatgccctcaagaacctcattcaactcgatgccgccgcatctgatgggcgccacttgggatttctgaaaattggtgacgagcccagttgcagtgccgaagtgctgcaggatgtccgtgaaggccgtaacatcgcctcgggtgggattaatgaagatgatggcgtcgtctgcgtacattgagatccttagcctagttgttctcccccgaattttcgagattgcgccgagctctgtagccttgaaaaggattcgctgaagggggtcaatcgcaagtatgaaaaggagcggcgatagggggtcaatcacaaacattctgtttcatctctttttctcttctcaaccaatcacacactttctctaatcatttccacctactttcttaatactcgtaccaacctaaaaagtacttacattttgacacggaggaagtactaacaagataaattaacggttaagatcacttatatcgatgataatactaaatagtagtagataggggtactcgtttgagatcaccataaaggtaagtcgatcatttcattattcagagtacattttaagtaaacaaaataactataggactctgaattttcttttttcaggagaccatccatcctatgaacttgaaaagattcaggacacttcatattacatatttatagttgcatgcgtgtgttagttagacctaaaccactgtgctacttaaattttgcctatggcaacacgacaaccagttgctatcttcagggcaagcagcagagagaggccccaaattcttaccagattatttgtcctgcctttatgtaaagcagcgtcgtcgtcgtcacagtggcaaagatcatttgctcaccagctcgatgcgcatttcgaactgctgcctgcagccagccaagcccagcttcgtgacacacatgtatttatttaaaagatgatctgaacaatcgatgagatcgactcctttcccagacaaatgcattgccccagctgctactgaagctgaggtgtcgtttaatccctgcactaatctagctatgaaaaaacaaagctctttgcgtaaagataacctaatcttggtcagtgttaaagcaggcaatgattgttgatatattgagatagtgtgatgacactgtggttttgatggatctgtgcataatatcatattatcatgggagagatatctttgcgtaatctgttcagtttggggctttgtagattgtatcattgtggtgtttgcctttggcaggtattatctctgatgatggatgattatacactgattgattaagatccagcttagcaatgtgctatagtactaaaactaactgaactgctgaaggtgataatttatttaatttgcaaaagatgagaagtgcaggtgtggtgcagttatcaagtttctagtatagtttttcataaaattgttgagtttctactatttgcaacagtgagctggtggccggccaggcgctctccttttctgcaaaaaatttaccgtgaccttaaaaattaaaggcataagggcatctccaatgtgcatgtaaagttaaccttaagcactaaaataatatttgtagtataactttatgtattgggaagtaaactcacaagagaatatatggctatggctaaccttaagagcaagtataataggaggctgtaagtcggctaaatgctgaggtgatggagagaagagaggagagagaggagaagcgggctgtaaatttacagccggcttggacgcaagaaccaaaaaattctgtgagagagacaaatgggcactatattaattataaatagttaactattatatttgtaggctaagaaaaaattgcaaagaaccttataaccaacaagtcggctgtattattagccttgctctaagcttagagctagccataagaaatataaaattaatttatatcttttcaatgtgtatgttggctttgaatcttcatgctaaaatggacgaatacaatttgttttccttggtgggccacaccttaaggtgaagaagagatgttatacattatagcatttaccacgagtaaaaatatatatggttgtgggtttcaccttatggttatggtgtatcttaacactgaggataccctaatgcggggacatgaggagtggtcttgctaggccatgtgggagccaacttatcacgtcaggcgaagcagtggctccgcatgaccacgcgtgccctagagaagctatggatggcttcccaaggaaaaacgttccgaagatgaagccatgctcaggtagctccattgctcgccgtcgtggttccaatctcatcgtcgatatgttctactgcgacctttgctcaaggctgctttgttgctaggacctttgcccagacaactccaccgtcttgtaatcaacctggttactccaccatcggtgccccttgatttggcctgatcatattcgtgacctgatccaatgagcacatgaccatattgctaggagctcaaccaccggaatctagtccgctcggagcgcggtggccggagtaggattgtaggaaacacaatggcgattgaggtagagatggacgatgcgcatagtctgagaagggagatgttggagactaggagaggatagcaatggtgattgaggtgttcgggagaacaaggaaacgacagcaccagtatggtaaagcaaccgacgtgaggcggacaaagaagcgaccggagaatggaggagaggagtcgtcaatgaacatatggaagaagggactgatcagagggggaggggttaggaaaggaaaaaagaaaagaaaagggagggtgactgacaggtgggtccacaagaagcttaagggtctatatgtatttcttttattataatagggtttaaatcaatttataaaaaaaatattatgagagctggtatataagctatccatggactcagccggtttgataaatgataatgaacattttcttcaacatgatatttttaaaggcatggatctaatcaaccattttcaaatttcaaattttttacatttgcatgcgttacaatctgataaaacgctgattgaaaccgctcttccacatgcaatggcagcttttaccagtcaccaccagtctaccacacgcgcgtgcatgccgacggacggtccgtcctcccctctcgcgcacgacaacagaacaagagatggggacgagaaagaaagagaccaatgacggactcacactctcgtatatcctccctcctctcctctttcccagtggaatccatggctcctctcgtcgctttcgtccctgcccatctcacacgcacgcacgcacatcacgcactgcgtctgcatgcatgcgtctggccggctccctccccctttcggcccggagaaaggcggagtacgtcagtcccatcaaaagaagccccgagtgcgcgctggatcgagagccgcgtgacacgatcgtcgtcgttgatccattccattctcgttggatgatcttggaaagtcatgatatgatgaacgtaacgtcccgttcttttctgattaagatgtaaattttattttcgtttttatttgtttgatttccaaactgctagaacagtgtatattttttcatcttaagtagaaacgaacatcacctaaaggtcctgctcgtcatggtcctagttaatttttacttccaaattttatactagtaagtggtaaacaaaattatgaagtgggtttttatgcggcagcgttggtaacgaagattcgtgaacggaagccggccgccattgatggaagtggaggatggcagtggcggtggagcagagtatgccacatgccacgctttgaaagcctgaatcaatcgggtattgttcgatcgatttgtgcgttctctgaagaagaatgggtggctctttcagctttggctgaatctccatcgatcgatcgatcggcaaggcaatcgatcaagctccccaacgttccgaaatgcagccgtcagaaaaagagggaaaaaaataaaggagttaaaagcgactttggtttggtcaacctggtaatcaagcactactgatcatcatcttttttttttacgtgccttgatttgtgtggcactctgccatggaatttggagctctttctttcacattctatctactgaattctgtaccggccaaccaaccagcaatgattgatttttttttctggtgctttgttgtacagccacaaacccatgttgttttggacagatgtgctatccaagcttctgaaactttttaggattggtatttgtaaatggaaattgtatgagtaggtttagctcgaaaagaacttgctttcctgatagcattatgatttaggacaccaaagttgtgtttgggacatgagagagtaggattcatcaagaaaggaaaataaattcagattagggtaattatccccaacagaacatatttgcatcatgtacaaacatggcatgatgctccagtgtccctttgatgatctgttctgtcaatcatttcagttcttcaactaccaaaccttgttcattgcaggggaactcgagttcaggtgttggcacctaacttggcaaatctctagcacttgtcttactaccaactgcatctgcaggaaacaatatacaaatgtgcaggcctaataggccgcgaatctgaagatgtatgcttgcttccaacacataaagctcggattccagctcctgtgttctatgattgcggcgatccaatgatcacaaattcggcacccaaagagcagcagtaaaatacacaagaatccttaaaaagctatctgcaaaggatgtactttgcatcttaaactgaatatataatagtacatcaccctgcttttgattaataaatacccctctgtatgtgccaactctaagatgcaatgcaaattaaggtaccaacttacttcccaagccagaaacaatcttgacctcagtaaaatggcctgagtaagattggtgatttcttacagtgacttggtacctactaactgaaactctgaatatgatgcattcagagctactgatcatcttcttctctgttgagagatgctgaacccaacacaaccaaactgaacatcgcatcagctgaaaatgcacttctgatgaaatgatgagcatgaactctaaaaacacagatcagttcaactggccggccactgacgatcgtgtcagcttctgacttcggcgatgctgtgcagtgatgggcgccattgacgatgcctagaatgtgtcgccgagctgctccgttggccgtctctgtcatgctgcaaaccacaataggatgggtggcagatgagtaatcagaattcagaacatggcactttgttaatcttttatatagtttaggagaccttggaatcaaatcaaattaaagataaagcaaaaattggtacaatccaaagaattagtgttggatgattcttcatgaccaatagttaatttttaggagttaggagtagctgcaagattttagactattgaaagtctggcctttcttggactttctgctatcatcttgtaaactagtaggttccatattccccatgtatctgacatcttacaagagaatgtcaaacttgcatgtttttatttaggagatgacaggaaagaaaaataagtaaaccacccatccatgcctttttccatgtggtgtgaggaaatcatggtatggcacacaaggttgttgtttaaagcttggtttgggaataatttgtccactaagtacataactaaacagagccattatatcatgtttaagagtacattattgctaaacatattcctggtatcatgatcaggtattatatgatatctataatggatctggttagttggttaggtactagtgtgtcacaaggagggtggccaactaaacatagaaataacagttgggttgagcaatagcctaagtaacttacttgcctcataatatactccaaatttagaatgttaaccaactatgtgctcacctactcctagactcctagtgttcactcaaccaaaagaaagaaattaattgcattggaacatagagctaaaattcaacatgcaaattccaatttaaatttcaaacatacaaaaatctgtcccttttgctcagaaattgagttctggatactttacttatgcaattagcacatatatcaatcaaattgttgcttccattataggagtataattaagttgatcgaatagtaggattataggagtaaattggccatggtaagaacagctgagatgatgaaaatcttgcagcaagaagattgtgacaaacctgatcaagattctcatcgagctgcgtgtggtcgtcgccgccggaattgatcctaactccggcggcgacggcggcggcggcggcgggcttggattccaggtgatgatgctgcgccgccgccctcctcgacttctcctccttcttcgcctgcagcgccctggtgacctcgtcgacggtgatgaggcggtaggcctggccgaggagcagcgtgtcccgcggcttgagcagcttcacccgcgtcacccgcaccgtgccggtgccggtgccgcgccgttcggcccgcgccggcggcggcggcggcggcggtggcggccgcttctcctcggcgacgcggagggtgacgagcgcgacgtagtggcccgggttggcgcgcatgacctcggcggcggtggtggcccagtagagccgctccacacgaccgcccgggtgctgcaccaccaccgtcgccgcctccgccgcctggcagttccccatcgagaaccgagaacaaaactaaagcttaacttccttcctccttgctggcggcgagcggcggcgccgcgtggcggcgagagcgcactggtggtagtacggtcgtcgcgggccgcggcggtgggcggtggcgcgacgcgacgcgacacgagagcgatgcgatgcgatgccgccgttggcgctcgcgttgggaactgaggagggtgaccgtttatatgtcgccgcgccagcgcggtgggtcatttacggcctaccgctcacaatttcgtcctactttttttaatgttttttgaggacaaagttttgatttttttttttaattaggcaaatattgttcaaacttagcaaaattttgtttaagttttttttttgttttcaaattttagccctctataattgtttactcatccagaaatatagttatatgctggcgcatatgcatgactttactctaatccatttgtcagggacttaaataagaggatcgcatcccgtataattgtggcatcacaatataaactctggtgggtttgagctatacaataagaggttaatgttgtttcccgtattcgatcgtttacatttcaacattaacctcttttttaaaaaaagattaataacccggcctttacatccacaaccaaagttaccctctcttttactctcttttacatgactgttgtttgggtttacttgaaaattttacttttccatgtcatggaagaagattttgcataagaacaaaggatggttctaaagggtcggtgatcatacatcctatcaatgatctatgcctctatggtctaacaaccaagcatgcagttttcaagaacacttgatcggaaagcaagaaaaaaaggcacaagacaaatgaaaagttattggcgatggcgtgtccagatactactttaatttctatttgacatctagtgttggcaatttgctgtagtataataaaagaagctttatgaagattatttaacttacttttcttggatacaaatagccgttttcggcgcctcatatctggaactgccttttcgcctcgttgataataatttttttagataataatggctgttgatagtagtgtctgttagtatagcctgtagttctgtaattattttttcccgttatatcgatatgaaacaccgaatcatattttttgtttgttttaaaaatatgtatagcagttgttgttactttctactctctctgttcgatatcataaactgttttagttttgtttaagtcaaatttctctaactcgtacgagcatcgatctctcgtgtaagatgttttcttagcagagtaatactgattaattaataaatgtgtccactaaacatgaacaattcccttgtacgagcatctcgtataaacagtatacttaatttctcattcaagtaaagactttgaagccatcccagattagtactgtacggtctgtaccagagcttacagccacaagcgttaccgtcagatttcagaagtactgaagcaaatgtcaatggtttcactctgaaaactttaaccaccaccgatcgctcggagtacaagtatatgtggtttgttgagattgtatacgaaatactcttgttgtatgacgttgttaatttttagacatgacgtatgatcatttatttggtttgaaaatttagtgcaaacacaaaatatatttctcatgcttaactcatcatgtacgtgagaagattgaggactatacgcatacatgtagctactcgggtttcatcaatagcactacaaaacgaaaagacaacatcttcatttaagttttggatgcatgtaactataaatattttatcttatgtgaaaaaagtaaaaaaataaaataagacttttggatgaagagaatacttttaataaaaaataattcacaataaaataaataatacttaatatcgttattctaataaaataattggtcctatgttatagcctagaaagtcaataactacatctagatttcctgaaatcacacacagccgcaggcatatgtcatttttggatcttcccatgaacattttccccccatcaacgcacaatttctccgccacggttgggggatcggctcggccgccacggtggcatgaggtcagcgccaatgggcctggcgctgacacgcgctaagccgacggcctatttttggttaaagtttttggcaaggttagtttcgaaataagttttcgaaaagggtcaatttgtcaaaaaaaaagggcaaactcagaacaaaaattatcaggatccaatacatattaattatctaaactagctgggtggtccgcacaattgtgcggctagcatcaatacaaaattatctattttttaacatgttttttcttgaaatttattaaatagatatctcatcgtcttaagatttgaaagaccaaatcttatcatctctgtgtttctaattttatagtttttaaaagtcacaccagttactaatgttttacttctatcatcccttctttatttgcttgctcgatcgatctaccactacttctattcattctctttggaacctttaaaaattggacattatagcttttagagtttattgtcttattgggttttggtttttataatgtttagaaatctcgttaaatactgtcactatactcctctacatcttgttaactgcttctctctttattgttattggcattttaaaaatcaaacgcttgccttcattttttactttgtagaagccctgccaaaccgttaacggctttgccactgtactcttttgtgacttgcccgctgcctcttatctttattgtcattgagattttaaaatcgaacatgattattattggtttattttttactttttaaaagttttgaacctttaaaaattggaccatatagtttttagagtttactttctcgttgagtttcatttttataatatttagaagtcccgtcaaacacgctgctactatacttctttatgacccgtccactgcctcatctttttattgttactgagattttaaaaattaaacataattatcattttgggattttttttttactttgtagaagtcccgctaaaccatccacagctttaccactgtactcctctatggctgcacgttgcctcccctctttgttgtcattgagatattaaaatcaaacatgattatcattatcttttattttttaccttttaggcgtcccgccaaccgccttgactatgttggttaacggcctgtccatcattcctcgttttaatcataattgggattctatttagagttttgttagtagtttttagatgcccaatcaaccgtcaccactcaactctttacatgcacattgcttctcccctctttattatcatctgtcatttgtcatcgttgtgttctatatgtactttatttttttattttgaaaatttcatattttcattccgatatgttttatttacaaaattatattcctacttgaactcttatagttatttttctattttcaaaatttattttatttgttattctgatttttaattaatctcgtcatgtgttctggatggtctcttctttcaatagtctttatttttttattacaaattttggttatttataaattgtattcaacttttttctaatttcagaatttattatattttccttttttcctacggttaatgtggtaatttctagcatccggattgagtttttattacatttgtattttgaatttaaaggatttttttcaagaatatgcaaaagaaacatagaaacaatatagatctggtgataatgcacatgttcttttgctagtttttagtgtgcccgttaatttttattggaaggtgtaaatcactgttaaaaacaatgataggattatacgcgtatgcaaaagaaagaaacaatctagatctggtgataatgcacatgttcttttgctagtttttagtgtgcccgttaatttttattggaaggtgtaaatcactgttaaaaacaatgataggattatacgcgtgcggtacaactattttactgctgcctcacatgaaacctactctagttctgtttcgttttgctaagttatattcctttccaaatagagtctggtgtcctgatgctactactatacgccatactcaatctgagttgtatcatactaacatgtccgcttctatagtgcttatgtggaacaacagtatatttccaaaattttacgcattaaatcttaacccttgagatctagatttactatgatttagtggtctatatttttctctttttctccgattaatgtgggagtttctagaccccacagcgaacgtagtgccttctttcaaaactgttttaataatataataaatagatagattatttagtgatatactagaattaaataatttaaccaggatcccgaccctagttaatagtactacgtatgaacgctcctgtgtataaatgatgagattgtatacaaaatactctcaatggttttaatatgtatgatgccgttaatttttagacatgacgtatggtcattcatctggttcgtaaatttaatgaaaaaaaatatctcatacttaagcacttttaataataaaataaataatccccgcaaaaaaataataaaataaataatatttatagttatttcaataaaattgatggttatatgctatagcctaaaaaagtcaataactacatatagatttcctgaaatcacacacagccacaggcatatggcaattttggatcttcccataaacattttcccccatcgacgcacaatttctccatctactcgagataccagatgtgactgatcgagctcaagctagctcgtggaatagaagaaaaataacttgcagctccaagtggccggcggtgatgtgagagctgaattaggttgatcagttgagaattgaatgccaagaattcagtcggcaacagcagaagtccacgtactgctcaagggacatgagaattgaggattcataaatctcgtacttgagtatcaagaatcgctttccgacgtcgtcaagatcatcaaggatgtagatacacgacgctatattcaattgtactgtgctgaatttaagaggccatgtgaggatcggtttgtgatgtccacgtattcaggattagaccacaggcccggctagatacagatgttacttcagttttcgttagcacgttttttaaattatattaaacggcatatttcatgagaaaatttattatataaaagctatttttaaaatattagataaatctatttttatgtttaaagtaactaaagtttaattaattatatgttaatgattttcttttcatgcccgtacttaatttactgcagtaaacttgaacggagccatagtagcactgtttccaggctattacaaaactgtaaggccttgttcggttgggccgggaacggctgggatcaaggtccaatccccatggatcaccctggcgaggaaacaatctcggcccatatgaaattgtacgttcggttaagccctagcgtaaattttagcccggcccaccacggggtttccctgtgctgtccgcccgggaaaaaatcacctactctccagaggagcggaaaaattcctcgagaggagcggcggcgcaacgaagacccggacgcgacggcgggagcggcgcgatccggaggcgcacagctctctcctccggccgccaccttctctccggtgagcacgcttccttcccccctttcccctcctctttcaaatttagggttagggtttccttctcttctccctttcctgtcgtcgcacgcaccgtgccgtagggcccggccatctggtcgtgctccggcgccgacgccgacgccgaccgcgtgttcagctccggctccgacttgggcggcttgggcttgggcttgggtggcttcggcttcggcggcgccttgtccttgtccagatccggcggcggcgccgggacacgggagggttcttggacgccggagaggagaggagaaggaggaggagagggttcttggttcttggcccgtagcatctctgtaagactcgccaaaaccctgatgaaattcagagtcatgtagatgtagttgcagttgcaggtttgcgaaatctgaaggaattcagagtcatgtaatggcaggtgcagtacagaggagtttcttctttcttttactttccaaagttgcagggttcgaacttgattcttctcaagattgcaaaatctgaagaaattcagagtcatgtagatgtagttgcagttgcaggtttgcgaaatctgaaggaattcagagtcatgcaattgcaggtgcagtacagaggagtttcttctttcttttactttccaaagttgcagggttcgaacttgattcttctcaagattgcaaaatctgaagaaattcagagtcatgtagatatagttgcagacttgcactgcacagatttccttttttatttgctggtaataaggtgtcaaaaatacaggaagcttaatagcatcaaagtgaaactagcatacatatatctgtctaggggccgatcagcaggagcactgaagtgctaataagagttgttttttattagtcattagtttattgtgatatatatttgattaatcaatcagatttgtactggattaggatcctctgtgtttatctatagctagctcttgctcaaacttcagaatgtcacggtgtttagttgatacaaggaaccatgatgatactttagtggtgaaccttacatatgtgaaacttaaatagaagatgaaacttgcagggctttcctattaagagcatcgttttcaccgtagtgtatcatgttgtcgccagattcagacagcaaatgcagtcagtcctcactgtaaattttggtctaactgaagaaatgaacaagctgctttctcttcttttatctccatttcttgttgtgaaactggagcacacttgtatagctgtacttacaaagtagtgcttgttccagaaaaacaaaagccaattaactgtatttttgttagcttcctagttcatgaactttcaagtctcttttcatcttttgttctatcagactgttagcattccatgtagtgcatcagccttagtttggatatcaagtgtggctcttttctttacttgtctgctcttctgtaatctgtactctgcattaattcaatttgatatttggttgacaagaaagaacatatatggtgtatttctttttggaattgatccaatgttgttccctttttttttccagagatgggaacactgcagctgggtgactgaagctcatggtggcattagtgctaagcttaaacacttgcattcaatttgtagtttagctcttagctggctagttctatttattctaaaaaaacaactgaattgtaaccattttgattactttgtgaccctttcatgtatgcatttgtgaacgtacagcatacatgtgtgttttccctgtgctaaacaatgtttttttttactgtgtcctatggatttgatctgggagaatgcatattggttcattgcttacttgggaacgtacagctgctgccttatttttccccgtgctaaacgaaagcagggtttctatgacagggattagaaacgggcagggattcgaaccccgcagggattgagtgatatgggagggattcactcagtccctccctggataggttccccttgagatcatttcccaagcaaccaaataaggcctaaggaaaaaggttgcctgtagctggaaaagacggaagtcctttctatttcccaaacaggaatgccactagacaatgtgtatcaattttctttgtgagaagggtattttttacccagcctctacatccaactagatgatatatacaatctttttaacttagaatatagcctatcaaacagaaaacttagcccttaaataacctaatctgaaattcgctcctatagagattggacattgtatattataaggtagttggagtgttgtcggtggaaccggctcactggccgccggcaaggcggcaacactgccgtcaaggactccaggacccgttcagtttatcgccgcttgcaatcttaccaaattttaataacgcaacaaactcaacacacttcaatcattattatcttattaaattttgatatttctaaaagcttcctctcttaaaactctatcaaatcaaagccaacactatcaaaatttgaaaatgccaatatgtgctaaaatgtgacattaccaaaatttaatatggttgatttcggcaacgaagtgaacaagccccccagtctccgggctaccaaatggcatagcccttcttcatctacacgagtggaataagttcactttttttactctcttaactagtggtcgaaactgattcgtatccctaaaccacaatactggatatctcaaccttcccaactattaaaaccggaacagtttgatttcctcggtggttttggaggttcacgtggtattataattaaaaaaatttacgtgggacccatttatcattcacaccaaattattatatgacccacttatatgtggggcctacatgtcattctctctccttcccttcttcctcctcttccctctctctcatctccccccccccccccttcccattcggccttcctcgttgctcctcctttccccccaccctctgtctctctctccacctcttgctctatttgtagccgcgacgatgccgatgccaacaagctcaagcaggggagggcggtcggcggtttcgacggaacaggacctgggtgttggcgtggaccgagacagagccatctccaaccgaggaggccgaacggctacgatgcttgaggaggccattgccgccacctgggtcatgaccgtagcgaatcgcgtgcctcgaattgggaagggaaaatgagtgacgtcgtactcgcagtcgaggctctcgacggggcacacgtcgacaccgacgagggccacctaggaggtggtgttgaattgggagcggccggtgaggaggaacctccaccgccatccctgcacctctttgtcaccctcgtcgttctcgtgtgctaggtcctggaagaacgagaagccggaggagaggagtggagcttgatgtcaccctctggatccacctcaccatcatccccgcatgaatggtcccttggctccatcacctcagccactcagctccactgccgccgccgccaccgctggcgctccacaaacacgaacaagaaggggagaacagctctgccattgctcattggccttgtagcagtggtcgtagccattggagatcaccccggtgactgcgaggcaaggaggataagcagcaacacaggggccgccatagccaacgaggccatcgctctcgctagggcctacatccgcgagccttcgcgaggccgagtcactgccaccggttccgaggcaccctggtgggagctcgccgccgctgccgctcccctcgtcttcctgtcgccatcaccgccgctgccctcgtcctcccgacgccatcgccgttgtgcagaagaaggcggaaggggagagactcagcgagataagagggagagagagagagagagagagaaaagagggagaagggaataagatagaggatgacagatgagtcccacatgctggctcggtgtttagactaggtcaacgagccacgtcagcgaaagccaccctcaaaaccaccgaggaagttattttgtaccggttttaacagttggatgttcaagatatatggtattgcgattgaggggtacatattagattagacatatatttgagggattcaaagtgaacttatttctacacgagtagttcggtaattctggttcgacatgtgatcgattcgggatgtgcctcagttgggcctctagccctccacggaaataggccgaactaggcagcagtacgtagagcttaaagggaaaaaaagtacatacaaggtccctcatcttatcatcagattacaaaatcatccccaccgcaaaatcagatgtatgccatcattttgggtcctcaggcggttttgtccaacgtggtggctgatttatcgcggacccatatggccccgcatttaagggtgaccacgttgtcaccccttctctttcccatattctctcccttccacctctctctcactcttctcataatctgggctggcggggcgagtcgggaaaggaggtctgtcggcgtctgccgtgaggcaccgccgtagcgaccagctatggagggcggcgggtggcaggagtggagctaggagacggcggccggcgggagaggacagccaccatggcctgctgcgggggtgaaggcgagcactgcggcggtgggtcgccacccgtggacgatgcccgtggggaggacctgaactcgctctgagtcgtggctccttagggcggtgacgtcccgcacgaggtcggtggtgggcagcatccttgatgtggcatcgatggaagtgaacaccttgaggaggaagacaagagaggggaggcgcaagatcatggacaagctccgctgccgctcttccctgtcggctgcgccgcgcgcctccagtctccccagctgtcgtccgtcttcgctaccgagcgtcgtcgccgctcttctccgcttcagctgctggtcgcgccgcgcgcctctgattctccccggctgccacccatcttcgccactgaatgctaccgccgctcttctcccccatcggctgccgatcatgccgcgtgccttcagttctcccccggtcgctgcccgtttttgcctcgaactcgacagactcgaaccccggcgccccgacctgctcccacattgcctgttgtcggccgttggaccttgtcctctcccacttcaccccgccggcctcctccccacccgctagctgccttgcccagacgaggaggagaatgagtgagagaggaggaagggagagaaggggggaaagagagagggtgataacgtgatcacccttatttttggggcccacgctaactcaaccatcacgttgaacaaaactagggtcaaaaccgtctgagaacctaaagtgatctggttttataagctgagggatgacatgtatctagttttacggttgtgggatgattttgtcaccaatgacaagaggacgaactatgtactttttccgagcttaaattggcctgtaacgacttcggccatggacaagtcggcccagtgctttatctaaattctaggagcaaaaaagttcactttacgtccatatggcgtctacatagcactaaaagctcgtagatggtttttggctacggaacaccggctttgtaagtttgagtgacgtgttatatactccagtatagtattgcagtttaaggataatttgaactcgacgagtcgacgttaagatgagggacctcaagtgaacttgtacctatatattttctcgatcggtataccggcccaagtggcttccgatgacggctataaataggaaccaattactgggcctctttctccagtagcgcagaaggccctctccctcatctcgaggcgggaaccgctcccgaatattctagaagcttcgggaagggcgtcccccgcgcgtcgcctctctgctctcctctccaccctctcttcatggttgcgtcggcggcggcgggggcgagcggcgagccccaaaagaagctcccctcctggccctcgatggtccgcgacttcgccaccgacgagtcccacggcggtaagctagttccgacctgcctcgccgcggggccgccgctgagctaggctgctccagtgtttcgcgtcatcggctaggctgatccgtggcctccgtgcagagcgcggcatgtccgtcctgaagctgcggctcgacggcgtgcgctctgcctacgacgcggccgcggcggagctcgagaccgcgaagcgcgcgcgggaggacgcggagcaggagctcggcgggaaccaggtgcaggtcgccatcgccgtggtgtccatccacgggctgaggtctctacctctcttcctcatctctcctcgattacggccagtttcgcctgattcgattgggtttatttcgtttcggtgcgtttaggcgacgatctcgcacctccaggaggaaatatcgcaggtgcgctctgatctggacgcgcttaaggtcagtaaattttggggtttcatctgcggtttgcagtaatattcgctgttcgatttttttttgtttaaatgtgacgcgctgatttgcttatgtttctgtaacattgcaattgggaaatggtgctgcgctcttggtgtttgatataatgtctccaaaagggcaagggagacattgagaggtgagtacgggagttttgttgattgccctgctgctggtctattgaatgcattttggtgaatacttggttgcaaacagctaagacatgcaacttgctccttgcagggatgagttcatcagccagatggatcagttaaacacaaagataaggtaagcaatgtttgtcctgccgttgaatctgtgaggattttcgcatgttgtatagttgcacattggatttgctacaacagatgctgcatctcttgcttctttgcttggagccagcttgatactctaaaaacatatatgttagtctgtattaaaaccttagtttagggcttggataagggtatcaatggatgtattgtctcgatctcgaaattcctgatatgcatgaactaaggatcataagggaatgaaaatgcttcaggtttttgttactgggggactcgtggtaataacacctactttcagaattcagatgtttctttttttttcttttttggcatggttagcactcattagtatggaggttgactacctatatggaaggatactaccaagttggttttggtgcttccaaacaattcaacagtcagtagcactgattatttgcttttttatgtccatttgcatttgctttgctaggtgaaaattttcttataagaccttcttgttgattatcaaaaggtaaacaatattcgtcttgtgcaggaagttccagcagatggtttctgtagaattaaatggtaagaagtgctctgagctgtcatcaggagaaggtaagcaaggaagtcacgatgcatacataatgatgtcccagaattgtgtttgaagttgcatacataagtttgttactgagatgttcacctttccaggccaacaggtcacggattggagtgaggtcattgagttagaaggtagtttcgaagagttgaatggaaatgtgagcaatgctgattctgagaggtctctctttgaagaacaatatgaaaaagacgatcatgataaggttcatctctatttcccccaaatgctgcatcatatctcaaagaacactttgtacatgcaaataatgattatgaataaccacatctggcatttgaaaacatggagctaaaaatacttactactttctggggtatgcatctgctgataaatcgctataacatgggtttttagaacatttggactctcatcatctgcttgttggcttatcaaccgcagccaaaatttgaagtttgaaacttaattttagagttgatattggggttttttcattgtagtttatttttcagccttggcttattgagatggagggttttagtagttctttatctcgcactaatcaagaagctagtgcttaaggagttatgttttttgcattggtaaaaaaactgagtatttttggcttggttgcaggtgacaggcaaagaatgtcacagaaaaggctttaccttcctccgttccacaggcaagtttgagagcagcgatgaaggctctacttttagcgatgatgagaccattttagagttactgccgttaggaccatccacttcacgcattttggtggcatccacttctgtcaacaatggccaaaatatatatgcctctgaccagccactatctacattacctccacttcctgatttggagataccccaaagaaagggtcccttgtgtattgatggcgatgccaatgaaagtgacaatgatgatacagctacaaccagcagtcaggggtcctacattgagcttcataccattcaggatgagtatgtgataggaggtccttcttgggaagcaatgattgcgccaattactgggctcgctctagaggaggaggaggagttgatgatagagggtcaaatcttactggccaatgatcagaaagcgaaccgcctcatcactttgtttgatgaggaggaaagagccatggttcgaatgctagctgctcttggacagccattactgacaatggggacgtttccaacatcaaggagtttcctactcaaccttcccctgatatttgtttgcaaggagaaggacacagaatgctccatctgcaaaagcacgcttgctacaaaatatagatgtcatgtgcacgcctcccttgtcaacacgtattccatatgcaatgcatactgaagtggctcttggcacaacatacctgtccagtttgccgatatgaactcccagtaaaagacattcaggggtaacaaaaggtatgattactctcctctgcattcatcaacttcaagaaagaaagataggttcccaatccacacattagacatgaaatgtctcatacagaagtgatgctctagtgctagtggtaaaatcatttgttcttgttgtgttttaattcaaactgcattaggtacctatgctgtgtaggaagccaatggttattgtgatccttagtgaaaaaacataatggtgctgccagaaactgttacactttcattatcatggtactagtccagattgtattatttgctccgcatagcagctatttggggtgaaatgcttaggaaaaataagatggcatgattactttgacacttgtggcagatgaattatgctctacacaaaggatggaaaagtaacagagtattagagtccattcccatgagctaaaaatgaagcgggaaaagtgatgccagtactcttcctgatgtcccataagtccaaattactttcttcaccttctgaaatgattattgacttgccatgtaggtactcttcttttgaattgtgatactcccttgctaatcctaggatgtttatgtcttcttttgtagggttttacacatcagtaggcaactactttgttcctgtagtcttattatatgtacttgtctatattgtaggtttgctgattgaacagaaagaagtatcatgtactaagtaagccgaccagtgctaatccaggagaatgcactatctgatgataactggacatgccaatagagtgctgaactgctgatcaactactgcttttcttgtccagttttttctgatgaaactgcgatctagtattttctttgtttggtttaccgtgtaaacatattgattatcttccttgatcatgtcttcatgatatacattgcaacatggcctacttatgacctcctgggcattggcatgaaactttgaaagttcatgcattttgtttcccttagtatcagcaagattatggtccaaaaattacctctggagaattggcatcctcatatttagcttatatagtggcattcgtttatttttgagtcgaatagcattatgaatatatttgtttcttacttgtctcagttttacactgaagacgtgtacctcatgttacccgtctcgcacaccggacgttgtgacagcgacctgcatcttaagccatctatgaaaagaaataaagaatcaaccttaaattcatctatgaaatcagcgagatagcaaaaactggaagtatttgaaataattgagtcttgccttgatacggagttgttgatttcgcaggttcgtcatcgtcaatggccatgtgatcttggcccagcacctcctccttttcctcctattcatctgctaccagcacatcctcctataccgatttgttggcttgtcgcacttcccctactaccacctctttcgccgctacgtcggagcatgtcttgtgcatatggcaaggagcaagaagtcgtggcgcaggccttcttgttgctgctcacagcggtggacttggtgctgctcggtcctccaatcctcgttgaagtcagcacaggcctggatctccatcccggctcagcatggccaaatccggcttctctagcggcgatgctgagagaggactcagaggaagaggaggcgggcgcgagcgcacgtcggcgagagtgagggggacgggaggggattcagcagcggtggccgacggcgacgggaatcgccatcgcggagtagccgggaagggaggtggctcattatatgaggggcgcaagggtttggagagactgcgcgagtgcgaggtagggacgcagggtgtgggccggtgtggcccgatccaagccgtttcgcaagtggaccggttcgcaagtgtaaccggtgcatttaaaaaaaaaggaataagttcaccggagattactcaagttaccagcaagatttttttaagtcctttaaccataaaatcagaaatcttcacccctaaactatacaaaacggtctaatttaggtcccatgatagtatatatgcctggtttcgctgatgtggcatcatagttagcaaaaataataaaataaaaatgcggggcccacatgtcagtgagagaaaataatttgggccccgcttctccattttcctttatttttctcttctcttctcaacttctcacgcgcaggcgggcagatgcgggtgtgcggccgacggcggagcgggcgcggcggcgagcgcagcgggcgctgcggcgcgcggggaagaagcgggagagggggagtggaggcggccggcgccagagaaggggagagagtcggccggcgtgaccgcctctccccatccggagatgcggcggagctgccccaatggtggagcctctatagtctctcccctccaccacccgccgcgatgtcttccgctgctccgccgctgccgcgctcaccggcggcgacgcccgactcgacggcgtcaactgcccggacgcgcgtggtccgtgcgccctcacgaccgccgcgggcgccacgccgccggagtgggcggagcgccgccccgccgtgtccgtggactacgaccggggccagcgcgaggcccgcgccgaggtggagggcgtgggcgccgtggcgttccccgcgcgccaccgcctgcgcgtggaggggagccggtggcagcgggactggaaggtgttggaggccgccgcgcgcgtgctcgcgatcccgcgcgccgaggccggcgctgtcgacgccgtgctcaactgctgggccggccgcttcgcccgcggcaacttccctctcctcatccgcgtaagggcatcatcccacgctctgaagtatttcatgaattgaattgctgtgatatacatcgatgtggttgccatggttgcgttcttatgatttgccatcacgcaagttatcgattgcttgaaattacgaaaagcgtcaacaattctatcaatctagctgtgttgttcattcaacagccgactccgctctcagccgctgccgcggcgactgctgtatctctccccactgcgccggaagccgcgcccgctccgccgtcaccgcacacccacgtctacccgcgtgtgagaagttgagaagagaagagaaaaagaaaagaaaaaaagagatgtgggcccacatcattttctctcactgacatgtactgacatgtgggccctcacatatttattctattatttttttctaactaggataccacgtcagcaaaaccaaaaccagacatatatactgccttaggacctaaattagacggttttgtatagtataggggtgaaattttctaattttgtggttaagggacctcaaaaaacctcgctgttaagttgagggacctccggtgaatttattccccaaaaaaaacaccacggacggaaaattagcgcagcgattagctcgtatggatgaaaaattagtgcggattaacagtcgaaaaattttgtgacgattggaaagttgcagattttttaattagttaagattattactagcaaagatgtccgtgcgttacaacatatgaaattaaatttattttctatgtgtactttgtgttgtgcaccaaaaaataagtagggccatgtttagatccgaaatatttcttcaaacttccaacttttccatcacatcaaaactttcctacacacacaaacttccaacttttccgtcacatcatttcaatttcagccacactttcaattttagcgtgaactaaacacaccctaggttcaatagggcaaacctcaaccatggcggtgccgcggcggagggagcaaaaggaatactaatgagtgggtacgcacacccctattcagatcgggggctgccttgcttggccctactaagcacaccagcttgcttggccctactaagcacaccagctccccatccaaaaccatcctcattcattcttgagtaaatttcacaaaactacatgttttatggttcaagttgtagaaaaccacatacattttgacacttgccacttaagtacatatattttgggagtttagtttcacaaaaccacactatcgatgaatggattcacccgtgatatgatgtg

SEQ ID NO: 41160 - DNA, 11525 bp, Oryza sativa
  unsure (1)..(11525): unsure at all n locations
aatatatgtactcaagtgccaagtgtcaaagtgcgtgtgattttctgcaacttggaccacaaaacatgtagttttgtgaaatttactcttcattctttatttctgttgtttcatcttccctcttccctctgggatcatatatataatcgtaaattttagaaaaccacatatactatggtccaaattacataaaatcatagaaattttggcttgtgacacataacctaggtattatgatactaaagtttcacaaaccacaatattaatcattttaaatttgatctaatacatatttgagttgtacaatcacatctcaaatttatgacaaattatccatcgtattaatgttacatctattttataaaattttgatatagaaatatgtcaaaatagttaatgatatggttttatgaaactttaggaccataattccctgagttatgtgtcacatgtcaaaattcctatggttttatgtaactagaaaaaaaatgcccgtgcgttgcaacgggtgaagtctattttaattttattattgttatatggtttagtaaagataaaattcactgtggaagttcgcttggatatatatttttagaaaatcatgagctgtagttaggagttcgatcgtctcaagttagtatgcgagttttttaaaacagatttcttatatgatttcttctgtatttgccaaaagtgaacgatcttaaaaaccgactcaaatacggatatgtatttccaaaagcaaacgaatttaaaaaccgactcatacacggatgacgtaccaaaataccggcaaaaatatctttgatttttataatagtagagatttgaatcatattaggtggggttttatgaaatttagtgctatttttcttataaccctaagttgtctgccttacataaacttgcattcagttacagcactgtttatatcttttgattcgctctagtggaatgaatagaccagtactgcaatatattataaattataaacaaggggttagggtggcatatcacaaattttgcaaaatttgtgtggcttggttcaaattgtccctataaacaaccacagcttcgatctcggtttggttttaactgtgaggattatgcttgaattttgtttacttttttgtctagagtttgattaattactgaagccgctgcccatcacctaaaagaattacagaaacctgaattttcatcacctaaaagaattacagaaacctgaatttattggagtatgtggagtttgattgcaatcataaatctgttcttgttgcatcgcgcaggcacttttgctaggccacttaaaatttattatttcctttttgtcatgcacatgtttttgttttctgaaattgcttagctcctcggtacattattccgttcgatacggccctgtgacatcggatgtttgacgctaatttagagtattaaacatagataattacaaaacacattccataaccttgagctaattcgtagcctaattaatccatgattagcctatgtgatgctacagtaaacatttgctaattatggattaattaggcttaaaaaattcgtctcgcggattagctctcatttatgaaattagttttttactagtttatatttaatactttaaattagtgtctatacatccgatgtgacaggagggccactcacttgttgtcagttgtcacctcagagaatcaccaaacggcaaaacgtagggacgaatctccttcggtgagtctgcacacacatcttcgccacttcgcgatgtcaggcgtggggcgggcccaggattttcaacttgggtattcgaaattggaagagatatttttttccaacacaaagtctaatagttgtataatatataatggtataagcatgatgcgtgtctttcataggaagggagctgactcccgctcccttccgtccatcagggatttattcaaaacctgaaatcgagttgagttgaatggggttcaagtcaactagatgaaatgtttcttcgtagtgagcgaacgagttgtaaagtcatagattcatagaattgaccataaattaaatatgttaagcatattttaaagtacagtactaaagtattaattgacaaaacatgtcaaatttataaagcatagaaaatggaaaaatgataagaaatcttacaatttagagagacttttcgtttcttgatattttgaaaataagtgacgatgtctttatccttcactttcctcttcatgtttcaaacctacaaaacaacactacggtcttctaatttaagtattaaccatgctaactctgctaaatatgtgcactaactctgctacaaagcctcacaaatcagtgaatcacaagtttcaaagttcaattgttcatccataaaccatgaaccatccctgtatggctggattcaaatcctaaataaaatgaaccatcctggattcaactaggaactataaatccgaaactcctaaatcctattcgaacctaattaccaaaatgttcctaaccagttttaccttcatctgggtccagccgtctgggcgtttggcgcggtggagtggtggagaggacagaggaggccggagcacggagcgcggctgcgtgggcacttgggcgccacagcccacaagggcggcggcgcgtgggcgccatangggatgggcggatggcgcccttcgcggcaggcggcagcccgggggcgcgggcgtggccactgggtagccgtggagctgcagcagcttggcagccagctgggcgccgccgccatcggggttgggaggcgatgctgcgaccccgacgcgcctccgctagtccgctgtcgctgtgcccgtgcgccgtcgggagtcgggaatcagggtcgggaggccgccagggagaagatcgaatgggaaggagaggttagggtttcattattcccttttgctgatatgggctattgggccaatgggccgaccagccgaggagaggacggaggtgggatgggatggtgctaagtcgggcttctctgaagaaacaagtctattttacatattttttttcatatacatatgaaatatatattacatatatgaatttttttttgtcaaaaattttgggtattcaactgaatacccatgaatcatggtggacccgccctccgcgtggcatgctggcgggtgatagacaaagccgatgatggcgcgcgacgacacccagtcatgttaaataaagcagccggatggagtagggtattacacctctggctgaacctgtattgtattcaactgatctagagaagacaactacaccaacacgaaacacacaagtagggtattacacctttggctgaacctgcataattcctgtgtctccctagtctgtttctcgggtcccgcagatccgatcttgctttgatctctttctacgtcatgcactaatctagggaagacaacaaaacacaggagtagggtcccgccgtgcactgatctagggaatacaacaaaacacaggagtacactgatctagggaagacaacaaaacacatttctacgccgtgcactgatgtagggaagacaacaaaacactaacacatttctaagccgtgcactgatctagggaagacaacaaaacactggatcttgctttgatctctttctacgccgtgcaatgatcttctctttctacgtcgtgtactgatctagggaagacaacaaaacacaggagtagggtcttgcagatccgatcttgctttgatctctttctacgccgtgcactgatctagggaagacaacaaaacacaggatcttgctttgatccctttctacgccgtgcactgatcttctctttctacgtcgtgcactgatctacgccatgcactgatcttgggaagacaacaaaacataggagtagggtcccgcagatccgatcttgctttgatctctttctacgccatgcactgttctagggaagacaacgaaacacagaatcttgctttgatctctttctacgctgtgcactgatctagggaagacaacaaaacctgatttagggaagacaacaaaacacaagggaagacaacaaaacctgatttagggaagacaacaaaacacaggagtagggtcccgcagatccaatcttgctttgatattttgatctctttatttctacgccgtgcactgaccttgggaagacaacaaaaacataggcgtgcaagcagatccgatcttgctttgatgcactgatctactttgttatctttctacgccgtacacgccgtgcaagcagatccgatcttgctttgatgcactgatctagggatctgatattgctttgatgcactgatctagctgatctagggaaaacaacaaaaacatcttgctttgatgcactgatctaggcccgttgtccgagcaatcgctcgctcgacagcatggttccaaactttatcagtgttagtagcctctggcaaacctcctatttaatctagtgctgcccaagctagataagtgaggtggtattattcgtgctacaatgctcggttgctacatgtcgcgcagtactgtgctgggttgctactcctctgctccgtgggctggctgctgggctatgtttgtttttttgttgggccggtctgcttctgctttggccgagctacttgccagcttcctctttttatttgcagagcgttaggatgtgtttggataatggaaaatagggggtgagattgggattgggaaatgaatgaagggttaggattaaatggaaaagggagaatgaatggttaagatttaaagatgggtgggaaatcatttccctttcccatttgccaaacactcccttagagatcgctgtcacgtgtctggactcgcggattagagcaagtacaatagcaggctataagccagctgcaaatatattttaagtagataaatgagaagagagaagggcagcgagctacagatttgtagctagctgtagtacggactccaagacgcagtgtgtgtatgacaagtgggaccagatattaatagtgtagtatataactattgtataaatgagctgttagattggctataaatgaattagagctagtagttagctatactattaaacttgctcttagtggtgaaatatcgcgtgggcccatgttttaatgacggatgaaaaattagcttattttttaattaaaaaagtaggtataggtataggtgtaggtatagattaagataagataagattaaaataagattttacattagctgattagcagggcttttgccttgatatttgtactgcccaatgacgacttgacgagcggggcaacggggaacatgggccagcgagtcggagtacgactcctgttcgcaaccccgaggggggcaccgacttctgggcttctggcgttcacgcggaatgctggaagtggaaaccgactcgggctcgtaccggtcatccttctctataaatctggggttcgtgccgcctcgtcgacaatcgcccatccaaatccagcgcaacgcaacgatcagacgagacgagaagagaagatagaccggcccttcatcagtcaaaagagttagagagatggtggcggcgatgatgatctcgccggaggacgttccatacgaggaggacgtcctgcgcgaaccgttccggctacggtgctggacgcgctacctgtcggccatccgctcggcgccgctggcgaagcgctcggtcatctacgagcgcgctctgcgggctctcccgggctcctacaagctgtggcacgcgtacctcacggagctcgccgacgccgcgcgcgccatgcccgtcgcccaccgcgcccacgccgccctcaactccgccttcgagcgctcgctcgccgcgggcatgtcgcggatgccgcgcgtgtggcacatgtacttctcggctctcctcgaccagcgcctcctcacccgcgctcgccgagccctcgaccgcgcgctccgctcgctgcccgtcacgcagcaccaccgcatgtggccgctcctcctccgcctcgcctccctccccggctgccccgttcccaccgccatccgcgtcctccgccgccacctccaattcgaccccgcccacgccgagcacttcatcgccttccttgtctccgctggccgatggcgagaagccgctgatcacctcgccgcggccgtcaacgatgactgcttcgtctcggccaagggcaggaccaagcgccagctcctgctcgatctgtgccacctgctcgcgcagcacccggaggaggtcgccgggctaccggtcgacgccatactccgcggcagcgtacgcaggttccccgacgaggccggcgcgctgtggacgtgtttggccggccactacgcgcgggtgggtctccacggcaaggcaagggacgtgttcgaggagggcgtcgccacggcgaccaccgtcaaggacttccggttggtgttcgaggcgtacctgcacttcgagaacgccatgattgacgtggagctcggggagcacggcgacgcagaggagaacactctcggtcaaggctgctggctggccgaccgcgacgacggcgacatggcgctcgcgaggctcgagcggcttctggaacgccggccggagctgctcaaccgcgtgcagctcaggcagaacccgcacgacgtgcaggcgtggcacgcgagggccaagctgttcgacgaggaccccgcgaggaaagtagccacctacgtcgaggccgtcaagaccgtcgacccggcgaaggcgacggggaagccgccgccgcacacgctctggctcgcgttcgccaagatgtacgaggaccgcggcctcctcgacagcgcgcgggaggtgttgcggagagccacgcaggcgagcttcaaggcggcggaccacctcgccgccgtttggtgcgagtgggcggagatggagctgagacagcacaatgccaacagggccatcgagctcattcggcaggcgacgtcagagccgtcgctcgaggtcaggaggcaggtcgccgccggcgtcggcgagaccgtcgtccaaacaaagctgcatcggtctctcaagctgtggtgcttctacgccgacctgatggagacgcacgggtcgccggaatccacctgcgccgtgtacgataggatgcacgagctagggatcatcacgccgctgctggtgctccgccatgcttccctcctccaagagcacaagcgattcgaggacgcgttccgtgtctacgagcgcggcgtcaggacgttcaagtacccgcacgacgaggcaatatgggcggcgtacctgacaaagttcgtcgagaggcacggcgcgagcaagccgcagcgggtgagggacctgttcgacgacgccgtccggcatgcgccggcggagaagaaggcggccgtgtacatgcagtacgcgaggttcgaggaggacttcggcctcgccaagcgtgtcctgaaggtgtacgaggaggccgcggccgccgtccccggcggcgacaagctcgccgtctacgaggcgtacgtcgcacgggccaccgcgctgttcggcgtactcaaggcgagggagatataccaccaggccatcctccacggcggcggcctcccggacgcggacgccagggtgctctgcctccagttcgccgacctcgagattggcctcggcgaagcccaccgtgcacgggcgctgtacgtctacgcctccggcttcaccgacccgacggctcaccccgacttctggaggcggtggaacgacttcgaggtgcgtcacggcgacgagtgcacgttccgggagatgctccgcgtcaagagaaccgtggcggccgccaacgccggagccggcgccgtggcgcagctggccgagcaggtcctcgccgacgacgccatggaacagatggacgcggcggtggcggcgccgaagaggcctctgcttgcgtgtgccgctcagcaagccgatcatgccagcggcttcgacgaggaatgcaagagaaggcgtctagtatatgtataggggctacggactttgcaaattgtaatatatgtattgtgcttacttattatattgtattctaaaattttttgagcaatcggtcatcagctagagctcctctgttactaagttttcttatgagatctaccaagttcgaacaaattaaacatttttatttttgaaaattttcttcggtttaatgcccacacacgtttatttgcagaattttttttattttttattttttttattaaaagttttacaaaaataattttccattttgaaaattgacggaagtactcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttgtactgtgcgggagcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattatcaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacagtcacataaggactgaagaggtagaacactactgacgaggcctcttacccctgtccctcctaccctgcgccctaatgtgcccgtgggagtacgtgagttggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgctcgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtagttgtaccggaccagctggaggtacgacgtccacggcgctgcgacaggagaagacgcgcatgaccgcacgcatcttctcctacatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcatcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacacttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactca

SEQ ID NO: 41161 - DNA, 2073 bp, Oryza sativa
gttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcgatcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatacttaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggtcgcctgcaaaattccatgccccctcgccgcccatttgcaggcggcccccccacagtacaaaatcgccctagcggagggcggcaagggggccgagtga

SEQ ID NO: 41162 - DNA, 4138 bp, Oryza sativa
gtcagtgagtgttttgctaaaaataaaaaaaattatagttcctcctctttctcgctttcctcctcatcgtagatgtcatcggcggcggcggcggttgcagggccggcgaggcagaggtgtgcccaaaagatgaccctgaaatcaaatctcccggagtttttgaccgagtcgttccaccggagcaagccgctcttgacagacctcatggagctgggcgtgcttgccgtgccattctcgacggacgggaacacgccggacctgcggttcgacgagaccgatgacgatgacgccgacgacgcggcagctttcttcttcgtataatcaatcaaaaattcaaacgttaattcattattcatgtatctgcctttcaaatcgattgctgcttcttgcagattgctagatggccagaagaagcaagctaatgtgtcacctgattcccctgtgtgagttggacttttctgaacttatttgaagatatagctgaagtttttgcgtatgcagcgcggaactgaactgctcttgcaggtatctctcgctccggccggacagtcgcgtccgtggcagcgacgtcgggtacccaccgtggcaagctttcgtggcgcagctgccaccggtaaaggggatgtggtctgaccttcttaacgggatggatgggagggtatccccgtgggcgagcaataggccatggcgcgcgggctcctagcgcgcctcctcccgttgcactccagagctttgatttcatggtcatctccgggtgcaccttcgcctcgctggccctgccacaacggccaccgccgctgacaccgacgacgacgacgacgaaagggagagagaggaagagagaagaggtaaaagagatgaggcggtgacgtaggtccctctgcattttttttatttttaactaaacacttactgatatgtaggtctcatgttttttttttctgttttacgtgtcacgccaatgccatatcagccgaaaacgtcgtccaaaccgttttgggaccttatttatattagttttgagagttgtgagacgcgtcgtattattactattcagggagacttagcgataaattaagggacctgaagtgaacttaatgcacagccaacaggtcgtaccgtaccctcaatcctattctagcccaactaagcggcccacacttaagccattatattgtaccagcccaactagaatgatccgcatgtaaaccataataatgttttggcccaaccagccgtgatccgcgccacaaaaaacgaacccttccggcacatactgccattatacataggttaatgctcaattatatatagctccagtttaaattgtgtaaaaactaacatggaaactccatcagctattgaaatcggttgttttgcctcctcttgagtggttggttttatcctacatgcactactggagaaaagggtcttcactcacggttcgtaaccccctgttgtcccagttgtgcaaccgggaccccgaatcaggtactaaagatgggcatatagtcccggttgaaataatcgagactaaagatgaatcttcgtaatacgaaccaacactaaagatcagagtgccacgtggctgacgctctcatctttagtatttttttttgttttatttttaattattttttttgctacttatattaatttcaaaccaaactcaacgacaaaatcatccccattcacaaaacatcacaaaatcatcgacaaattcatagatcgaatgaacatactcaaattgacataacaaattcattagacccacggtatgaacaaattcacataaaaaaacaaatacacattaatcaagtcattgtcgcgccggccgccgcccggtgctgctcctcgtccggcgtcgtgttagccgccgccgccgcccgacgcgcgcaggccgcccttgcccggtgctgcgctggccgccgccaccgcccaacgctgctcctctctgttgcgaaaaaaaatggagagatgagatatagagaggagcctaaggataagatcgatagaggataagatagagatgagagagagagagagaggaggaggaaagggagttacagatgaggaggagtttgtgaggatgaggtgaggataagtgcgagggattatatataatgcatcgatctttagttccggttggtaacaccaaccgggaataaagatagtgggacgcctgacatattttgaaccgagactaaaaatggtcttttaacttacattgcgattttaaatcgggactaatatggattttgcatgacccaacaaagatcagttgccagtagtgatggtagctacatggtatgtttccggtattcatcatatatgactcttacatggaattataatcagtaaagaaatgtaaaaatatattgaggccgacgaggatggacgctgtagcagccataataatgggccacaacacattagcaataagaagagtaccatttacatggcaataacgtgtcatatcttcacgtatgacatgtatttttcccgaccagaatactcataggcataaagctataacaacagcaaatagttcagaataaataaataataaataaaaatctaggggaaggaggacgggatactttagtgaccactttcctttccttcgtttggctgaactcccacgcacaagctaagcagtagcgtccctcgtctccttgcccccatcgaccacaacaacaaacagggaaggaggagcacgtaagaaaaagaaagtagaagaggagaggaggagccgttgattgtgacttgctgggcaaccaacactactacagaaatgaatatttaggtcagcattatatatgtcggaaatggtataaacgttagctgtagtgccttgatacttggtacttacgtataacggtatttggtagttggtttggtacctcacaagtcacaacagggaagatgggagttcattgaggagagaaagggagtagaatagtgatgaggacatcaacaattcaacaccatcaatacatccatgtctccacaagtacaagtacaactatcggtgagttcattctttacttcatgtttatcttagttataccacagagatgcgcgcactcttgttttactcaggaacaatagagaggatccaaaaggagaggattcacgcgggctggattcggactgcaggacagagccaacttcattctgacgaccgctacgacttcatgcgaactccgatttaggcgtgcaactacttcatgaaaatcttatcaagtctactttcaaatggatctagcctcgtgtccatatctatgttggagcggccgcaatcatcattttactaccaagttcttatttgggtctaatgggccatgtatcgagtttggtccattagggacgtgtactagggttagaacatgactccaacacccctgtggtcgttctctcatcttcttatacctttagccgccacaaagaacaattgggttttgtttacatcaaagtttagctttgctactttgccgtgtaatcccgtgattggttagatcgccggtttgttcgctgcggaagctcacctgtgatacttttgttgattcaatcctacatctttaattcgcaaattgagttgcttgttcatcttattcttgctagttatcgattgcttgcaagaataaataccctcgtggttgggctgaccatgcatccgtcgagattcataaccgcctctaagattggtgtacgattgctaaagcgcaaatagttttactcagattactaacgacgtgcacatcaaatggaggagcaagcaatttgatctgctgggaatagatcgatggaaaaaaattgtttgctcgttatgttatcccattgccaaaacggaatctcttgccgtggttcatttgataattttataagtaaattacagctttcatccattttataagtaaattacagctttaatcctttgtatatgcatgcaactacatgtgtggttgaccgtgtgcattccccttataatgcagacaccgggcgctgcccattacaaatcattgataaacatgtgtggttgactggtaggtccaaacatatcaacaaaacaattttgcaattcattgataaaatcatttattgctagttttctgaaacaactagctaaagttgccgt

SEQ ID NO: 41163 - DNA, 30177 bp, Oryza sativa
acgtataatgctttaattgtacccttctgctgtacatctttcgcagtttcgctggccagtccaactcgaggcacaaataacattctattaaaaaaaatcctttgcatgataaattttgacacgtatattatattagctcccagggtttgaccaatttggccgagttacctcgagcaagccttgtaaaaatggcaaatgtcttttccaaaacctatacagtcaatccctaatcatcaccatccgtccagctgaagtttagcctgtctagttgtatattctcaagaaccatcatctcaaaaggaaataaaaaaggtccaaattaagtagcttgttctgtggtctggtcagtttgttatattcgctgctgtatcattttcactacagaagaactcttcagccttgtccaagaaagaagctgggatttttctatgcaacatgaagttagatgaagtttctccagctctttgcttcagaggtccatcatcaccaattcttgctcctcggccgtctctttggcccttatttctgctcaatctgatgacccctgaaactccttttcctaaaactggccgtgcacttttgcggttcgaccttattgagatatcaccttgcgggtttcttgtatccaataagatctgtgtattatcactggaactgttggttccccaaccatccaaaagaatggaatctgaagcagccagtcctggtgttttgcatgatttgatcaaagaacgaagcatctctgtgcttatttcttgctgaactacacttctattctggtcacaaccataacagaccgcgataagagcagtagccaagataggcatcaactccgggtcactgaagaaaacgaaaggcaagtcgcacacctgtttttcatcttaatcagttttgcccataggtctctgaagttaggagagaaacatggttatataaaactttgtttaccttgtgaagtatggtgggactctttccccaccgaagaactgcttggttcccagcatggaacaaagagaagtaaccaagaagtagcagagattctagaagcagtaaaccaacctgaaaaaagaagcacaaactcttatggtaaatagaattatccacaactatccctgcatgttttgcacattgaacgtgatagctgatcattcaaccacatactaaagcattgctttgagcatcagtgtgcaagttgtcaatagaccacattataagaatcacatatataatggaaagtgtttgtccaataagaacgtgcaaatgctgaatacacattaagattcttgttcaaggacaggagcccatgcatttattcttgacaatctacacatcaactagattctaaggtacccactctattagtctaatgtcacggataacaaagaaattgtaaccaagtccatccaagtaatagcaaactgtttgagatgcatcttgctattgctatagtattgctatagtgatagaagaattgatttacattaaaatctgaaacttgaaattaaagtactatgatacttaaggcaacaatgtacctcgacaaaaaaaaaagatatttaaaagtatcacatatatcatgtcaagaatgtatgaaccattttttctgtaaggaacagtctgcactttacctgatcatttggcactctccatttattcatgcaatggctaagaaggaaactgatcaaatggaagaactccatctttagatccgatctagcctgaaattatgagaagagtgaaaacttatataggtgaaagaacagaaagaaactatcttcagaattcctatactggaaaaccatcaatttgcctgacagctatgcatgaaacctttatggaagactgattgtgtccattgataacatggagacatttgttgctatgctaaattcatctaacaacatcaagttatacatgaagaacagacaagcagacagcaacaacaataccaagccttcgatagttggatgccaccacttaccagcatgcattgaagaagggtgatatccaaacatgccatgttgttcagaactttcaaaacgccagtggctacctcttcaaaattcgatggaagaattgctgaagcctgaaaaatgaagtgccatttgcttcaaagagaagatccatgaaacaagtatatatatatttggtctgtgaaaagaattccagttttatccttatgtgattcttaaagtctgaaagtcaccaagtaacagatttatgtgcataatgtcatctgccatgcttgtttataaatgcatgtgagcatgtcattttgaaactgagaaccttatgcatatccaaatgcatgtgtggcttctatataattcacttgcaatatggtaaaatggtgtttcataatgtctatgaagtattggaggcaacataagcagcttttttcttaaataaaaacaacattttttccacacaaagcattggatgtaaatagagaagaaagacaaacctgttctgatgatgatctgttgttggcctggagcaacacagctgtcaaaagagaaggcagactaacaaggcctgtctctgccatagcagaaagtacaagcactacaggttgatttaggtttatttcattgtcttttccaggactatcatgcaaacatgtagtactccccttttttctttcaagggtgccatctgcagcatctccctggcagggaattacagagtgtacctctagtgtatcagatgactgcatttctggcatggaccctgagtctttgctagcttcataaactgacatgttgtcccctggaatgttgaatttatgatgatccaaggacttattttctttgatcaattcgctaggatcgcattcatcacatttcaatagatcagacttggtagatggcaatttgacatctccagattgatcagatatcatcaactggttgcccatacctatgtcttgtgaacaaagatattcatattcttgaactagattacccgctagagttctgcatttgcaggactcccaatcaatggtagagaaatttccaggtttagatgttaagacggccagaaggttgagaccaaatagtatggatgatggtaatggggatccttccacctggggcctgtcataaagggcaaaaagatctcgcaggcgatgaattatttgataagccacaatcagttctatcaaccccccttgcatttgaagctgttggtcattgagatatacgtggccaacaattacggtcactgtccaaaaaaatccatctaacacttcacctactgactccatgtattcagttgatgttttgcttgactgaatgttcgaacttccagagtttgatgctgcaacctttatgtaattctctagagataccgataacatgggaataatcggaggtaaaagattttgtacaagaaaataagttcgattggctggaagcgagagcaacactctcaacagtcgtagtaggtagacagtgacttgacaagctccaggccttgaagtgtgagaggcaggtaaagcagatgcaataaaatcaagcaagccaacttgtctagatgcatgtaattcaagatcctttccttctaaatactgtgccaaaataaaaagaaagtggtattagtaaacatctttattacaacacaatatggaacaaacaagaagtacctttgtcatgtcactaacaatcaaaccaatactcgcagcaccctcttttctagcttgacgaagtctttgcaagtcctgaagccatctacttaacttagcttttgcagtacctagagcagacctgtgcacaattcctgtattttcgcctatgagtggttcaacaaaatcatgcttaagagccattaacctctggcgtatctttttaatccttcgtttcatttgcgtggaattgaatgatttaacaccagactcagcagcgttggcactgcttattatttgtgaatcttctccactattagctgagctagaacgattttggttatctttacttggaaagcggcgctgaaaaggtgaaggctgatccctgaaatccattgaagctctctcacgtatctgctcaaggtaatacttacggcgctgctcactttcacgaagcttctctgctaatttttgggctaacagttcagcctcttcttgttgagcttttgctcttatctcttttctacgttgctgctctgcagccctcgcttctcgtgcagcactagatgctttgcgctcctcttctcttctaataatagcttcttctttcttacgctgtatttcagcaagacgttgcatcttctcagcttcaagaatttttctccgttccaatacagcttcttcccttgcaatgtcctccttttgctttgttttgatcaccagtagcttttcagctctccgcatttcagaaccatgaagtttctgcctcagtaagaatttcttgttttcttcatttagtgatgtaataaaacggacctcattgaccttagtactctcatcaccagctctttttgcaacctgggcaaggtatgcctcatgacgagattcactacgttggtggcgtgcattcattacttctcgcagttttgagctgcgcacagcctgccattcattgacacgatttaacttttcagaggtacgttgcagcctctgaactctctcactttctagttgactccggattcgtaaagctcgtgcatgtttttcttctgcttcctttttcatgtccaaagcacttcttttcttcttttcaggagacattaacttgtcatgtagaacacgagcacgctctggtacttttctgccaacaccaggggaatgggagacacgagaactccgaacaggagatttcagtatatcttcccagtttcttttctctttccaggcatccaatgacttccgtggtgctgcattttgtttctccttctcagtatgaactgtagtcctttttgccgtatctgttgacctgagcttgtcaaatttgttttctggcaattccttatccttcctaaaattatgcttctctacctcagagataggttccagtgatccttttcgactctttgcagaagatgaaggcatattttgtggaggtgatctacctgacttgattgtatccttgctttgcctctctccagcaatttttttctcagtgtcagaaagtttcacctgactctccactttcaaacttatacttccaacagtcgctgatgctgtggttagctttgatgagctaccagaaacttctccagaagagctggatgcaaagctctctgttgttataccagcttgtttgcgagccagttccaattgaattctctgaaatgcctctagagatgaagacaatatctcttgcctgtgtggtgaacttgtcatccttctgacctgcatatatgatttaatcaaaaagggttttgttaactcttttagcactgtgagatactccccaagttgatttctagcattcaaaatttgtctaaaaaagggttgatttctaaccatccttggtccagaaatcgagaagtattaatgagtcttatctcttcaataccccttactacattcctattaatgaggggcacgtctttttccctactaatctgtcttggaattgctagtagaaatcaactcttttggagacgtagtagatttgcattccatgaaaagtgttttgtggcaattaaccaggttattttaacaactattaattcaataaagggtccaagtccagaaactcgtcatgatatatgtaatcgttcaattcttgataagtacataggcttgtggacagagaataatatgtgcacactatgagttgttcaatgatcataaaactacgctaaaacttggagcaattgaaatgaaattctgcatacaagtcatgtaagaaaatatttcataattttgcgtattatgagaatacggacctcccaagacaaggcatgtggtcttcgatggtcagctttcacagccattggcatcccctcctttggtagagcagtagattttttggtgttatcaaaatgctccgccctggatttcagttcttgaaaatcagatatagcttcttcaagaacaaggatggattcattaatttgctccatgtcacattctaactcacagaggaggtaaagttcatccacagccctattcagattctcaaaaagaaaacaccagagtctctgcctgaacctttctttgcttccagcagtttcacctccaaaatctgctgaagttggtgcatgaagaactgtctggctttctgttgaagcaacagaagacgacttaactggaacttcaagatcattgtttgcacaggacaaggagactgtgtcgtccaaggaaggtgaaccactaacatccaaacgattatctgttatttcacatatatccaataccttgctctcatcttcagtgggcgtttctgccccttgaataataacaggagatgtctcaacaattgttttacaagaattcggctcagttttaagttcactttcatctttacattcatttatgaattctgtagcatcgccaatgtgtatgtgtttttgagatgaactattatttctacatgcatctgcaggtaatgctagacctggcacttcatcaaaatcaccaaacctgacagaagtgttcgataaaacacctatactatctgtcattggagggcctttaacatgatcataaaaacctgaagattttgcaagaccacttgaacagttggaggattgatgtggagttggagaatcagcacagtcaatcttaccaacgttgggaggttcacttatttcttcagtcactagcagttttttaggtttttctattgcatgatccgaggctgaaacacttaattcactcttcagattgctagcatctgcatgagcacattcttcaccatgaacaaccattgtgactacgctacccggttcattaacgcaaacattaacctttgtgatctgaggtgagcattgtaacctgtcacaccactttgcactatcactgccaaagttggtctgagattgtgaggacgagtttgaaattttattatcattggaacctcctgaagacctctgcaatgtgaattttgagctggatcggtgtttctgttgaatagatttgtaataagttaggaacagaagcactaagagttcttctggcataatagagcatcaaatgagagcatgatccaagtctctgagcaaaatgcaaacaaaaaatataaaatgtttgatgaaatatggtattaacttgatgatccagaaaaaatgcttctgaaagagccaataatcttcaagcaacttagagctgtttacagggtataccttcgctatgtaagtctatgtgtgtgcaagatagtactggttaatagctatcatcctggacagaatggaatatggccaaaatatatcactgaatacatgcccttttgctatgcataaataacacagaaactcctaccacaacatctgtttggttcaatctaggtattcttctaacatttgatttataaacaggtgttaaattgattattatcactctcggccaagctattgcatctgtttatctagaaatgactgtcttgttgcatggatcaaactcacaccccttaaggccttaaccttgcatttaacaataaggcgattgtgggaacatattgttagagtttgtgtcgaatatatgtacaaagtcagttccagtttaggacttggaattgtaataggtgttaggactagagtaagagtcagactctatcctaggctctctcataaatagaggggcgtgcctattgtaaccgcatgacgacttagcatagcgagagggagcggctgccggcagcgaccagtcgtgagtcgttgtaactctgatacgctgtaatatgctggattggggaggagcgtccgtaatcagtgctccggagatgtaggctacggctgaactccgttatcaaatatcgtgtctcggtgtcatcatcatatttggatctcctatggtgttttcttccgcggtttggtttccgatgtgatttcggggccggttttataacacatataatggggaaaacaccacaatcattcgatgcattataattgaacagagagaactccttacttttttcacttcaagccaccctgatcccacatcatctagatctccatgatcattctccattaccaccaataaatcttcagtggttcctcatgcattcctgctttttcatacagatacggcagttaattataccaggaaatgtaccagctaaaatatttttttaagtgtacagtgtgctgagggattaaaaaaatcacagatttttcaagaaaacaactataatctataggtactgaaatcctcactaaaaccctgacacttaactgcaacataaaacatagcaaaatagtgcagaagattttgccaacgatgcatatccagacaaaataaataaataaatccaaaaccatcaaaggaattggacgaaatgtagacaaactaaaacgtggggctacttaagttccggatcccttcgcagctggtctccgaatttccaatctaaaattccaaaatgactcctgccactcaccgtcactggcattcactacaatcaaccaaggatcgaacaactaaaaaaagcaagaacattccattcctctcgtgctaacatgtcaacaacaaggttgttggttggaccaatttccggcgcaaatttgtacgatttgggggtaagaagagaggccccgctccctcccttctccctgcccatccatcccaattcccaatctacaccgcgcccgcctgcctcgcgcaaagtgggcggaggaggacgaataccttcaatccgatccgaaccgagacggaaggatgtcgtcggcggcgtcgcccctccagacctgcctgctcccccgacgcgcgcgcgaggaggccacgccgctcatgaggggaggatggccttccccgccgccgccgccgcccttctcgccgccggccgcgcgcgcgaggagtcggggagccacgtctccggctcgccgcagtttttttttttctttttttttcctttttttttcgttttagggaggctagtggagactgcgggttgggagagagtgagagaggcgtggggaagtcagggtgaggggcatttcggtcattttaggctgagggtgactggcttccaggtggcggatgacgaagacgaggcggtccagcgcggcgacggtgctccggcgaccggcggcggtgacgtgagggcggtagggaatccagaacctccgtagtaatgcaaaggtgcactcttcatgtggggagcacaataaatcaatgcgtgtgaacagtgtcaattcagtgtagcaaccgtaacgaaaacgttgtagaacactacagagtactgtagcatagttaccgtagtgcacgatttgatcttgatcggacggtctccattgctcctaatgctgagtatacctattcgggcagtgggagcgctcgatgatgttaggtcaagtgctactcgtgtcggcgaggattaggagcagtgtcacttcctcaaagttgatttgggttgggatttgattacgagctaaccggttccagctcacttacggtttgttagagcttagctccaacttcatctctcctaaagttagagcccatttatttcagctccaccataaaagaaaaaaatgaaacggttaagtgttctcacaaaatgaactggagaaatggagctggatttaggctgctccacaactccactttaaactgaactcttggtgttaaatctcgaaattgaagtactctcaaacatgctctcaatccaatcggatacactcccttggcatcaaaatacatgatttttaaaataaagaataaatattataaaaaacccctatgtctcaaggcgttcctatcacaaaactacatgttaagtacttcctctatttcaggttataaaactttctaacactgcccatattcatatagatattaatgaatctatgtgtcatctatatgaatatgggcaatgctaacaagtcttataacctgaaacagaggtagtaaattttatcatacgcacttccttgccccttccgcaaggacgaagtattgacaccgatatagcccatcccctccacttctctgtcatagccaaccgtgtaatacataacttcaatatctaagtattaaccagaactaaaatatgcaggataaaccttaaccaataggtttatctaggttttctaaaatatgactattttttactataaacttagataatatttttagttacaaatctagtagtaatagaaaggagtatataaatttttttacgggaggatggtataaccttcagcgaacaacacaaagaaggttagttagaggcaggactaaagttgcaatcatgttccttccgtgttttcatactcaaagtctcaaacccagcagttagcaacttccatttctaaacaatgcgctggtcagcaagaaaaaaaattacagatatccattgataaagaacacaggagcatcaaaaccaacaccgcttgatggcatggcatgtctgattgtctgtggccatttgcgaccagttgtacccaaccaacagccgctccaaagaatcaacagacgttggtcactgctcatccagagacaaacccctgttagtaatataaaaattgtttctttttctttttcttttttactccccaatcccccttcttcctccttgatccctttcttctccccatccctctttgccatggtttccgcatcttgagctgagcagagcacagcttgtacctgcagccagccatggtgaccaccaatttcgtgcagaaccaccaccttcagaacagccagttcttcctgctccccaagaggcagcttgtgacctacgccctctacgctctcatccctctcgccctcctccattaccttctcttcaaccctgtggccactgccaagaagccggtggtggtggtggttcaggcgacagacgatgcttcggtcatcgcctcgtctcatcacgagcatgtcaaggtgaatgccaagcagctgcctgtgcccccttctgaccaaggagatgaagggttcaagaagaatgcgataggtgagatattgggatctcttgtcgatttcgagtacctaggatttttttttccatgatgagatttgtctgccccgattggttttctccatttcttgatgtttttggattatcggattctgggcattagatttgtgatgtttcttgtgcagattttagcatgtatgaacagatttgagttcttggggatttaattgggggagggaagggcatccttttgggctaatctttgcatcttgtgttggatccgagcagccggagaagtggcggcggcggcggcgtgcgactactccgacggcgagtgggtgccggacgcgcggccgcctctctacaacgggacgagctgcgccacgatcaaggatgggcagaactgcatggcgcacggccggccggacaccggctacctccactggcggtggcggccgcggcggtgcgacctcccggcgttctcgccggaggcgttcctcggctggctccgcggcaagcacctcgcgttcgtcggcgactcgctggcgcgcaaccaggcggagtcgctggtgtgcctcctggcgtcccgctccacgccggagctcgtgcaccgcgacggcgaggagaacaggttccggcggtgggcgttccgggagcacgacgccaccgtgtccatcttctggtcgccgttcctcgtcaaggccgcggagaaggcggagcgcgccggcgtgcggcacaacaacgtgttcctggacgcgttcgacgagcggtggatgtccgggctggggggcctcgacgccgtcgtgctctccatcgggcactggttcctgatcccgggcatctaccacgacgccggcgaggtcgtcggctgccacgactgcgccgagttcaaccacaccgagacccccttcttcgccgtgttcaggcaggcggtccaccggacgctcgccgagatcacccggcgccacgtcctcgccgccggcgcgggcacgagcaagagcaagagcaaggtggtggcgttcacgacgttctcgccggcgcacttcgagggggagtgggacaaggccggcgcgtgcaacaagacgcggccgtacaagaacggcgagaaggaggccgggtacacggaggcggagatgcgcaagaccgtcgtggaagaggtcgccgccgccgacgccgccgcggccggcggcggcggcgcgggcctgcggttcgcggcgctggacgtgacgacgctggccaacctgcggcccgacgggcacccgggcccgtacatgcgcggcgacccgttcgccggcggcggcggcggcgcgcgggtgcagaacgactgcgtgcactggtgcctccccggcgccatcgacacgttcaacgagattctgctccagaccatcaccagatgacgacgttgataagatgaatcgtttcgtctcgtttacgagatcatacgagtagatagtgcgaattccgcggtaaaaatggtttggtttagatctcagtgatttttgggtgtcgcctttgatgtagctgtaattgttagagcatatacaatagcaggctataagtccgttataaacataagtccgttataaacatattttaaagagatatatgaaaagataggagagcagcgggctacagatctgtagccagctgcagcatgggaattggctattacattggttatagatgatttggagttagtagtgtgctatactattaaacttgctctaaactgctccattttaaatctgaactactcccactgaactgaactgtactactgtcatcaatacaacgggattacgggatcgtcggtggcgtttgatcttacgatcacgtgtgaacaaatcgtgcatttgatttttcgtggacactgctactcgatcacttgcttgatttgaaaataaatgcagacgttcatgagccgtgtacatcgtctatcattttaaaaaataaataattagtcctaaatatgagcatcaggattaagtacaggactttgcgttcacatgttgatcctgatctggtgtgcaagtagcagtcaggcaagtagcagtcaggtttcccaaaccgccgggtctggggttaccgcgccccgacggtaagcgtggtaaccgtaaaaaaccgtacaaaatcgtgtaaaatttatcaaaaattcaaattattttttaaatttatttaaatttaagaagattaccgcggtatttatattaccatacctccgcggtaagaccggtaaccgcacggtaacgtcaaccctggtagcagtcaatctaccatacaatctggttggtgtgtcgcaagtgggctgtcggctccgtggatctgtctgtgcttagcctccggcggaagttgtgccttgattgtctctgcttcttagacaagagtggtggccactttgacctttgagtgtgttgtttgctgtccctttgatacccactcgatagcagcagcaggccagcagccagcagcatatctgcatatggcgtcgagaacaattggctcgtcttccggcgagggagtaccatgcaggccggccggagcggtgaaccgggaaatttccggcctccgacactagggcggcggtgaggccagccatgccgtctcgcctcgcctcgccgcgtcatggtcacggcacgaacgatggcgtcggctgccgtacgtgtgccacgacgtgctgggctgctggcatggtatggtaagggtctctttaaatcatttaaatcatatgaatgaaataaaaaacatgattatagaaatgcaaatgtaaaacagagaattacaaaacacaagaaaaacatacgaataattgtttgattgggtcgcaggaaacacgcagtgagagatagactcaaaggatttttctaagaggttggacctcttactaaattttctccaaaatctacgtgcaatgagctattccataggatttgtataggatttggaaaactccaaccctttgaatcaaatagccaaatagaaaaatttcttataggatttcaatcctatgaaggttaattcaggacgtcttgtttcatggttgttttggaccaccgaaaacaacatggttttcagagacaaaatggtttactctccactgatcctgcctttccaaatcattttctttttgttgcagtgaaaagcctatgtcgttctgaggagacttttgctgatggagacgatgactgagaagttaaaagtgacaacaagtgctcttggtgctcagagaaccggtgttggatgatgatatgccttgttttagcttgtcatagtatcttttgtcggtgacttttttctgctcatggccttttgtgtgttggctgttagtctcactgtaatagatgtgtgtttgagcctttgatatgtaaaatgggtatccccgtaaggccataaacttgtttcgacattttgctttcaatataagcagggctgtgaggccttttctttaaaaaaaaatttcaggatgtcccacttgttttacttcttttcatcaaaatggcacaattatattaggtttattcagcagatgctgacaaattgggccaccatttgagtaggaacttaaaagtcttatacgatgatcaaacaatccaaatgacccaaaattatacggttggaccttaagtgggaccctgagttgggcaaatcaagttattgagattcgaatttgctacatactaacagtcatgtgactgtttttctttttccaagacctgtggaaaacaatcctttcggcatcaaacactccaaagaaaccactcaagtcgttggtgatattctagttgcctgggagatttggaaaaaaaaaaactcgcgcctgtttagaagcctagcaaacacccctgagaccatcgtttacgcatcgtatgggttggttttgttataaaaaatatatcaaatgaatataattataatgtgattacactataattacaatattattatattataaccatacttagtgtgatttttactcgagtgatatagttagtccaattgagacttgatgtgccactattagatttgtgcagccagacacgattatggtaggaaagaaggtgttacaaataaagttgcttaaaaattttggctaaagaacaagaaatacacatgaaatccattaaagttgtgcctttgagagagtgcacgaccacttaagatcttgccaatgcgctcagagtaaagaatatcacacctcataagcattttaaggaagataaatttcgtcattgcattgacttttataaagtttgcattgactaatgagaactagaaggctccatgttgagtacggaagaagctcctctaacatgctgatcagtcacttaaaattagagaacatcaagtccgaggatttgtttccgttgagtactgcttgtccatgttcataccgaattcgctacttacaatttacaaattagtgtacaacgttgtgtgcccgtgtcactaacgccagccccaccggccagctccagcgttgtgcctctccgctccatcattggagtatatgcaaacgacaaacgttcttaggttgtgctcgaaggtagaggttgagaactccacctcatcacatgtaaaaggagtgatttgttagtacataattaattaattattaactaaaataagtttgaaaaatggattaatacatttttcttaaaagtaattttcctagatatagaactcttgcaaaagacacactgtttaacagtgtgtgaaaaataagagagtagaagttggaaaaaggagtggccaaacacaaccttagacattaatatggggacgaccgacattaaagttattaggtgatgataaaataaggatggaagaagtatcatgatctttaaagattggtactttataaaaaagtgacattgcacattataccaccaaaataagtctaatacataattaatataataaaaaagtcatctccacttcaaactgccgcaatagtttttcttgttttaaacagtcaactaccgtagaaatgatgggtagtaaaaggacccagaggagaggccgatggatcaaatttgaggattattagccctaacatttatgagtctactaatttaagagaaatttgagaataaaatgtttacttttctcatagagtttctatgtattttagttgattagaggtgacacatggtgatttaaaagctggtgatttaaaagcgttccacaagatgttcaatgggctttctttttttatgttacgtttgtatcttatgtagttcatctatctctaagagttttagctaggtacgtaaagagagattagccagatgttaaaatattatcatgccctccattaatatggagagaaaatatcgaggagaagaagcgagtactgctcgtttaatttgatgattaagaataaatgataaagtagtattaaaggggtctagtggattcctctaaaattcatgtttagtaaattaattattagcctacaactaacggtgggaatatgttttttcctacttagtttttttttcttttgtgaatagtacgtacgtacgtgtttttctgttgtacgtccacgtactggaaaggagggattatcttttataatagatttataatttaatggtttaaaaaaaggttcaccgatttaagtgtatataaaggctaagatgttctgatttaaaaaaaaagaatttctaagctttttcataatttattaggatgacgtagtgactcaagggcatttcagaggatatttgatagacattttatcataccgtatatatgtatatatatttatagactatatattagcttacatgtgtatatatattcatatgtgctccctccaatttaaaatataagcatttctactatttttttaaaaaatatttatacgtattttttaaggcttctctctcttttttttcctctcgcgaatagtacatatacgcactgcacttttctccagtaagtcacgtacatgagatatctcgtaagtacacatacatgagatcaggagactttttaaaatgatataatggtccaaaataatggtttcactgattttaggtgaaaacctagagctaaaaattttacatctaatagaattttaatcttttattttaattcatttaatgtgacacgtggcgacttaaaatgcttcagagaatgtttaatgaaccattttcaaccgttcatatgtaatctctcttttataagattatcatttctgcatgtttttttgaatgcatatggacatccctccgtcaacatatattttaagaaacaagagaaaatgattatattttagaatgaaagtggcttttcttttgcatttctttctctctttttcaggcaaacagtacgcgtgtatttttcttttgtaatcatacgtactgaagataagggagagattatttttaaaataaaatctgatagtctaaaataacgtatcatcaatttaagtgaaaaatcatgagctatatattttgtttttttctcatttaatttctaatcttttttctaatctattagaggtgacacactgtgagttaagagtgttccgtttagtggaattttagtatacaaccgaaaaaaatagaaagatggatgatagataatgatatgattattgcttcacacaaaccagtggattagatttgacacaaatattagggatactttggccactcgaaatcgttactgtacttcaatcagccagtttaatcacttcctctctacttcagatgttaatcccctttatgttcgattaagcaataatgctgtgctttccaggttacactccatccatctcctctctacatgtagtacaaactatctgaagtcaccactcccacctgttcgacgccgtacgacgtcgtcgtcctcgtcgtacgcgctagctatggccgcgcgcgagccaccgcgtcaaggccatggcgccacccggctgtcgtgcccaactccggcgaccaccaccaccaccaccaccagcaacctttgcagcttcctcaacagagccatctccgcttggctcgtctgcgccgtgctcagcttgtttctcttcaacctcctctggttttaccctgtcgacgcgccgtggaacgtcgtcatttccggcgaaggtaagcgtccatccatggcgatggcaggaggaggaggggaggaggctaggtgcgactactcggaagggcggtgggtgccggcgccggggcgcgcgcggcggtacaacggcacggcgtgcaacgtgaaggagagcgagcggtgcgtcgggaacgggcggccggacacgggctacctggactggcggtggcagccggcgtcgtgcgagctcccggcgttcgacgtggcggcgttcgtgggcgcggcgcgcgggaagcacgtcgcgttcgtcggcgactcgatggcgcgcaaccaggcggagtcgctcgtctgcctcctcgccacggcgttcccgtacaccctcgtgtaccgcgacccgcacccgcgggagcgcaagttctggcgctgggcgttcccggcgcacaacgtgacggtgtccgtctactgggcgccgttcctcgccaggtccaccggcaagacggacgactaccggaagccgcgcaacgacgtctacctcggcgcgctcgccgagcggtggtcggccgacgccgacacgatggacgtggtggtgatcagccaggggcactggttctggatcccgaccgtctaccacgacgccgccacgggcgaggtggttggcatgcacaacgtcaccgggctcaagaacaccggcgacatcggcctcttcgcgccgtacaggaggactctgcggatggcgctggagcggctcgtcagctccggcgccggcaaccgcacccgcgcccgcaccgtggtggtggccacgttctcgccgtcgcacttcgagaaggcgtgggacgacccacgacgtgcgcgaggacgcggccgtacgacgacggggagaaggaggtggacgccgacgagagggagctccggagcatcgccatggaggaggtggccgccgccgccgctcgccgtggcgccgccgctggcggcggcgagagcagggtggaggtgctcgacgtgacgaagctggcgacgatgcggccggacgggcacccgggggtgtacatgcaccgcgacccgttcgcgcgcggcgtgccgaagcggctgcaggtggactgcctccacttctgcctgcctgggccggtggacacgttcaacgagatcttgctgcagctactgatcagcaagaggcggtgacgataaaccggagtactagcgtgtgcgtgcatgcaaggcaaatatgaacaactaacttgagatttgagatacaagtctgatgatattaagttccatttgtattacaaagttatgtacatgtaaactatgtttcaaacttatgccacggcaatcaaaaccgatctcaatattatattaggagttgagaatacatttgtactggttttaaaagatgagggttacgttgtatccgttgttttacggttgagcaacatgattgcaaactcaaccattatgttattaggaatgtaaagtggactttttcccttaaacttaaggtatattctctgccagaaatacactttttcggcccaaaagtagggtgtcaatccgtaccaaaatgcggtcgtgaaatgcgcgtgagttgagcccacaggccacagatggtcgtgaatttggtccaaagcttagcctgaattcagccctacgttcttctaaattcagcccaaaagtgtgagcgatctcagctctcaactgtgcacgcgaatgcggcccaaagatccgcgtaaattaagcccaaacgttcggcgggttggaccatatttgaggccgagaaatgtgcgaaaattcggcttttaagtatggaaattccggcccagtgggcgttaattcagcctatatctttaaggaaatttagcccacgtgaaaagaacgaagtatgtgcgccagtccgccagatatcatcatcgcaagtgggccgacatgtcattgggctgaggcctttatttctgcccattgagcgtggaacatgtcccagctaaaattcttcactacttcaaacgtacactaggtgaaaccccacgtgttgctgtgagagttttgtatagtattaataaaaataacatgcaacatagatacattatgtacacttttcatctttgatcaactattgagaaaaaaactataaacaattaagataatatggattatgaaaattaaaatcatatgtggattgatcattcaaaaacaaaagtaaggtaacgtggcttcatgagagaggaaaaaaagaacgtaatatagatcaattatttaaagagaaaactaaggcgatatgattttataagagaaaaaaggaggaggataatttagaccataaatcaatcatgtaaggaaggaataattgagatgatgtgacttaatgatagaagagaaaaaataacattaactatatatagtggtgataaactatatagatattcgctcagtttcatattataagttgtttgatttttttcttagtcaaaatatctttatgtttgaccaagtttatagaaaaataatagcaattgctacaataccaaattactttcattaaatttaactttgaatatattttgataatgtatttgttttatattaaaaatattagtagagtttttttataaactttgtcaaattcaaataagtttgattaagaaaaaagtcaaatggcttacaatataaacgaatggagtatataggatacgcggcttaagattctaagaatctagttgatagccagtttctgagaatctgaagtgaggtttattttttagattttataactaagtttaaaatttggatgataatctggattgcttgagggagctgaagtttatgcgagaaacttcggctgctaaaagctctttcaaacaggtcttgttgcaggaatcttgcggcgtggtggtagtaacagcgagtcagaagtcagaacttcttcgcaggacacagatttaacactgcatcaccattggtgctcgctaacatggagatctgcaaacccgttagtttttgcgcagcacaatcgatgcagcccccatttgcgaggcaagttcgatggaaatgccgttgaaaatggaacagatatgcccacttgcagatatagaacagtattgtcctccaaatctcgagaccgtaattcagattcagttaatgacgcgattgacggcatggcctcgatctacagcaaaactcttcttcctctctctcactctctgttgcggtcttttcttttgtgtgtgtaactgagttctatcacttttgaaacgatttaacacttctgcgatatggtttagtattatagttaaaatctcgattgcatgattttacatttctaacttgtaactaaggtacccaactctacgattccatacggtaaaaatgagtaaattgtatcaccagtacacaaacttgtcaggtgggtgtaatctagtgcacgaatttgtaaaatgctcattttagtgtatgaacttgtctggtgcgtgcggaggaatgtgaaaaggttactacatggctagtcttattgatttaggggctaattaggatactatgtaaatagagtaaattgtattggtggtacacaaacttattagctaggtgcaatttagtatataaacttgtaaaatactcgtttcggtacacaaacttgtctagtttgtgcggacgagaaccaaaataacttggcaatgttaattttacgaagctgatgttaggatgtgacgtgcatacatgtagtgagtatgcataagaaatgcaatatttataaatttaatctctagtttatccttcatcatggaaatgatgaatttcatatatttctaacacttatattgctcagtttttttctttatctttatctttttctactatcactatattctattaattttttattgaataggtgtatgcctgatagcaaccttctcatatatatatttacatagtatcctaattagcccctaaatcaataagactagccatgtagtatccttttcacattcctccgcacgcaccagataagttcgtgcactaaaatgagcattttacaagttcgtgcactagattgcacccacctgacaagttcgtgtaccggtgatgcaatttacttcggtaaaaaactataattttataaatttcactagaaaaaaatatcagtgctttgtaaagggtgaagctattttaatattattattgttatacagtttagctaaggtaaaattcattgtgggaattcgtttcaattttctttttataaaatcattagctgcaattagaagttcaatcatctcaagttatcatgcgagtttttttaaaaagagatttcttatatgacttcttctatattttcgaaagcgaacgaatttaaaaacagctcaaacatgaataggtatttccaaaagcgaatgaacttaaaaccgactctaacttgaattacgtaccaaagtaccggcaaaacatcttcaatttttataatattagatagtagagatagatatagagataaagatagaaatatagatagagacagagatgtataggattctatagttgcgattctacttagaatttccaattctaatttagcatcgtgatttcgaattctagttcaggattgtgattttaataatcttggtttaatattttttaaatcacactttagtcattttgagtcattttgaaactttctactacgcccgtcccaataaaaatcaatgaccgaatgagacgattattatattttggaatggagggaatatcatttttacatctttttttcctgtgtggcctgtcaaataaatgggaaagtaatttcatcccttgaggggatatcccctcgttttgtgcatgccacctaaatagtcgtaaaaaaatatgaaaaaaaatgacaacatagattaatatgaaatgtatcacttcacaaacatgcaagtttaaattcaacttatacaagttgtaacaaaaataacaaatatagttgtggatgcgcgataactattttcagtttaatttttatttttgttgcaacttgtagaagttgaatttggtcttgcatgtttgtggagtgatatattttggattaatatagtcaattttttaaattttttgataactatttagatgacatgtaaacaacgagaggaaaatccacatcccaaataaataaatactacaactatattactcctctcacaaagtgtaatttgggttgttttctcaaatcctatgcacaaatcccaaacaacagaatatatttgagttgttttcacgtcacgctccgttgacattttttgggtttgagctcttcttcttcgacaatcatttcatttctacatagacctatcagaactcataacacagaacccccctggtaacatcgtcatccactcatcctcaccgattccgacgtacggatcgccgccgccgtcgtagctgcaccggcggcaaatgggagcgtacgacgagccgccactgcgtcaccaccacggcggcgtgcaacccatcagagacatcttcacgtcgctcatctacgtcgcgctctgcttggccctcctctacctcctctgcctcacccctcgcggctcgccggagaacgccgtctcggctctgctccggcacgtcaccattgcttcttccggcgaaggtcgtggtaagctaagcgcccatccatggatgcgcgtgatcgcgtcgtttcagtgtaatcttgagttgatctcgtgtgtttgtgttgttgcaggaggaggaggcggcggcggcgggtgcgactactcggaggggcggtgggtggcggcggcggggcacgcgcggcggtacaacggcacggcgtgcgacgtcaagggcagcgaggactgcgcgcgcaacgggcggccggacacggggtacctggactggcggtggcggccggcgtcgtgcgagctcccggcgttcgacgcggcggcgttcctcgccgcggcgcgcggcaggcacgtcgcgttcgtcggcgactcgatggcgcgcaaccaggcggagtccctcgtctgcctcctcgccgcggcggcgttcccgtaccgcctcgtgtaccgcgaccgggagcccgggacgcgcaagttctggaggtgggcgttcccgacgcacggcgtcacggtgtccgtctactgggcgccgttcctcgccatggccgccgggaggccggagaactttagcgtgcagcacaacctcgtctacctcgacacgctcgccgagcggtggtccgccgacgccgacacgatggacgtggcggtgatcagcacggggcactggttctggaacccgaccgtctactaccaccacaacggcggcgaggtgctcggcgtgcacaacctcccggagctcaaccacaccgagatcggattcttctcgccgtaccgcgaggccatccggatgtcgctcgagcgcctcctcggcttagccgccgccggccgccgcggccgcaccgtggtggtgaccacgttctcgccggcgcacttcgagaaggagtgggacgaccccgcgacgtgcgcgaggacgcggccgtacgaggacggggagaaggaggtgggaggcatcgagggggagctccggagcatcgccatcgaggaggcggcgggggcggcggcggcggcggcggcggcggcgaggagcagggtggaggtgctcgacgtgacgaggctggcgacgatgcggccggacgggcacccgggggtgtacatgcaccgcgacccgttcgcgcgcggcgtgccggagcggctgcagagcgactgcctccacttctgcttgcccgggccggtggacacgttcaatgagatcttgctgcagctactgatcaagaagaagcagcagtgaacaacaccggtatcgtacaagtacaagtgacatatgcgttgcgtacttgcgtgcatgcatgcacgcacgcacgacaatataacaacttgacgaatttcctagacattttttatactcttaagggatacaagttggaagctgcatgcgttggtagatactaagagcttctccaatagactatttaaatcagactctccaaacacatatataaccaactttctaattgatttagcaagccaaatttgttgcttacttcaacaaactctgatccatctacgtaccctctttattttgagtctatgacattgagaccccaaatgttagcctctactatactcttcctcatcctctttctccccctcttcctcactacaccacaacaccaaataggaggcacttgatatatcgggataaacaacttttagtagcaagcagtctgtcgggaaagacttttgccaacactttgtctgttaggtgagtccgagtcccccttcctcctcatggtgtcttgctccatttaccctgatgagacttcggtgagttggagccccatatctcccccgtgagttgacaacgtccctttcatcctcgccgacatgccttgcatctcgttccaagcaacgacgaaaagccaacacaccttcctcctcagatccggactacattaggagataatgggacttcttttttggggggagctaatgcaatttagttgacatttgaggagttggtactaaagtttttcaaattttagttgaaagttttatgattttgagttgaaagtttcaaattttgaatcaaaagtttgtgatttcaagttgtaagtttaagatttcgaatcaattgtttttgtgattttgagttaaaaagttgtttgtggttttgagttgaaagttttaagattttggaccataagtttatgattctaatttgaaagttttagactttgaatcttgcgtttttgtgatctgagttgaaagtttaaagtcacaagtggaaggttttggaaattggaagtaaaagttttggtaagattatctttaggaatatagagctaggggtatgcgtcgacacttcaaatgctcttggcatgcacacgctctattcatggaaagggcagcgaaattggtctgacttccctaacgcatgcctgacctatcctgctggtgcataccccctccgtcctaaaaataatacaatcctagctacaaaacatatgcatgtccagatttgtaactagggtttatcattttttggaacggagtagtatgtgcgatctaggcgcctccgaaattgggtaacctgtttttaattgctagtttatttttttagtaaattacagcgatggtatataaacttttgaggtgggtatagtttggtataaaaacatgtaaaacacttgtttcggtggatgcattttgtctggtgcgtgtgaaccttaggccaaatgagcatgccatgccatggttaatcctacttagtttgaatgtttattaagatgtcgtgtaggcatacatattagcatgctgtcatctagacgtgcatatgttcaatcaaatgtataataagaggcactgataattgatgttttaaataagaacatatttttagagaaataactttaaccactatgttctgttacatataatagaattatcaacaaatatataatttttgtttacacccaaatttagtacctttgcacgaaatagggaaaaattgctaaagtttggaaagcaccggattttcttcacatggccagtcagaccgcaggtgtgttgtcggtctgactagctagtaggaccggtttgaccgcaggcatgtggctggtcagtccgtcagagttcgagcccgaagcgaatttcgtcaggtctcgggtttccttactcgggaaggtatgttttgggttttcattggtttctaccctgagttgaacatggaggagcacctgtaaaaggcaagaccaacccttatataagggacaaggccggttcaattgaatcacacaatctactttcaaccaattagccaattgaattgctttttcaatattgcatctacttttcgcttagttctagcctagtttcgtccatctttgttggtttgcaccgtgaaccgttcgccgtcactgcgagagtgcaataccgctttgtaggtttgtcccgtaaaccttctgttcgcccacgagacgggtggttatcctttgttccacctagattagatccgctagccggtctagtttgcaaaacacatcttgatttcgaaaggctaatgggcgatcgattgcccctagcgatcacccccctcctccacgtggtttctttttttggcaccgcattactttcctattttagtaaatttatgcatctatagtttgtacacctcaaatttacacatctaaattttatacacctaaagtttagagacccaaagtttataagtcaaaagtttatatgtctgattcaaatttgaatctgaattcaaatattttatatatatagtatttctatacatctaaagtttatacacctaaagtttggagacccaaagtttataagtcaaaagtttatatacccgattcaaatttgaatttgaattcaaatattttttatatatagtatttctatacatctaaaaattatacacctaaaatttatagacccaaaatttataagtcaaaagtttacatacccgattcaaatttgaatttgaattcaaatattagtttatagacccaaagtttataagtcaaaagtttacatactcgtttcaaatttaaatttgaattcaaatattttttatatatagtatttccatacataattttttctaactttgttttctttttttaaaatttatggtgtaaaagtaggaagagaagaagggggggaggaagccaggaagggggagaggagcgtataggggggatggggggtgatcgctgtgggagatcacccgcccattagccacgccatcttgatttagccttttggctagatcggagtggttggcgactccatatcaccgtaagacgtttaggtatcccgatcatggttgtcttcttgccaaaaaaaagttgtcaacaattttgttgaagtactttttgagattaatctataaatatggagaccatgattataagtcaaatactacccccttttcaactgtaaatctttttgacttgttttttcaagtaaaactttttttagatttaactaagtttataaaaaaatatagtaatattttcaacacaaaacaaacaaaaaatattaaaatatgttcaacgttagatgaaataaaataaaattggtgctataagtgttactttctccgtttcatattataagtcattttgatttttttagtcaaatttctttacatttgattaagtttatagaataatataataacacttctaacataaaataaaatagattatcaaaatatatattcaatactagatttaatgaaactaatttggtgtttaaaatattactaattttttctataaacttagtcaaacttaacaaaatttgattaggaacagagtcaaaacgacttataatatgaaacagagggagtactatattttctataaattttgttaaactttcgagaaatttgatgggaaactattctaatccctcgaggggatgttccctcgtttgctcaaaaaccatctaaatggttatgaaaaattctggaaaaatttgacaacattcatacaacacatatatacaactccacaaaatcttaagtccaaactcaactcacacgtcgagatataaaaaagacaaattcagcgtatgaatagtagcgtactgtttatatctaaatttgtcttttttatttctcaatgtgtagatcgaatttgaacatgaattttggtggactagtaggtatcattatactgtacattgtcaattttttttcagaatttttcacaactatttgtatcgaatttagaagaaaaaggtatacgaggggatatcccctcgagggattagaatccactcccaaatttgactttaagaacggaagaagtattttagaagttatttataatattttttgaaaaaaaaataacatcagtttattaaaaacaataattattttaaccggaggctataagtactttgaccaagttggcaagttgaattcgtaccgcttgtggatggtcatgccctctgccatttgctgcatcgatccgcaccttcctcaattagatgccctgaggtgtagtacgagaaatagcaaagaaaatgacctcgaggtcaacccatctccattgtcgacgcacccatgcacattttcccctatcagtgtcagaatccctctatatagtaccagtactcgatactctactcactcactaaccaaaaccctcactgctcgatccccaagctcgagatgggagcttaccagccgctgcagcatcaccatggcggcgccgccgccggctacttcctgccaagaaccgccgtgacatggctcgccgccgcctgcctctcccttgccctcctccacctcctctgctgctcccctcccggcggccaccaagccgtcttctcccctctgctccagtatttcaatggcaatggcacttactcctccaacatctcgtcttctgggtatgtacaagctaagcttggatggatgagcgagcgatcgggcgagctagctagctcatcaatggcggtgttcgttgtcgttattgttgttgcagggtggaggagaggtcgtcggcggcggcgtcgtgcgactactcggtggggaggtgggtgcgggcgccggggcacgcgcggcggtacaacggcacggcgtgcaacgtcaagccggagcaggactgcgtcggcaacgggcgccccgagacggggtacctggactggcggtggcagccggcgtcgtgcgagctcccggcgttcgacgcggcggcgttcctcgccgcggcgcgcgggaggcacgtcgcgttcgtgggcgactcgatggcgcgcaaccaggcggaatccctccactgcctcctcgccgccgcgttcccgcacgagctcgtggcccaggacgccgagcgctacaagcggcagttcacgcggtggtcgttcccgtcgcacggcgtgacgctgtccacctactgggcgccgttcctcgtcaggtccggcggcaagccgttcaactacaccatgccctacaacctcgtctacctcgacgagctcggcaaccggtgggacgccgacgccgggacgatggacgtggtggtcctcaccgccggccactggttctggaaccc

SEQ ID NO: 41164 - DNA, 23860 bp, Oryza sativa
ggctccgacgggcggcggcggaccgtggtgctgggcacgttcgcgccgccgcacttcgacgggaagccgatctttgacccgacggcgtgcacgaggacggagccgtacagggacggggagaaggaggtggggagcatcgagagggagatgaggagcatcgtgttcgaggaggcgaccgccgcggcggcggcggcggcgacgatgagggtggaggtggaggacgtgacgaggctggcgacgatgcggccggacgggcacccgggggtgtacatgcaccgcgacccgttcgctggcggcggcgcgcggccggagcggatgcagacggactgcctccactcctgcctccctggcccggtcgacacgttcaatgagatcttgctgcagattctgagcaggcagcggtgattcgagccagtgcgtgcgtgcgtgcgtcggtgcgtgcatgggcattgtttaattgtgaattgtgactgtggtgtgtacgtgcagttcaatttctcgtttatttcgtcctgctaattgtaacttctgtgtgttctggtcaactctgaattaaccaatttcatggcaacagaacaattcttaggctgtgttcgcttgtgctggctgagaatctttccttccagcatggaaaacacatgattaattaattactacctccatattttaatatatgacaccgttgactttttatccaacgtttgatcattcgacttattaaaaaaattatgtaattatcatttattttattgtgacttgattcatcattaaatattctttaagcataacataaatattttaatatttgcacaaagattttgaataaaacaaatggtcaaacgttgtttaaaaagtcaacggcgtcatacattaaaatacggagggagtattaactaaaactaacttgagaaatggattaatataatttttaaaacaacttttctatatatatattttttaaaaaaacacaccgtttagtaatttgaaaaacgtgcgcgcggaaaaggagaaataagagttgggaacccctacaaacgaagcacccttagaaccgttaaatccattggttttggtgttggtctacatgctaaggacagtctcaatcctccatcttagagcaagtataattgtaggttgtaagccgactaaatgctgagatggaggagagaagagaggagagagaggagaagcgggctgtaaacttacagctggcttgaacataaaaatcaagaaactctatgagagagacaagtggatcctatattaattgtaaagagctaactattatatgggtgggttgagagaagactgaaaaacctttatagccaacaagttggctgtattattagccttgctcttagttagttttcataacattaaatataatgccatataagcaaataactaattaaggtagctagagaattaactaggcgaaataaaaaacgtgaagaaaccatttctcatataagaaaccaaccctacgtagaaaccaacaatgaaaacaacaaaatacatggatgaaatgagagagaagggagatgattggatagagtttattttgaagaaactactcattgagtatattttttttatacatgatatctaagtgacatgacgagtatgaaaaatattcgatagtttttgggttgggattgtcgtatgttttggtgatgtggcattcaagtgtgtacaaacatttgcttcattataagggaggagtagaatgatgagaggacaaaatttagtgatatgggagctaatgtatgtgccatgacaccgaaatcacggtggttttggttctacgctttgacattatcttttaaaaaaatattgtggagctgtgggcttaactaatttcagcatcaataaatgtcaagtgcccaattttgtagtccatgaacaatttgaaatgaacaattaatttcaagactacggttcatgaaacagatttttcgttcatgaacgtgttacatattcatcactacttcaaaagaaatagtttttgatatatttcagaaacaagcaaatgactaatttggatatatatatttaaaacgaaccgccctcaatggcgtgtaatatttccctaaatggaatgatacaagaaaataggctcgctagttggctcgccttgttagttagcccgtgcatataactttagaaaattcatacccaacatggtatattattttctatttttgtgtaacctaaagcagataatatttccccttgtcctatgcatattgtttagggtataatcattaaaagattgtgattctgcgttttgttgaaacacacttcatttatgtaaaaagactatggttgtatattgactaataccctcgtttcaatattgaaagataatatttgcctctttttaattaatacatactacctttcccttgtatttaattgttttaacattattatttatttttgctgtcaattttttaggccagtttaaaattttatttggaaatagaagtgttggtattttatttgataccaacattttttatcataagatgaggatattggtatttcaaaattttagaacacagagaagtgtaataacaaaaaaaaagaaggaaaaagaatgaaattggggtgggagtttggcccaagccagataggcccagtgcctctcctctgttgttgggccaaccaagttgcagcccaagtggccagttcgattcgcatgcgcacgacgtgagtaggggcaggggcgcgagcacacaatggagcggagagcacgcgtcgtccaactattggtgccacgtgtcatgcacttttgcatgaaaacccgccggctttagaatattagatatgcacaaggaggccacgattgattcagaatggttgaccttaagaaatgggcctgttttatttgctaataattgaatggctgaatttttagataatggaatgaaatattccgacagccaattattacaaggttcgcacaaaagcaaactcacactgtgagtatgtagccaaagtaacaaaaccaaaagtaaaagcaaactaataaaaaccaagcaaggtaaagacccaacaactattgaattctattggtgaatctccacccgaagttggcaaagagctacatgatcgtcgactcaagtttacgacacgtatcctttattagcttgatatgatcatcatacctttgtagttaagcacattcccgaaagtaatatgttgccctgaaaagaacctgcaaataatgaatagccgaatgttttaatttgtcagtactatttgagattacaaatgaataaattagctatcataaagttgaaaataaatttaaaataatagtttttttttaaaaaaaactcatatatatatttaaaaagttcttgtgaaaatcgtgtgtcatattaacccattatttccttttattcattggaaaataattgtttgcgtcacgtgtggatatccgtgtgtctatttttctttggttagctctagatctcaaattaatgactacccctgtttttctcttttgctcgatgagtttattttacagtttttgaaaataattgaaatgcgaccttggtcattactttttataactttgcactacgatacagtagcaaaacataatattatgaaaacattattactgaaaacctagatgatttcagatatactagtgatcaaacttcggaaaatttgatggcaggaatttttcaaaacgtcaaaataataataacaaaaagaatgacagcctagcttgtagtagtagagaaaaataagagtcgactaatactaaatcaggtgattacttgtactaatttgtaaaccgtgtgagcgtccgagcgatgatctagccataaatctttccgttgactctcgcgattccaaacacgatggcttggaattggagctcatacttcgatccattccgttaattaatccagaaatactccattaggcacttcatcattctccatttttgtttgctcctacaagaataatcagtagtgttgtgatcgcatcatcaattcattattcatcatacagcaatggcagctgcagaagtagaacacagcggcagctccctccccaagaagctcgtcacttttgctctctgcgccatcttcaccttgtccctcatctacttctcctcccctcctctcatcatctcctccaccaccaatcttctctcccaattccaaacacgcgcacgagctagaaccaccgatttttctactcatctcccaggtaattattaggatttttttttctgagctcaattgagcagcatttcttgcgatcttgattggtttcttgatttgtttttagactcatttcccaggtaattattaggattttttctgagctgaattgggcatcatttcttgcgatctcgatcgattggtttcttgattttgtttttagattcatctcccaggtaattattagattttttttctgagataaattgggcagcatttcttgcgatcttgattgattggtttcttgatttgtttttagactcatctcccaggtaattattagatttttttctgcgctaaattgggcatcatttcttgcgatgttgattgattggttatcttgattttgtttttaggggtagctgtttggaagcaatgcgactacagtgatgggaagtgggtgtgggacggcgaccatggcggcgccgccgccggcggcggctcgaggtacgacagcgagaactgcgacatgaagatgacgtacaagtgcgtcatcaacggcaagccggacggcggctaccttcactggcggtggcagccggcgtcgtgcaacctcccggcgctcgacccggcggcgttcttgcggctcctccggggcaagcggctggcgttcgtcggcgactcgacggcgcggaaccaggcggaggccctcgtgtgccacctcgccacggcggcgcggccggtgacagtgcggcgcgacgaggagcggctggggcgcaagtctggcggtgggcgttcccgtcgccgcacgacgtgaacgtgtccacgtactggtcgccgttcctggtgcggtcggaggggcactcggaggactacggcatggcgcacgaggtcgtcgtcctcgacgcgctcaccgagccgtgggcgtccgacctcgccgccatggacgtgatggtgatctccgcggggcactggttcccccacagcgccgtctactacgacgacggcgagatcgtcggcgtgcacggccggccggacatgaaccgcaccgagatgagcgccccgtccgtgtaccgcaaggtgttgcgccggacgctggagcacgtgatcaacgccaccatggcggacaagctcgagctcgtcgtggtggagacgatcgcgccggcgcacttcgacggcaggtacagctggaaccaccgcgacgcgtgctcgcgccagaggccgtacgacggcgacgtcgacggggaggcgaaggtgggggacaccgaggccgagctaaggaaggccgtgctggaggaggtggcggcggcggccacggcggcgaggcggcgctgccctgggctgcggttcgaggtgctcgacgtgacgaggctggccgccatgcggcccgacgcgcacccgggcgtgtacatctacaagaacgcctacggcggcggcccggtgccggagacggcggcgaacgactgcctgcactggtgcgcgccggggccggtcgacacgttcaacgacatcctgatgcagatgatcgccggcggctagctggccgccgccgcccgccgtcgtcgagctcgatccggcacgtgcggcgcggtgtgtcgccgcacgccgcgttgcatggtctctgcgtctgcgtggatggtggatcagatcacgagaatccgaagctgtcggttttgttctgactggttcttgaatcctgacaattgactttggtatgcgttttttataagcactttttcagttccataaaaaatatttcttcaaatacgtattactagagatatataagaatatgtctatattcaatatgagattaatttttgatgggacgagattgatttttgttagatggagggaatgttcttctgccaatgggattcagaatcgcagtttgcagatgcaacgtgtgctgacttcaatctcgatgccattgattggcacagtgtacaatggtctatttcaccttgaatataagcatttttatattatttagcagttaaggaaaaaaagcgtgctgacttcaatctcgatgccattgattggcacagtgtataatggtctatttcaccttgaatataagcatttttatattatttagcagttaaggaaaaaaaggctttagagtgtttgtacttgtagacagaggaaataggatatatacggccattgaaatagggaacttagccctgcaaacaacccaatctgaaatataagcatttttatattatttagcagttaaggaaaaaaaaggctttagagtatttgtacttgtagacagaggaaataggatatatacggtcattgaaatagggaacttagccctgcaaacaacccaatctgaaattcgctccataggagatttgagccctgcaaacaacccaatctgaaattcgttccataggagatttgaactcaagaccatagggtactactcaggtcactataaccactaggctatatccctttcgtatatattttattgagtatgtggtgtgttatggtgctgattttattgcaaggaaatgttacaaatttcaatagagaagtgctacacgaagggatccttttctatctcgtcctatacaaagggattgctagaaatataccattgtcacgtaataaaagtgcgagtacgtgtgatgccacgcggtgaggacgtgagaccgcttaatctcgtgcaacgaggatgcaatacggctacttcgcatccctaagagtatctccaacagcttcttcaaatcacactctccaaacacccatatagtcagctctccaattgatttggcaagccaaactcattcctcacttcaacagcctctccatctacactctctattatgagcctacgacactgagacccgcacatcagcctttattattctcatggttgtgtaggaggcagcatccttatgcgccatttcgtcgaacaggttgcaggcaggccacatcggcatgcctgggcatgtatctggtaggccaagcgggcatcgcagtagctgaggacggagcaggtgagctcgttggcggcggcggtggccgggtggacggtgagagcgcggcggagggtggcggccctggatccggaggcagagcaacggaggcaaatatcaatcgatcggtatgggttcatttcatgggttgggttcggtgggggattgcaatgcagactgcaattcccttctctctctctctacactttcctcttcctcttctctcttctatgcagtggcacggattctatgtggcggcggctctcttcggaggaggattctatgtggcggcggctctcttcggaggaggattctatgtggcggcggctctcttcggaggagaggtcgatggtggtggtggcggtgttgttctactgggtggtggtggtgaagccggagaggatgtggtaggcgggggaggacgccgacggggagtaggagggcgccagcgcaggaaggggaggggagcacgcggcggaggtggagcgcacggcggaggagcgtggccaccatggttggggaggcgaggtgagaggagaggatatgggaggaggatgacgacgcggcggcctcgcaatcagacgacgacgcggcggagggggggcgccggcggagggacgcggcagagggagtgatgccggttgtggctggggacgttggcggctatggatgcggcagcgccggacttggctggggacagaggcggcggtgccggatgtggacacggacggaggcaacggcggcggttgtggccggggacggaggcggcggggatgggctgtgcgggaggcgagagcgaaggaagaggggagcgagacatgtgggagggatagtgcgtggggccacagttggccagttccatgggatctttagctagccgaatggcttggccaatcaattggagagtatttttttttctctatgttagctataatttagcttggagagccatttggctactctgttggagttgctctaactagctaactcagtgattaatagattaatttgtatcattagaaattaattaattaatgttatttctttaataagcatcattagtacttaattaatcgataatatggttgattaatcactaatcactataccatcctgctagttggtgaagtgagactgcactaattattgccatttattaaatcaacatcattaataataaattaatcattaatctggtcgattaatcactatcattgtacaatgtcgcttgttggtgaagcgagacctccctcgcgccgcgggtgtcgtcacgccgtcgtcattttcaggcaactgtttaacgatatcatatcgttttcgcactttccctcagcaacgatgatatgttatatgtttgtgccaaaaaaatatacccctttatatttctgaggaaaaatagtaaataaaaaatatattttcaaatttaattataaggtattacactcggactagagtgtggtatcctcgtcatcaccttaaaaaaaggcttctatgactatgtcctttttttttaatcttaaatgtgctctttattagctcgttggtttggtacgatcacgagacaccagtacatttacagactctgggagggggtcagcccaaacatacaagtcccaacccacacttatacgagcaatgtcaattttttttaatgtctcacacgttgtattgatagagcagaaaaaaattacaagattacaaccctgaagggtcgtaaccaggaaaaagaaaaaaaatataccaccacccacacaccgatagcaccaacacacaagatcgggagaaggctaacaccggaccagccgccgctaaacgtgaccgaccgctactagaccaacaaaggaacacatacgagatcacccaaaagaacgccctcacaaccaacgcaaagccaactcctagagtgtgcttgcaccaatcgttcgagaggcttcggctagggtatgccaaaacgacgtcttcaagaagagaagcgacggaaaaccgccgccgccgtcagtcgggatcaaaaggagtcaagactgggctttcgcccggcaaccacccttgagggatgagactgcatgacaatgccctcaggagggggaattaaccatcgttgtcggtccggccaaggccgggctgggttttcacccgctacttaccacctgcgaatccacggctgatgcaccgatactccaccaccactcaacctctgccaacatgtgggaccactacaccgacgccccccgccggccagccttcgtgtgccgaagaccacgccacattcattggcagctcctcctcgctccgaggtcgccttctccaccgccggccacgcctctcgcactaagccggcctcctccaccggatgtgcctctcgcaccaatctggcctccccccatcagccgcgcctctcacgccaagccggcctccatctccaccgcctgcgcctcttgcgccgagccagcctccgctgccatcggctgcgcctctttgcgccaagccggtctccaacccctcctccaaacgctgtcgcgtcggccagatgcagtcatctgccacgccctcggctagccgtccgaggctgccatgcctcctcccacctcagccaccgtgcctcctcccaccgccgtctgtcgctgcagccgtcaccagccgccgcagccaacagctgctgccgccaccgccgtcggcagtcgtctgccgctgccgccgtcaccaaccaccatcaccagccgccgtcgccagccgccatcgctagccgccgcagtcaacagctgccgccgccaccgccatcggaagtcgtcatcgccagccaccaccgccgctagctgctgccgccaccgtcgccagttgccatcaccagccgccgtccgcacccatcactgctggccaggcagtgtccgagacagatccggcccggcaaggctggatcccaccgtgtgggggccggatccgtggccgccctcgccggggcgtgccgccgccgacgagcaatgtcatgagcacaactattacaagaacgacccgcaaaagacagcttagcacttgggaactctaaatggagcagagctctaatatgcctgaagagcacgccacccggagagcagtcaaaatctgttgatgacaaggcacacagcaatgcagagtaatcagtctgatcaaaatgcgagaaaccatggtgagctgtgatccgtagagcatgcagacaagcttcattctatgactatgtctcgacgcccctggacatgtccaacccggacggaatagtcaacaccagccacaccatttattcatgctggggtcgtcattggcggggagcatgttacggggtaagaggcgaggaaaaggggatcgacgatgaaggtcatctgtgccttgggaatcatgtttggtacgacgattctcaaaactattgatacctggtacttaaaaagcatcagactcggtacttggtaggtactccctccgttttacaatataagtcattttagcatttctcacattcatattgatgctaatgaatctaaacatatatacctatctagattcattagtatcaatatgaatatggaaaatgatagaatgacttacattgtgaaacggagaaagtagtagcgaatatcaatcctaatatatatctggtattcgactagtactcatccggtatcatatggttttggaataagatcttgtacaaatgtacaataacaactcttatttcaaaatcgttaataacaacagcttatatagttatacagaatcaagttgctgtaggaccaggatgtcagatcaagcgttcacggatccaggccatgtattatttttccaacgagaagtgcacaaaagggatgtagtttttcaatctgccaagagggctttcttaacccatctctggatattttgcagtgggaaaaagtatatcgaaggtcacctcatcttgtcatcatattacaaaatcatctcccaaccgcaaaatcagatatatgtcatctcttaacttataaaaccgaatcatttttgttcaatgtggcagctgagtcaacgagggccccacatatcagtgaaacccaacctcttcctctcttcctctcttcccatctctttcccgtgtgagagaccgacgggaaacgatagcgtgggcggcgccccggcagggagaacggcaacggagaggagatacgtagcagcggcgcagacggagaggagttgggtggtagccgcgagaagctcctccgcctcccaccacagctaggatcactcccgagctcctctagagccgcctccaccacggcctccatatgcgtcgcggtggccccgcgagcccatggtacgcatggaggaggtgaggctacccccacgccgatgctgccgccgagttcaacatcatcctcaatgcccatctcccttcccttccccagtactcccgcaaccctacctcgaacgatgcgggaccgtcactggctcaaggaagaagggacaagatccccgcgtggctgcggcgtgagggaacagacacactgccgccgtcgccatcgtcgatgacctgaatgccctgagacatggaggggatgccgaaggtgtgatgggcgtggagcgggacgttaagctcggagacgacttggagcatggagatgcgattgtggaggtggtcgatggcgtgggggcgtggcgaccatggggacggttgggtggagcgtgaagaaggcgtccagttgcccgcgcccctcctcgccgtacaacttgtggatgaggaggtggaagggcccctgctcggagaggggccgtgacgggtttgacggggacaaggtccataccgcgcctaccggcgcgcatcactagcgacggctagttgaagcttcgggatgacacgcgctgggccgccgctcctctcctctgaccacgactcctctccccactcattttaaccatcgagggctcgtcatcgggcgcgcctcccctgtcgttggtcgccaagaagagagaggaagtgaggcggtcgcgtcgtgctcgggggcggcgcccgtgggtctaagccgacgcccaactcctctccgctggtgctggtcctctccccgctcgtcttcaccagcaagcgcccccaccgccaactcgtgcgtctttggttctccccacctatcgccgccagcgctctccccctaccgccgatcactaagaagaaaggtaaaaagagaagggttagtcgctgacatgtggggcccacgtgggttctaagctgacttagctgccacgtcgcacaaaactgggtcaaaatcacctaaggaccaaaagtgatacggttttataagttaagggatgacaatgataaaatgagggaccttggatgtactttttcatttgctgtttaatagtccttgacactttggtatgggcctaaagtaggtttccaaagcaggcctagtgcttgactatacgagacaatcgttagttccatacgtcacaccagataaatgggagtaaaattgctaactgttgatatgttttatcttactatatgttcaacaacaatacataattatgggaaacatattatatgcacataagttttctgtgcacaccaacaaataaatatcacgtaaaattctagaaaaaaataaaatgtactttcaatagtgctatttggtaaaatctaaaccgagagcgctctcagattaatattaaagagcgacgcatccgtgagagagggttcacttgcaactagtacacctacgtgagagatggtctagttgtttactactgcataaagtgtatctcttttttttcttgttatggacttttctcttaaaatatttattcaatctacaatctaattacactattatgtttgttgtaattaaatctttataacaagattttacatgattatattataataaaaaatatttatgttgtaaattacttttatcatatatgtaagttacttttatcatacatataaattacttttagatttgattaagttacgttttagacattcagtgaacaatatatatactttactttatcgttagttctatgatatgttgattagatttaatttctagataaacttaggtttttaccctctataatagatttacttttgatatcgtgacaagttatttttttaagttacttatattaaattacattactatttattgaacttacttttatatgtctaagaagtaatttaatgaaatctaaaaagtaatttaatgaaatctaaaagtaatttagatatattataaaagtaaattgtatttttcataaaaaatataaggcaaattttgctacaggacatcgcgactttgtggttttagctccaggacaccgcacgaagttacttttagggaaaaacactctcaaaacatggctatttgccagtggacaccgcgtctattaaaataataatttctggttgaagagaagagagaaatcgtgtgaaatattaaaaatacccttgaacccatatgtcatctctcttatctctcttctctttttctccctctcccctcaccgacagcagctagccggcagcggcggtagcaacaacagcggcagtagcagcagtaaacggcagcggcagcagcagctggcagcggcggcagcaacagcagcggcggcagcagcagtagcagccccagtagcaagcagcagcggcggcagcaagagcgccagcagctagccggcaacggcggcagcaacagcagcggcagtagcagcccgctccacgcaatattcaacgggatttgcacggattggttagagttcgccggaaaaataggagatgaaatccgcttcgaatccacgcaatattcaaagggatttgctccaattcttgaggggaatgaaagaggaggataagacgaagaaatcccctcaatcaatgtttgaaacgagcaacgggattggccgaatttggagggggaggtggcggtgtggcgcacgggcatgagagctggaggttgaagacgttcagtagcgcgagggagggaaattagactttagatgtgcagggcaatttggtccggtcgcgtcaaaatatgggcccactcaagcctagtcagcacgaatacactaaacaaatgggcgcggtgtcctctggcaaatagccatgttttaggagtgtcttcccccaaaactcacttcgtgcggtgtcctggagctaatttcacaaagtcgcgatgtcctgtagtaaaagttgccaaaatataatcatgtgagatcttgttgtaaagatttaattgttacgaacataacggtgtaatcggatcataaatcggatgagtgatttaagagaaaattctataagaagaaaaaaaacatgcactgttgggtgtactagtagcaacaagagaggtcgctggttaagacaatctagcttacatctcgttgtagtcatgtcctatttatatctatgaaatctcatgtttaaattcattatattttagccgtatagaaggtaaaattctgacaaaattttgttatggcaagaatataacaaatttaaatataagaatttacaaacttttacttttataactatcagatttttcatttttatggcaagaatataacaaatttgaatataagaattttgttacatctaacatgcattgaatttgaacatgagatttcatagatatgcataatactattaaaagtacatgtcagattttttagaatttttcatgatatttgctagttggtgtgcacagagtgctcacgagagaaacttgtgtgcatagatatgtttccggttatatgttcggttatatgttgctgagttaattgctagagatcctgacacgagatttcgttgttacaaggttattggttggactgctagccagtttttagatatctgatgcatgcatacatagaggagaaagtttatttgttactcaaggtcaaggggacgtcccccttcattttacatttggtcctatagtttgaatcaaataatttcttgttaatccagtattataaccggtcataacatacggttgcgattgttgctgcttgggggatatgtcgaaaagttatgtttttattgataattgttggtagcgtgaaagattgaaaaagccgtcaggtgtgctcatcaattagattaattgaacatcaaagggccatgatgttcggccacctgtccattccctgcaacaactgaagtactgaactgaccccttttcttctactttgtgttcatcgactcctgtaacatagctcaatgttgaaggttttccgttctgtaaactgcaaatttcaagaaaccaagagtatgaccattaattgcaatattcagaaatttctttcagttgttgaaacgttgtacgatgaaaaagaaaaaaaaacattgtaagaacaaatattccattggagttcgaatagtattacacttgaaagttcaggattttaggatatctggatcactgtttatatattcagtactactagttgggaaagcattagcactatgcctatataatacatcccattccaactgataaaaatcgacaggtgagacctttgcttccatggaagctagcatcaggtcagcaaaaaacaaatgacgccacctgccatctgttagccagcctacctcatcaaccatccacgggtcatttctccctccatatccaacacacatttttgtgcatgctgccatcccaagctttctcattttctcagatcatgacgcatatctatttttttgatagtggaattcttttcagaagctatagccaattattatagagtttacgggacggataactacaaattacataattcaagacaagaagacaaccataaagatacaaatcttcatctatggttgattagagtatgcataacctaccaacaacttttaagttgtacttagtctttgcgaatggcatatagtctagtggttgcaatgacctgagtagctccctaagattctgagtttaaatctccatagaagcaaattttagattggtttgtttgaaggggctaagttcctaattaaggatgtgttctttccggtgagttcccaactcacctacctcgtttttcgcgcacatgtttttcaaactattaaacggtgtgtgtttttgcacaagttttctaaacgaaagttgctttaaaaaacatattaatccatttatccatttttcaaaaaatagtaaatacttaattaatcataagaaaatatgtcggctccgttttacgtgtgcggtctcacctcccaaacacagccttaaaaggttccataggtgcagatttcagattgggttgtttgatgggctaagttgtcaatataaaaggctgtgtatattcggttggatatagaggccgggtaaaaaattctcttaaaaaaaaagttgtgtttagtctttatttttctcaaaccagaaaagtggaatctaagaaatcagcgaacacatataggcatatagctgatgtaaaacacggctcacaacgatcatcatcagctcgtcacatcacaatctcacaattctctcaggattggctcaaacacggcccagcaaaagtacagcatagtgacatgcttccggctgggcgtacatatatacgatctgaactctgaagtctgatctgcaactgagaagaaaccaatgcaaaaaacaaaaaacaaaaaaagaaagaaagaaaaagctagctactagcctactactacctaatggttaaaatcaagaactctttgaagcaaagtgagacgagacgagacgagctactgaactgaaccatcggcagaagtgtgtagtttggtgagctactagtgtcacagcgtgacagtgttaggctttaccagaagtgatgagccatccagcagccagcagtgaccatattattctcctcaaacgtccaccaaacactgcaatttcaataacacgtaaccggtcgatcgcaagtactccctctgttaaaaaaaacaaacactgattttcgtgtctaatgtttgaccgtccatcttatttaaaaaaattaaaaagacaagtcacgtataaaatattaatcatgttttatcatctaacaacaataaaaatacgaattataaaaaaatttcatataaaacggacagtcaaagttgaacacgaaaacttaggatttgtctttttttttttttggacggaaggacgcacgcacaaatccttcaaaaagctggctgtggctgccggcattttatcgtcgtcatcgtccacacgtacggtgagtcgagtgagctagccatagctagctatgaagaaggcggccgccggcggcatggcgcctcttcctccgtcgtcgtctcctccgtcgtgcaaagccggcggtggtggtggcagcccgaggtggtcgttgcttcacggcggcggcggcgagtggggcgtcgtggtgcggcggaacgtcgtcaagtcgtcgtcgctgctgctgctggtgttctccaccttcttcgtcttctccgtcttgcgctcgtcgcagacgagcttagtcccgccgccgccgccggctgctgccggccccggcgagccggcgctggcgcagagtggtcacgacgttgccggcgatgatggcggcgaacatgtcgccgtcgcagtcaacaatgtggcagctgagacgcagagcacgccggatgacatctcgctgccgtcgacgaactcatcggctgcagctgttccaacaacaacaaacaaagctgaacaacaacaaacaggtgatcctggtaggtgcatttcaatagtgtattcattattttgaagcaataaacactaagataaattctttgtaagcagtggtagagccaaaaagtatcgaagcctaaagctcgaataggactcaactaatgagatattattttttttcaaaaaatatacatgatgatttaagagaatttaaacgtcaagccaagctatcctaggtttgcctccccttctagatgtaaaaccacataaatcttgatgcatattctctcgtttcttacatgtcacaacttctcgttatttcgagggttaaactttttggtttagccgatttaatcagatgtcaccgaaaaattagaaatttcggtccaaaattttaaacaaaattcaattgaatttgaacaaatattactaaaatttatgaaaaaaattgaaaatttttggccgaagtaatatcgtatcggagtggtccaaaattaccgaaatcagtccgaaaattccaaccatggttatttggacgcggttggtaaataactaaataagggatcaaagtaaatttttaccacgacaaatgtgaggcatttaactttgtgatgtttgatgtgtgctctggataatggcaggagcgaacaacatggaggagaaatgcgacatgtcgatggggaagtgggtgagggagcccaagggcccggtgtacaccaacacgacgtgcccgacgctgccggacttcaagaactgccagaagcacggcaaggatcccggccacctctactggcggtggcagccccacggctgcgacctcccgcgcttctcgccggaccgcttcctcgccgccgtccgtggcaagcgcctcgccttcatcggcgactcgctggctcgcaaccagatggactcccttctctgcctcctctctcaggtatatcatcgcacaggatttgaaatttcggtaatttcgcccccaccggtatgctcaaatctcgcccgaaattttcggctttttacaaatttttgtgaatctggtcaaattttattcaaattcagtcaaattttcaaataatttcggccagaaacttctgaaatttcggtaattttggtcacccccgacataaaatccaatttcaaaattgaaaactatgtcattgcaccggctagcttccaatgtcttagcaatggcggctgccactgattaatggcccgtgtcgtgtctcgtgtcaggccgagacgccgacggaggtgtaccgcgacgcgcacgacaagttccagacgtggcggttcgcggcgcacgagttcacgctgatggtgatgtggacggagttctacgtgcacgcggagccggtggtgggcgccgacggcaagccgacgccgtcgttcgacatccacctcgacaggctgagcgccaactggacgcgccgcctgccggagctcgactacgcggtcatctccggcggcaactggttcaaccgccccaactacctctgggagggcggccgccgcgtcggctgcgtcaagtgcggcggcgcagccaacctcaccgacgttggcgtcccctacgccgtccgccgcgtggtgcgcgccgctgtcgagggcatcgcgcggtgcaccggctgcaaggccggcctcgtcgcgttcctccggaccttctcgccggaccacttcgagcacggcgcgtggttcagcggcggctactgcaaccgcacgcggccgctggaggaggacgaggtgagcccggacagcgccgcgtgggagctgaggagggtgcagcgagaggaggtgatgcgggtgaaggagacggcggcggcggcggccgcggcgagcgggaacgcgaggaggttcgaggtgctcgacgtgacgaaggccatgatgctgcgcgccgacggccaccccggcgcggccatcgacaagaggtggcagaagaacatcgtcagcgactgcctccactggtgcatgccgggccccgtcgacatgtggaacgagatgctgctccagaggctcaccgagatctccacgctggaccaggatgcttccatctttgaggcaccttaactttgtcacttacatgtaggtccggatcattaatgtatcactgcatacaatcatacggggaacgatgcatgactggtgatgctataggggaggtcttcctatccattgagaggacgtgcatatctctcaaatggttataaattttttgaaaaacaatctagatcaatatatgatgtatcactttataaatatgtaaattaaaacaaaacgaacaacaaacaagagactaccaatccatcagttagacgaatgtttgctacaaaaggatcaggtttttcaatggctaggactattttaagattagtactacttctattacctaattacgtccccgattaaattgacacaaacataaagctttatatgccatcacttccctccggctaattccccttaggccctcacttccctcccctctcccccactctcgatcactttgccagagccgtcgttgttattgtcttttcgatttctgatgtcattctctcgacccacgtctcctccatctctatcggatcgacggttactgccaccacctcttaaccacatggtttttccttgccctgaccccacccaccgtcatcctcaaatccctccttccattaccaccaacctaaaaaacctaatataacaaaagcttttttagtccaaaagtcgccaaaaatgagagcttgccaattaagtcaccatcgacgtttctattaccatagtcacatgtgagtacttgccatctttctcctcatcacttgctcttgctagccctagatctttaatccaatggtgttcatcaatcgattgataaatagcaaatcccaacgaacaaatatgaccatgaacaatacatatatagttagtgcaatttcttctttcttttaacttgtatgtttttaatttatcataaaattcataatgatttagataacatggatgaaaaaaggggcataccctagagggaaaaaacatctcctgatgctttggtttggtgatggtatggtcaaaagttttttggaagaaaatttagtccaaagttttcaaagtaaaaggatgttaaatattgtctttacataagatgaagatgctaattaaattcccccacagaaacttatcatctaaggaaggatccatgaaaacttatcatgactatttcaatgacttggcaaaatgagggatatcctcgagaggaaaaactccactttccttctttaatctctatgaatgatgaactacagaagtgaaaataattactcgagtaaaacaacaagaaagagatctactccctccctccgttttatattataagactttctagcattgcccacattcatatagatgttaatgaatttagacaaatctagatattagttcttggtacgccagatattctattgtgcacatgcaaattgcaagaggccggatttagtcgtacaatggaagaacggcctagatttggaggaaacgtttattatttctctggtttatatggaagagaaagaaaggaatgtattcaaggcttgatgatgcttgtgcaatagcaaaacagggatgagtacagctactccatttaatgctatggttatccctccaggatgaaatggatatcttcttattttggacacacataaatatataccaaaaaagttatctttttttttatcctcatgggtcattgaccctaagaagaaattaaggtcatatccataaaccttaccaatgtcctcaccaacaagtgttgttagccttagccatggcacaggcaagtggatgctgcaacaacaacgttcggaggcggtcgaggaggagaagaagaagcagccatgggcggtgggcaagaacgccgcgctgttcgcgttcttcgtcgtcgtgctaccgacgatgatgatcctggccggcgtcagccacacgccgccgccggcggcggcgacgacgaggctcggttggacgatgctgggtacctttacggcacgaggtatatatatctcccccggtatctgtgttcgatttcactgtccacaccaactcaaaagttatggattgtttggtttaaggaatagagtttctctatccgtttttccaccttgaatcaaaagctctctaattgaccaggataattttaaactttgatcattaataagttctaaattagcatattttctttaagaaaaattatatggctatgtttaatgtgcaacatactactataagttataaaacccagtgctttgctgtgaaaataatgtatgagtatatgttcaatgtattatagaaatgataatatttgatttttttaaacgatgtgaagaagatggtttgacatacttgaatattgagctcttcaatattatattccagatgatatatcatctttcatgagatttaagatgctagaatagcgatagttagtgggtgataatgtggtatatttagcttctaataagtggatagcaattatataaaaagtatagataattttcaaatgttcacaattacgtggataaattaaaagtagtaacagttgaaatgtaaatagtgtctcatgacaagtatttaaagagggggtataccatctaatctagttatactgccttatggttgacattgctttctgtttacattttagaatttgtctttggatggtttgttgtcaattaacatcgcccttaatagcttagattgacttcggaactaaagtggatctattagattcctacgagaaacttagaaaggggcatcacattcagtgccaagtttaatgatttaattaccatatacctcattgattgtactatgagttcgtgttacaatagtgtagattgatcattataagtatataacaatattcttttttttgaaatggaaccaacccatatagttctattttcaactaaattttgtgtagttatcgccgctcaatttgtacagaaaattatactagccatgtaacatataaatgtatcaacataaacacatagctatatttgtggatgttttctaacaacaaaatctgttgttgtttgtcgccaagccttaaggcttttttttttttgtgggcgcgcgcgccgtaaaaaaaaaaagtcaacttcacatccctcaggtagagttttattaacatatgtcttaacttttaaaacctaaacaaattgagtccttagaaatattgagaatgatttcggatgaagtagctcagcgtcggagtagggacatgtgacaatttgagcttgctgaggtgggcgagcggatcgaggggcctcccctttcgcaccatcacaacagggtcagcttgacctcgaggacaggatgtagtcggcgatggcagagtggatcataggggcaatgatggagcgggcgcgtggtggccttgttggcagcaacggcttgggaataactatttgccacttttagatttgacaattaactattaaccacccctatctacatgtgtctataatatgtggatacacatgtgtctatgacatgtaggtccagtgacaaatagttaattgccacatttaaaagtggcaaatagttaaatatatctgggaatccgggagaaggggagaggatgcacggtcttttgctgacacgtgggacccactatctttttttttatttcttttggctgactaggacgtcgcacatgacaaaaccaccataaaaaatatacaaggacgtaggctgatcgggttttagaagttaggggcacttcgtacccagtcttggaatcgcggttgaggacgcgtacgaaactcgttgagggaccataagtagactttctttacctccgtgtatgtgtcctgggccataaaatcatcgatctcacagaataagttcacttttgatccctcctcctcacgtcgagtttgaatcacatccctaatccgtaaaaccaagtacgacgcatcactcatctttagaaaccgatgcgaatgtagtcctaagatagtattgaaggtggctttgcccttacatt

SEQ ID NO: 41165 - DNA, 1894 bp, Oryza sativa
tacgccgtcttctccaccggcaactggttcttccgcgtcaactacttctccgagggcggtcgccgcgtcgcttgcagcggctgcagcggcgacgccgacgccggcgagctcgccgacttcggcgtcgcgcacgccgtccgccgcgtcgtcagggcggcgctcgaggccaccgcccggtgcggcgacggcgactgcaagcgcggcctcgtcgcgttcgtgcggacctacacgccgagccacttcgagcacggctcgtggttcgacggcggctactgcaatcggacgcggccactggaggaagacgaggcgccgagctgggaccagtccatcgggtgggatgtgaggagagcccatatcgaggaggtgacgtcggcgaggaagacgacgccggcgacgacgacgaggttcgaggtgctcgacgtgacgaaggcgatgatgctgcgcgccgacggccacccggggcggcactacgacaagaggtcggccggcggcggcgccaacgactgcctgcactggtgcatcccggggcccatcgacatgtggaacgacgtgctcctccacaagatcgccgagaccgcctcgccgccggcgacgaatctccggtgatgtcggcggtgatttggtgacaaatttagcaacaattgatgcaaaaataagtagcggaaattgagtggtcgtgatgtagtactgttgagtgtaagttaattacccgcgctttctattggagatgaaccaaccacccacaacatcacctccataagggacaaatgttttctatcactcaagaaaatatctactcgtttcccatctatctatctatctattatctatctatctatctatctatctatcttctattatatactaaaagtccatgaaacttcctaaaaatactctcaaaccgccacgtggcttcctcaaaaccctcctaaatcgccacgtggcattatattaaatagacaaaattccaaccattgattttcacttaaaataggtggacccattattttgagccattaaatttaagctaatccgtatcctctcatctccgaacaccgcgtacctcctccccgcatgcaaggcgtagatagctaggtacgcatccactcctctccatctccccttttttctccaaggttgttaagatacaaagcataatttattacaataagttagatagaggtatggagcctgcaggagctcgctgtgcaccatgcatgctacctaaattataggagtgatcacagtgatacacttgaactacacattcagtttattatacacttgaactactgttttttaatcaaatcaacggtttaagactcatattagttagctatattttggtggtaaagaattattacatgttgggctttttcaatttatcacatgcacgtatcattttcatgagtcctccccaaaattgaaggaaaccctaaaaattttcttcaatatcaagtctaattttttattcaaatcggtggatcaattatgatacaataaggcaatagtaactaattaactacatacgtactctctcatcctcctctcctctctcattcaattattcattcttctaatttttaactaattagcaacttaatataaaaacaaaaaaaaattagaaagctaaatgattataattcttaagttatatctggtttttaagttcaacaatataaaagtaaaatatattacttcacaaatataaatatatttagtaaaattaagatctatatatgataaatatccactcaatgttctttaaaacatcttctaaataattcaagatccatattacccatatttcactataaataatacgtcatttgtagacacctatgcgtgtcaaccaaataaaaaaaatcaaacaaactatatcaccttaaatcat

SEQ ID NO: 41166 - DNA, 6208 bp, Oryza sativa
tacattctcaatagagcacttacatgtcacgtgttacgtcttaaatttaaaaataaaatcttagaaattatagaaaaacacatttgaccactggttatgaattaaatatgtatatccattattttaaaccattagatctatttttttaaaaaaatcttaagccgctaggggttacattttaataattaaaaaaatattattcaaaattttaggaacaaaacaataaatcatcggttttcatttaaatcatttataaaaactaggaaataaaccccgccccaccccccaaacttcaccccctcctcacatatgcacaaacacaacactacccgtcccctcaccccttggctcgcactttcccctataccctccttgatatttttataaccaataaaaagagaaataatcaataatattaaaacatacatatcttttgaaccacacatctgattctaatataaattgctctatttataattaaaccaataatttaaagatccataacgcctatattttaaacttaaaataagagtagtatcaaaataaaacaagatatagaaaatatcaatatgaacattggttcctacttttcactaaaattagaacaattatacatgttcctattttttaagtgcttagatattattggttttcatgacattatgagttcctctgtacattattgtatatatataagccacacaatgtttgcggtttatagttggttgagaagttatatttgtaattattaaaatgttcagactcatattaactaggtattttttttaaaaaaagaaagatactatagatcacacatatattagggaagggagatctacgatatatctttagaaatttatatataaatatataacaaattgcgtcaataaaatatattcattaaaaaataaaatatattcattaacaataatagttatttaggattttctaaaaaaagaaagcacctaaacattttattaaacaagacaaaacatcacatgtttccaaacaaattaaatctaactcctttctagataatgaagagatcatagataattatttataggaatgtattaaatattatgtattttaaaagctaacaaatagattggaaaaattatctaagcaacactgatgagataagttatggataaacaatacttatgaaatgacaagtgtcatctggctgatattatgccattttatatatttttttcaaacataatttatagtacatgcctacgcatcgcgcgggctaccttcctaattatatctaaatggttatcaaatttttttaaaaaaaaaatatgacgagatagattaacatgaaatacattacttcacaaggtatacaaattcaaatttaactcagttttttttacaagttatagaactcgaatttcaacttgcattttgtagagtggtatatttcctattaatatgtattattaatttttttataaaaaaactttatgactatttaggtggcatgtaagaaatgagaagaccagccccggtcctatgattttgagggcctcagagtgaactcatcgcgataggccctctagactatatataaaattttatgatatatatagacgctaattttacttgcaaagcgaacacaaatccattgaaatatttaatttaacatatttgataattatcaaggaataaagacaaccaaaataacaatatatttgtgcccttggaatcaatatgattaccttaacaaagaatagaactctatcacatccattgcttcccatgaaaagatactcttcgagcatctctagggctgaggacgagacgatcagattgaaggcggcggatgatgaattgagggtgagcggaggaggaattgaggatggcgcctagcggctagcgtgaggaattgaggatggcggcgcctggcagctagatcgatctgatctgatctcctgtctctgactctctatctccgtcgcggcatttccacttccaccacaaagctgcgtccagagctggccctcctgctgcgagcctgcgactatgcatattggctagttatctgctattaggtgtgggccccgggcactggagaagacatttacttgagggatgaaaatccatctccagacaatctccacaattaattaagagataaatcaacagttaattcacatatttgggtaaggagattgaaggataaagggataaggttgaactcctcacctccataaagtgaggcaatctccttatgatcttcatcatacataaggttgaaatctatatcatgtttatccttcaagtgaagtgattgcctcaaaaaaatgaatcaattgataaggctgaactcttatcttatggtgaaataagatatttgacaaatatttattctacttaacataagagtagatgtcatccataacatgtttatccttcaaatcaagaaatatatgggtctgtgaatcaaggcagaaatctcctcagcaatgggaatcatggggaaatgggagagatgcatcggaggcagaagcaagccaatgtcgaggcagcgcacgcaggaggctctccgtcgagcacctggcgactccgaggtggacaggaaggagaagccatgggcggcgcggtggaaagcttctctgatcgcgacctgcctcgtcgcgctgccggcgctggtgttcctcgccgtcggcggcggcatgccctccgccgtgacggtgcttggcggcgcgggcgcggcgagagcaatggcggagtgcgacgtgtcgagggggagatgggtgagggagccgagggggccgagctacacgaacgtgacgtgctcgacggtggccgactacgtcaactgccagaagttcggcaaggatcccggctacctctactggcggtggcggcccgacgggtgcgagctcccgcggttctcgccggcgacgtttctcgccgccgtgcgcggcaagcggctcgccttcatcggcgactcgctggcgcgcaaccacatggagtcgctgctctgcctgctgtcccaggtggagacgcccaccgacatgcacgccggcgcgttcgtggacgcgttccggaggtggcgcttccccgagcacgacttcatgctcatggcggtgtggacggagttcctcgtccacgccgtcccggtcgtcgccggcaggcggacggggccgttcgacgtccacctcgaccggatcaacgcagaatggacgcgccgcctgccgttgctcgactacgcggtgatctccaacggcaactggttcttccgcgccaactacctctgggagggcggccgccgcgtcggctgcgtcgactgcggcgagcccggcctcgcccacttccccatggcgtacgccgtcggccgcgtcgtcggcgcggcgctcgacgccatcgccgggtgcgcggactgcaagcgcgagctcgtcgcgctcgtgcgcacctacacgccggaccactttgagcacggctcgtggttcagcggcggctactgcaacaggacgcggccattggaggaggatgaggtgagctcgggcgtcattgcctgggagctgagggcggcgcagatcgaggaggtgaggaaggcgagggagaaggtgacgacgacgatgaggacgaggaggaggttcggcgtggtggacgtgacgccggcgatgatggcgcgtgccgacgggcaccccggcgagcaccaccgcaggtggagggggaggaatgccaacgactgcctgcacctatgcttgccggggcccatcaacatgtggaacgacgtgctgctccggcggctcgccgagctctcgccgccatcggatgcacggtgagatagtggcgcgcgtggaaacagatcctctgacttatttgtcctccgattttgagtggctgacatgtagatctcataacttgtggacccacgtgttagtcacccacgttggaggagtttcttcatgcgtgcccactatgaagaggtttcctttgctagctgagtactccctccgtccaattttaagcgcaaccatgagttttcatgtccaattttgatcgtccgttttatttaaaaatttttatgattagtattttattattattagatgataaaatataaataataatttatacataatttatgctttatttattttttttaaaaaaaagataaataagacggacgattaaaattgaacatagaaatttatgggtgcacttaaaatgggacggagggaggagctgttgatatgcagttgattcaccaagttgcaatcttctgaaggttttttttttagaaaatgtgtcacaatgttgcagtggaggggactgaaataaccaggtgaattaattttagctttatgaggccattttgttgggatgaaattaagatgacagtttattaggttgtactcctgtttcatataatgtaagatattttggttttttattctaagttaaacttcttttaattcgatcaattttataaaagacataacaacattttacccaaaaaaaatattataaaaatgtattgaatgatggatttaatggaattaatttgacgttataaaatgttactgcattttaatggaactaatttgacgttataaaatgttactacattttatataaattttatcaaacttggaataaaaccaaaacaacttccattctgagatgtagggagtgctattaaccttcctaatacattacatggacaggatagtaatctactactagtactccctccgtcccaaaatataagtatttttagctatgaatctggataactgtgcgttcagattcatagccaaaagttgttatattttgggacggaggtagtagttaattgccaaacaggatatatataggttggaaatgcaactatcaaactggaacttttgagataaagcaattatcaaacacaagacatcattttgtctcacagacctctgctctgctcatcaaagaacccctcttgttcacttgaagcatactagccttcttctggacatgacacccttgcagctgcaatgccaaagaaaaaggacttagcatcttaaataaaaactctccaagaattaagcagaaaaataacagtctacatgactacaaattcacagacattgacgtgagaaagctaaaattttgcagcatattcactcacaagaaagaacatccgcgccgtgttttcttcttcttcctgtccctctgctttgttggaggcttgattactaccttgatggcagcatcaaacacagcttttacattctacatattattgatatttgttaagggattacccaagctatatcttcaggattgaaatgtaggcaccttcaggagcatagagaggcaacatgagaaattaacctgctgtgtctttgagctgcattcgatgtaacacgttgcgccaatgtgcttgcggagttcctctccctgcaagataagcattgcaggagaacacagaaatgtaagatgctggaatgcagtgatatctcaaaattttgcagagatttactgtgaaattttcagtcctcaggtatgcagagtgcataggtactggagaataatacctgtgctgtagtcacaggcaccaagctaggatggtcaagtaagtagtgtttatcttcacgaagatctgtatggtcgacaaaagttgtggtttaattgaacagtaactgattgagatttgttgcaagataagattgtaggcttggttttcaaaaaaaaaataaaaatccaaggcgaaatgcaagaaacttgaaaacatgatcagcataattactaggtaaatttcactagcctatttcattcaatattactgaagtgcaaccttccttttaaaacaggtgcaacatttattttacttaagtatttagtactagagaattatcatctgtttaattaattgtagtggttactatgttagatgattaactgcaaaggaatatagtgtctcccatctaggtaagagcttggaactttgagttccggaaaccgaattcttgcttcggtaagttactaacaaataagcttcaatttaaagcagaaaaagtccaaataaacccctaaactttcattgaaagtccatctagaatcctgaagtttgaaatcggaaattcaaccccctaactttacaataccattcatatggaacccttaggggggtttacaaagttgttttatttaattggcatataaattggatgagctttgatcatgtgacatacgcatatgt

SEQ ID NO: 41167 - DNA, 788 bp, Oryza sativa
ttaattactataaatttgaaaaataaatttgttagatttattttaggaaacattttactaaagattttagtaaaatatatcggttaatagtttaggaagcatgctcacggttaaccaaatcccaaatgaagatcctaacaaaaccttaatcggcttgtcctgcttttgatattaatagtaatcgtggacgcgcaatgcacgttatcacaacatatgttatgaaatataaaaccaatgcaagatatttgaaaagcatatacaaaccaactacttattatcccaaagactttacaataaagtcctaatcgaaagacttacaaactaatacaaaccattggaaaatccatgttaagaaacatatacaagaacattaacatcaaaaagatatttcagtgtggttcccaaccttttatgcccatgttcgtaacttgggtacaaggatgttttgtggtctgctaagatacgctccaatttctagacgtccttttcactttcagtatttctttacatcacacaacatatgatcgagatcatctgcaccatcattttctgcaacagctccatccacctcgcctgttggattttctgcaaatccatcgtattgagcccagtctggaatattgttgtcttcttcttcatcttctttcattgcaacccctaactctccgtgcgaggtccaataattataactaggcatgaatcttgactccaacaagtggacacgaagcggtctcgatgtagagtgctccttctagtttttgcattttttacatgggcaatatataaaa

SEQ ID NO: 41168 - DNA, 42945 bp, Oryza sativa
  unsure (1)..(42945): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattctcattttatacaaaagagttaataataaatactcctacgttggagtatatggacatgtggaaccaatccacaacacacaccatatataccaattatatggttgtgaggtactacaaaccatgtacgactgcaaataacgaacccagggaatgatcaatgatgaacgtggaatatgacaatcgaccacttttacgagaggagaatatgaggctagcttaattggtgacgcactgtagatcgagctggaaattaaacagtgacctactacctaacttggaacaagtaccttccgattattaggccccacacacatcacaatctatagtcatgctaactaaggaattcgtacgtgtctagaattaaccattcgaattttgtgattgtgattgatcaacacacttgacacatccaattagttatgtactgcatgtgatttctgcatgcttaattttttttattttggggtttgatctatatacatttataatagaaaactctcaagttgaattaaagttcttctcatgaacagcacattattgtcaatctatccaatttttttcagctttccccccttattaaaaggtaaataaaagctcttttttggcaattgacttttgcttgaagttggttgtttttcatcccaaaactttcaaaaatcgaaaaattaacactttacaacatactgtattatttttagcggtttttgtttgaaaacaaagcgagttttttaagttcatattctttctgtgcacattttgttgatgtatatgttgcttttagggccacaactatgaaatggaagtagtagctaaaaaatattcgatggtttttctcccccaaacttttgaatttgtgaccaccggattgtcttgagatttgggcggcatacaaggaaaaaaactgcaagtcatccttgggagggagtcaaacccacaacatgtggcttcaaagcttgtgaaggtagccacaacttccgggggtaaattttgacaagttatgtataaactagattgcaattatagtaattattgtgtagttataatttaattacatttcaaatatgctatatacttatatttggtttaatgttgtttggctgatcttcaagtaaattatcgaatgttgtatggctgatcccctatgaaattacctaattgaagttcatggtagggataaaccactttcataccgattaaaagtttaaaacaccataaaatatattatggatgttattatttttttaaaaaagctaaggatgaaaaaaaaattggttctgtgttggaagtgaaaaatatattttgagcaaattcaattaccaaacatagacttttttccaataaggataaaatgtgattatatatttctgacctctggatactgtgcacacacaaaccaaccaacaaaaaccattgtcccctgtttgatcaggatgatgacttgcatattgtagcatccatcttgacatcgaatccatgataggtaggaaccacagctgcatgtatctcactactactccactcatcaacggctggcttttgacaattaagcgacgatccatggagcgcgaaaatagaaccgctcttttggaaaaaaaagaaagagagatcgagatcgcgtactgcgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctgcatgcatccggtggcaacgacggctctgacgacgactcgagaggatattaatattagtaaagccggtggctatatagcagcgcattatggctgtccctcttgcccatgatcaatcattgtgcatgcatggcttggcttcttatatactccctccgtttcaaaatgtaagactttctaacattgtccacatacatatagatattaatgaatctaaacacacacacacatatatatatatatagattcattaacatctaaatgaatatgggtaatgctaaaaagttttacattgtgaaatagaggtagtactagcttaactggtgccctgaaaaaaggttgatgcttttccacagaaaaaggagagcttggatcgatcctttgaggcatctggccaatcttgttctggcttatgcaacaatcagggtgtacacagacacaataattaactttggagctttctctaaaaacacatataaacgcatacactcaaatacacgcacacatcctatatatctataaagtttatcctcactaagtgtagtcaatactatttctccattctctcatacaaccacatcaattcatttgtttttaaccattggatgattgatctattatcttcattttttctcttatgaattttgttggatgacctacatatctataaagctcattcacactaagtgtagttaatgatatttctcttttatctcattaagtcacattacttcaattgtttttagccgttggatgattgatctatgattcaaattatcttcattcgtttcttctcctatgaagtcatatcactttaattttgcttttggatgatcaatctatattatcttccttcgttttccttagttattgagccatatcacattatttctgcttttgaatgatttaaattatcataaactatgtcatcttaattatttatattttttttcaatggtcaatcaaagatgaaaattatataaagttgatgaagttatgtcatccagttatcttatatactccttccgtcctaaaatataacaacatttacccctcaaaatttgtcctaaaatataacaacttctccaccaacattctcttcccaaccaatcacagctctccaccattcacttttcccacctacctccactactcaaccaatcacaacactccactattcacttctatctactttcttaataaccatgttcaactctaaaaatacttatattctgggatgaaggaagtattatttatactattattatatagaactctcacagcaacacgcagggtttcatctagtttactgaagggtgtcgagtctacaatttaattaaatccgagtagacagattctaccataagaaatttaatcagttgagatacgctcactcatacatttaattttttcgatgcaatgttgtgttgggggattatgcccaagattgtcataattaaggatattactagagcggctgtaaataaaagatattttggcaaaatgcatgaaaatcgattccgtgaattggatcctgagataagccttcaaattgagccattgaggtaacaaaataagtccaattttcatttatgatatttggatatatgcaattaagttcaattgaattggggatacgtctatcacgagtcttgatagtactagataacagatttagttataatttaacgacgtattttgagaagctgggaaccatcacatgaaagatattaaaccttcattcacaaatgtgcagcaaaatcaaattaatcccacatctaataacacatgttttgtcttttaggtttaaaacctaattctcctttttggacagcaaggcaccagtggtctagtggtagaatagtaccctgccacggtacagacccgggttcgattcccggctggtgcatgaacttctatttttttgggttctagcttttctttagcgaaaattttgacgaaaacaaacaaacagccacagtttcagtttttaacagaaataattccggcgaaaattccgaaagacatctccagcccaagctctacataatcgtaccaaatatttgtgaaaagaagtagatgagtgagaattgaacactgtgggctggttacagatgagcgtacgagtctatcttgctagcttgcatctttggttatattaatggaacttataattatctagtatcatattatgtgataatataatattatgacattattcggttatatatatatgtgctaaataaactataaatgatatgaagtaatataatcatgtattataattaagtatgtgatattataatactttatttctgatacgaattttcaccttaacattatatttctttttcgacaatcccatctccaatatccaatagatctgttcagattatattctcgagaaaaaagtaatgataaaaatggaagatagatttgttcgaccattctcatatatatctagccagtcttctctttctttttctttcactctcgtaatctattattctaaagctggcagtgcttgctgccatttgattggtccgattggaaacacatttatacgtcgacacgtgtccagctaaaattaatgcttagtcgcgattcgtggggaagcagcgcgaggaatcgcacggagcaccgagcggcccatcagttcaaccacagatgtcgaaggctgcaactgcaaagatggttggcaggctgtcgcaggcctatcgagtctaactgggcacctggatgcccaataaccacacatgcacatgtagtccagtccaaataggtgaatgcttttgtgtctatgcttgtggtatatataaaaatatttaatttagatgatcacaagattttattcacataccaaacttattgggtgtatatattagttattatgcaccctaggcttgtgcacacatatttcctttttaaaaaccaaaattattgatgagtcaatcaattgataatttatttttcaaaatatcaaataacaaatgcaagtaaatgtcacatcatgccaaacgtatatatgtgcactcaccgtacatactatgtgctgccctcggttacactcatttttaatttgtaatattaagggtacttgttttggtaacataaaaacatgagataacacatggaataagtgtccaattgcttggttttcataataagctgaataaaaatatacaaggtaacaaaaatatttgcctaaggaaaaaatggatttatcagcttttagcgaggctaaaaataggtataggtgattcagaaaagaattggcattgtgccacacaaaaacactatatttggattctaattggacaacattagtagtttcggctcaatttggagcacttaaaacgtaagagtttatagattatgtttgcacaacgccatatctcagacaaaagttaaatttgaagtttgtatgataaataatagtgatttaaaattatatattttatctaggatgggaacaaaataattcatcgaaagataatcttaaatctgaagtagtgccaaacaaaggccataatatacgtgggctaaaattagctagcgcgtcaaaggacgcgcctattttctagtgttgtactgaagaggatgcccaaattaatgagcataggaagtccatgccctttttgtcccgctctcgcgagcttatcaagggatacaataataaacttgttatatcttataatacaaattccatgcaaacaattgaaagaagaattgtgccacgtggcaacaccggtttcacgggatggctcgatcctgctaattgcgcgcgtgcaagctatgtgatttctcgcgttgctgccgtacggctggcaaagctcaggcagctattgcttcctcctaccaccggatattgaggattaaagaagtaatgatacatattttggttagagactaaaagaggattaacaagatgtaatcaaatcacccactaaaattcctacgttgcaaacatccatccttttacagttattgtgtttccttattttgtatccgtattcatgtgatttatattatttctttcctgtgttttcctctatggaaatcatataaccttttctctttggggcaatttcattcttacccctactttaatgtttaatattgatgttgcccagtattttagggttatttttttgcccatagttttttgaaataaagataaatttagtccctacttttgatggacagattaacgatgttaaatctttagcgagaaggcattcaatacccttactcatgttgcaaacttcccctgtttttgttcatgattgagaatttgcccacatttagcacatgaaccttgcaaattcgataaacttttacccaatatgataattttaacataaatatcaacaaaaatttgcttcaaaatttgacatcttgaaaaaaacaaacaagtcaagcaaatctattgcctacctatgccaagctgtcgtcgtcgtcgcctcctctcataaaccgccgccacctttgttgcctcctcttcccaccgagccgccgccacctcctccccacgtcgagccgccaccatcacctccccgcgctaagccgccgttgttgcctcctccgatcatcgagccaccaccgccatcgttgacctgacctgttgtcctcctccccgtcgcctcctcgacacgtcgagcagccgcacctcctccctacgctgagctacagcagccgccattgtcctcctctctaccatggcctcttgtgcaatgcctagcctcctcctacacgttgcaactgggttgggtggcctacacttgctcgggtcgtccccgttgcctggccggcccacggacactgccgccactgtttcacaacggggattcgggtttaggaagggaagagttgatgccaagtgcccaagcttggagggacaccaagcggtacatgcatattttctaggggtaaaagggtcaatcaataatttaaaaaatcattatctctttctttctctaattctttaccgcactaagtccaatcccactcacttccatcaaaaacaggggtaaacgcctcattcattgaaaaaaatagggcaaaaaacaacaaccctaaaatgtaggcaaaaaacaacaaccctaaaatgtagggtaaaatcggtattggacatcaaagtaggggtacaattgtacaaacaaaattgtccctttctctgttctccctcggtccaatgcaacctatatatgtcttgtgagggctactttgaaacgaagattgagggatgaataggaaaaactagaattctcacaaaaaatcaagcgcaaaacaaagaattataaaacacataaaaatatatgaaataatcgtttgattggaccgtacgaaaaatgcaagaattagatgagagagataaactcataagagacttcgcatgatattgaacctcatgttaaaaatactccaaaacttgtatgaattggggcattccttagaaatttgataagactcaatagttttcaataatcctttggttcaaagaatcatatagaaaaatttcctatagcaaagtttatcgtttctatacagaataaaagttcatatatttttctttcaagtaaagggaccctaattagttactccactaaagtcgaatgagctgggttcactttaccatgcgtggcgaagccacgtggtttttctagtttttctagtgaataccgtattcctcgtttggtgcggtctgtaatacaaatagctttagaactttaattactacctcatagtgttttgtatatgtttagttgttggcttttcggactaacaattgatatgaaaccttacgatctattaggaacggccatttattatggctatgctgaacgacatggtatttgacaaaaaaaaaagttgggttgatgggatttggttgctatggcatgtcaacatttggagcggatggtcaaagaatgttttacatagagcataaatgtaacactccgggtatcttttacctataatgctacacactacggaacaaaaaccactaagttctaaattcattaaaattttgacagtctcccctgtaaatatggacatccacgacaggcagttacatattaaataattaataatatcattcccacagtacgatccatccttataatccacagaaagaaacaaatagatatctgaaagattattataataccaaacgaggatatagtttaaatgtcattatagacctaagcaatatagtttgatagtgtgcagataaatgtgtatataagggtgctacttcccgcccaagcatgcccatctcaatgtgtatctaaaaccaaataaacacaaaagtgagtacataaatactcagcaagtacaatataacacatacacatattggaaataaagaatgagcagaaagttttctttctttgaaaaagaaattgcaaggttaaagaaaatagtagttcccatttcgggcatacatgaaatgaagtagtagtttctatcccggacaattgtgaatacagccgcgcttacccataggaacataaataaaaaccagatagcacatcaatgactcgcatggaacatgaataattgaaaacggaacaaagaaccaaattgaaaccatatcgcacatccatggcaaacataaaacttgaattatttaccaagaaccaaaatacagattattaaaataagaataacatcgtaaacataagataaacttaaaatctaaatggcatgaacaacagtctgcacataagcagccacatatcacatatagaaatacaacagaaataaatagatagagcaaacaattcatgaatcacacaactagttcgtcacgcacttgcctttaaccttgacgataacccgatgaaccaccttccacaccagatctctccacacctatggagcaaaactacgaataaatccttatattcaactaatgatagttacgagatatttactaaaatcgaaacttagaacatataaactttttactgatttgtattaaacaacctatagtagtttcattactgttttatgcgtaactcgcaaaccatctaatgaaatctggcaaccaatataacttcggtcatctagacaaaattttctacaactttcatgttgggcgaaaaatcagtttactacttttctaggtctcagattaaggaaaaaagaattggtgtcactattttcatacccggcagcagtactgcttttgttgtttctcctaagccgtttaccggaatcgagcaaaactagcaccgttagaaagatatcgatgatgaatacaaactttatttaggacaactaacctgaatcccgatgttttaatacctttcaaaatatattttccagcctgcaatcaagaacctcaaaaattgcacgagcggctatcgaatcaatttatatttgaatcttatacttctaaggagtaaacaaaagtaccgttgcagcgaggacactagaatttgagaataaacccactagttacgaaatcaccgaaatccccaaaattgctcggcctttaccttcccttcttcctcctgttctcttgcttcctctgcactatgcacccttctcctctctgtccgatgcagtagcagcagccccacgaaaccattagtagcagcaagaaacaaccaaagccacagccatagatcagatcgacagcagcaggagctcaccgggaagaagcaaaacggaaaggagccaccagttgcgatggatgacgatggctgcggatctccagcaatggccgtggtggcggcgcaaagacggcggtggcaaccgggacgacagcagcggcagcaacagctagcgcaggagtggtggcggctagggctggctgtagtgatctctcgtttttacctttttctttttttttttgttatataaagagactaaacaggagatctaatggcccacatcgtttcaatccttgggacttcgttcgaactccaattactatgaacttatattctattttgcactactcaatgagctctacgcatccatggttcctaatcgcctattcgaacaacggtttcatagttgaacttttgcatttttgttgtaatatttcctgaaatacactaattcaaaactcaggatattacaataagcgacaatctagtctacggattgatggtccctagcatttcttattcgtcctggtttaaaaaactattgtgtgggtgaggtcgggagcatttgcagtacacttttatctattggaattaaaaatatatgactcccacatgtaaaaagtgtacgataaataatagccatgatcacgagttgaattggcaatgaggttttggtcttctaaacaatagatagatctaattttctccaactagtaacgagacatagtggattggtacgtaaccttctttgaggacagaatcctatatttatgggagaactaagttgctggatttctattgcagatctaggtgccaagcggcagtggcctggtgaagacgggtgcccttgaccagtagtggacacgcaattgggtggaggaagccgttaggtggccatcccggtggtggggtgcaagggagtaagtgaagatggatcctaacatggcgtggatctagaagtgctggcagaggatgttggagttttcaggcgggtttcgaggttgtcacataggtagcgctcaacgccgtcatgatcatcgctaacctatcactctactcgctagcgttatgcgcggtgccatgctggtagatagtgggtgtgtcatcttcggctgtcacctataggtattaagcctgataccccctaggtatcacggctgttacccacatatattaggcttggaacctgggtctgatataagggtttgataccttcaatattaggtccggtacacaagcacctattggtacccatagatatactagcttggtactacgttttgtacaatacatgctattatcatatcttgtatcttagactagccaaaaaatatcagagggtagtgataaatgagattattggatttatcggaattcatcggtgatagacaaaaaattttggacaaaatttggaaaaaaaattgaagaaaatttgttaggaaataacatagattttatccaatccattttttattaaaaaacaacacatatatattctgtaaatgagataatatcaacattttatagtgcacacacagcaagcaaatggaaccgaaaaaaaaaagagagaacaaaaatcgtggcttcgcttgaagcaaactcgaaacctgttggttgagagctaccgcttgtaaccaaggcatcaaagcaacttctatagcaactatcgaggctgtcttttatattatagcaggaaattcaagatagaagattttctcggagggtagtgataaaagatgtggcttccctctacgtggtgtacgcctatttgcttccctttcaccggtggccctatttcctgccttcctgggccttgcccctagtcttctgatcatctccatcgtagaagagtttcagactccattactccgttctctcggtgacaaaaatgaaacaccacggctaagaacatcaatcctcacgcagttgtgaatggccattgtttcctggtgatttatgtattcaacttagaagctactctctccgtttcaagttacaaaatgttttgattttgatcaaaatcaaactatttcaagtttaactaaatttatagacaaatatagtaatatttataatactaaattagtgtcatcaaatcaataattgaatatattttcataataaatttgttttgtgttgaaaatattactattttttctataatcttggtcaaacctaaagcagtttgactttgaccaaagttaaaacatcttataacctgaaatggagggagtacttgatttataccatctcaatcaactttgcttactgatagatgaacacagggataaaggtcagcaagtttttctttcctgaatgtgtagcagttaatctgctagggattcgtttcaatttttacgggaataattaagactagaaattaagaacggtaagaataaataaaataacgcaaggaggcatatatcatggtgtctcatattgtaatcaattaatgatctatccagctgcttcaacctaattaagtcatcctctttgatgccatccatgtcttcgatcgtaagcaagagttatcaattaatgtttgggaaggtttagggggcgatggcactcactggtgaagaacccatcttcactcccgatttacaacctcattaagtctcgggttacaaaccggaactatgaactccagaactaaagatgtccatctttaatcccaattgaaataactggatctttagttctggttggtaatcattagtaccggatggtgttaccaactgggacttttttttttttgctattttgcatatcttgcgtccgatatccccaacaacaaaatatcatctcccgacactccaaatcatccacaataacataatcataacaaatcatccacaacaacataatcccaaatcatccacaacaacataatcattctcaaatcacagatcaaatgaacaaattatcctcaacaaacaatcattcacaaattaagagggaaaaaggaaaaaaagaaagaaaataattcccacggcgaccaccacggccgccatccgtgccgaccgctgccctcctcgtgtgacggctccaccggccgccgccgtctgccactgctaggcacggccctccgcgccggtcgcccgcggaagggagtggaggaggaggaggaggagaggggataaggaggatgcgctggaagagataagatcgaggttgggagaggaggcacacaactcgatttttttaatcttggtcccagttgttataaccaaccgggactaaatatggatctttagtcccgtttggtaacacaccaattgagactaaagatcatctaagttccgtggtagttttaaaccggggcaaaaaagatatttagtcctggttaatattggaacgggactaatgtgatttttggccaacccatcagttctctactcaagaggatctccttgtaccttgctattgcgatcgtatcctgattcctgaagagcttgcacctgcagcagcagacagacgctgtgcatccatgcctccatgacggctatgagaggcgagggtccaaccgattatcagcgaaaaagttcaggcagaaactattttggaaggctggagactcgattttatatttatgtttttcttcggtggaggagggccaccagtagaacgataacaaatgggcgtatgccacgtagcgggaacagggatgggaacacaaaggcacagcccgagagaggcgtttttgttggaccaattttgcacctatccgataacagcgagaaatccgttcgttttcgcagcaaatcggccagtctggactctggaggctctcgctcgctcttatcgatcgatacgaccagaccggaggccatctcactccagagctcgcgggattttttgacttgaaaatagcgtgatcgcctctcatgtcatgcagatatcgtgatgcgtgagaagaaaccgtctatcctcctataaactctcgagcatgcagtccgttgtgcattcgtgcaacgcggttaagttagttgttgttgcgatccatagatagagctaaacccctaactagtaactacccagagagaactgataaggccagtgtcgagctagccagctgacggccgccacagtttgcttgatcaaggctgatcgatcgatcgatggacatcaccggcgcgggcgctatgggaggaggatccacggccgccaccgccgccgcggcggcgggggccgggtggaagacgccggtgtcgatggtgctggtgcagctgttcatcacggggcagatcctgctgtccaaggtgtccatcggcggtggcatgttgatcttcgtgctgcttgcgtacaacagcttcttcgccgtcgtcttcctcctccccttcgcgctcatcttcgagaggttttaatcttctccggtttttatttgtgtgtgttttaaagaaattttacgtttcttaataaagtacctcgaggtacctaaatattacactaaatattacctaaatccgaaggtatcaaattttacaccagaaaatatgtacatcctgataatttctcaggatgatgaaattatccgtgtttttatgatcagcttgccgtgaatatttgcagatttcgcatcttcagaatatttttttctcttcggacaaacattttacaaaactaggatatcggaatgagataatttatggtcatccattagtgactcttttctaaatttattgaaaaatcattttgtaatgtcaataattataaaatgtatgtctagtttaagttgcgaatcaattgattcaataatgaataacaccacatgtatacttctgatcgaataaatggataaccctggaattaatcacccgctaagaatactgaatgtgattgtaattaagaaaagtaattagcagcggctgtatgcattctaaaatcgggtttcatggtgaaaatttaatatgctgctaatttggttttgtgtagaggcaagtggagggacatggattggggtgcattcggatggatctttctcaatgcgttcattgggtatgtacgacatgtgtatctgaaccttcaaattcagtcaaactgtccataattatacttattatttaggaacaagtccaaataacccctaaacttggaactgaagttcgtttagcaccctaaactttaaaaccggacattcaacccccctaaactttataataccgtttatataacccctaagatggttttgcatagtagggtttttatctaatttatatataagttggatgagtttgatcacatatcatactctttggagtaaaattttgacttaaatatttatttttctacttatgagctctcacttacaaacaagtacgtacatgataatagtatgatattactgaataagaataaattgatgagttgcaactgatgatatgcaaatgtgttatattacttatttaaaattgttcgtttaagcttccaaaatatacaaaaccatcatccaaaaccaccttagggggtgatatggatggtatggcaaagttcggggggttggataactgattttaaagtttagggtgctagacggatttccgtctaaagtttatggatgtatttggactttttcctattatttatttattgtgtgtgttgattcgatcgatagtacatgaagatccattcgttgacacgtctcacctctattattactcttcctatcgttttttcataaaaagagagtatggtttgaatactattcgtaacagtgagttaacgtcgaaaaatacctgtcctttgtacggcttgtaggttgcaactcacctacgtgagagaaaattgtaaaatataccaataagctagctgtgtagaccagacaattttagataattagttatttggaggatttttttaaaaaaaaataattggtttgagactactgaggaagcaccgcagcatgatattaatatatgatgatatttcaaaaacatgcatgattgtataaatatgccagctccacctcctaacaactctagatatgaaattttctccaatgcaacgatagcaaacccaagtaaattgggagggagaaggataaatttacactaacttagcattagaacagagtgctcacttcttggttcttaacttcatcacttcccttatggaaaagattgatttcacttgtccttccagttccaggtctgtgttggacttcggattgccctctatttccatctaaccatgtgcattcagacaggcttttgcacataggattcaattttacagaacaattatgtaacactaaaagcatatataaatttttagatttttgtttgtttccctctgtctgtgcatccaggcagcctattgcacatgtaattcatctttgcaaaaccattatgtaacacaaaagcatatattttaaagcagaggttgataatattcttgattatatatactctgatatttctctcaaaatagttctggcaaagcacagaagaaaataattacacatttattaacattaaaatgttttgactatacaccttctgattttggttgtattcgctccttcttaaaatagttaccttactacaaatgttactatattttaaaacagagggagtacacaagcacataatttgttagaaggatttgttgcacaaagctgcaaactctagatatgtgcttcaacaacaaaaatgaactcataaatctgctaagagcttccttagaaggataacagcataaactttgatgaaagatttttttttcaaaaacaatgatacaaatatagaccattagtctgttcagagttgttgtgataaataaaaacttagcctccaataataagatatttatttactgataatagtagcaatttggtgaaagactctactgcatatagagccacctttatttaaaataaatagaaaaggcaaagatgaagacattgccttatttattgatagagaaggggaaataacatcaacccaagcaaggataaacactaaaaaaccatcaatttgattatactcaataaccaatttcttgatggctatttattacttcctgagacaaattatttttagtttttcttctgacatgccaaaatatgcaggtactctgtgccaatgagcctctactactatggcctcaaggataccacatcatcctattccgttatctttcttaatataactcccctgttcaccttcatcctctcacttatgttcaggtaagagtctcactcaactagttgttgtatacgatgtactacttggtaactataggttccaacaacaacagttccatatcatgcaaaaaaaaaaaaagtcatacgggtaaaattcaaatcgtgtcgcaaaattaatgttccatctcattgaaacatatgtatgaacatgattataggttggaggcattcaaacttagaagcatacctggagtactgaaaatagcgagcatactgctttccattggagggacaatgcttataagcctttacaaaggcaagtcattgcatctctgggattctatcatacaacaccaaaatgaacacaagtcagcaaccaatcagctaagaggaacaattctattggttggcagcagcttcacctttgcttgctggtttcttattcaggtaatcataaacattgcttctaataaagtatatatatttagggtaatttttacttctttgagaaggtattttctagtgtaaaactcggtaccttgagttacttaatttcttaatgcccataaaaattctcatatatctatatattacagtaaattttatccccatacaatgacatcttataactattgtcacagtcaaagattctcaaagtgtatccatacaaatattggtcgtccatggtgacatgcttggttggagtatttcaaaccgcattggtcggaatcatattaaggagagacaagagtgcatgggagctaggatggaatctcaaccttgttaccatcgtgtacacggtataccttcaaccttcctaacccttgaaattaatttagtgagctagaacaataaatatattttataaaataagtttttttttctcggtgttcagtgatgcttaaaataagaaatccatttgcaaagaacattttgttttctgttttttggtgtccactaaaacttgaattgtattaactaacaagtttagagttatggtattattttgggaaagatgaaattttagggaatgcgtaggggactgtcttagggatttgacatgaaaaatattttggtgtagggggcacttgcaacagccgggaaatatatattgaattcatgggcaataactaagcgaggcccaacctatcccacaatgttcagtccattatcagtcgtcttcactgttgtgttggattcagtccttctaggaaatgatattacaattggaaggtcagttgctttcatttgtgtctatcatgcatgtttaatgttgcaaaaggaaaatatatttgatcagttaatgtggcaaatgtaatcctttgccaaactgaataagactaagtttacatagcaaaaggaaagtaaaccttggaaatttcttatgcatatttccaagaaatattatacataataatcagtacaaacaacggcaaaatggagaatcaaagaagtcggtgatgtgaatagtgcaagcactttcaacaattgcagcttgtccttttcaattcacttttacgtttacaaaaattgtgaagcacacaaaagatactagtataacatagatgactcttggaataatttcacacaaccacatgtgttatggtgcaagttatgaaaaaccacaagagtttaggactgcacataaccacaacaattatggtattaatgatttacaaaaccaaactcttacacaaatttagccattcttatgtgaactattccaccaatgattagccacactgaccatgtgcataagaatagctaagtttattaatagtgtgcttttatgaaaaactaatatcataactgctatggttaagtgccaaatgtcaaacatctatggttttttataatgcagaccataaagcatgtggttttgtgaaatttactgttttactttgtattcctcgaaactatatgaagtgtatttgcagtacagtttattttttgaccattggcagcaatagatgtaattgttctcctattctcaatgtgcagtcttctaggcacagcattggtgattgtcgggctctacctttttctctgggccaaagcacgagaaatacctaagaagtcaacatagtatattctacacaagtcctggtagctaaacaacacataggagttatttatgtacacaatgagatgtatacagcacagttatttaaatgcgaaagtatcatatacttgagacggatagcttataatgtttgtttatttgttgttaatggatactattgtatttcataacactgttaaaagaaaatattgttgatcagcccctgtcctcttactactatttctttacacctataaaagaacatgttggtggccatgaactcgtgatttcctggccatgtccaatattacattcgttcacttaggccatctttggaaactacgaatagcaaaacaaagttagaaaaagacaagatttaggtagtttgcacatgcaaaacataggttaaatccaaatttaaccgtttggacaggctatagaaaaaacacatgcataagagaggtaaaactaaagaaaattttctatgagaatgaacatcaattgaataagagggtggtgaactatgaatccaccaccaagtttcaataaaatgatctcaaaggttgaagccaccacacttagacatcatggcaacatgacttgaaggagcgatgagccatccgtgtcaactgcgcccgctaagcaatggtgattacttccgtatttcatagtcgatgttacaaaatatggatacacaaataactaataatgcagtattatatatttatagtatgcaccatcattattcacaactcataatcaagtgtaaaagaagcttagaaaataaattaaaaactaaattatacttgtaacattaaatagaattaatgattgctttccgtagcctaaaatccaagaaagatgtgaatcaagatttaatttagtattgtgcaagactggcacactttaaccatagcaactttgatcatgtttgatcgtcgcatttcactacatgcgacaccataacggacagccagagtccaaaactattcccctatttctattttggcaaaatttgccacatgacatctaaaaatcatgtaatttgttagaagacataaaaaaacgcgacactgccaatggacactacaaaatttgtgtaattagctttaggacacccgaggcaatattttattattttcggtgaaaaagaggagagagaaatttcaaaaggacggaaatgccctcagcctcagtacctgaaatccccatccaacttcaactgcggcggcggcttcggctggttgcggcgttgggaagcgacggcggtggtgatggctcggccggtcatggcgcaccaggagctcgccgcgctgcaggaccagcaagaccatgagttccgcgctgcaagagctcgccgcgcacgccgcgaactccggcgaaggcgccacgctgccgccgtggtgcgtctcgaagctgagccccacggcgccgtcgccgccgccgcaggccgcggtctgcaggtcctgttctccacagacccgtcgccatggatccagctcaaacctgcacacacatcaacaagaaaccaatcaacggcaacaaatcgatcaaatgcaatgcacaaatcacaatggcgatggagccgctcgccaccaccacccgctgctgcagccgctctgcaacgccgccaccgcagccacggcgcagagctcggccaagtccgcaccaccgacgctgcagccgcactagcagctgcccgctgccgccacgcatctgtccgccacaatgcacctgtccgtcgcgcctcgccgtcaccggcggtgagaccctggcggagcgccgcctctttttccgcagcgcgccgagccatcccggctcgggccgtcgcgccgttcctccgctccgccgcgtgcgtgaggaagaagaggataggagagagatgtggactccacttatgattaccaaatagtaatcaccctactaattacaaataaattagtccatgactcgtagacccatgtggttaaaaacctattaaaaattagattaaagataggttgtcgatgacatgtgggacccaccagtatttaaagaaggaaagagaaagagcaatccgggcatttagataaatatctcacttttttttttacctaaaaataataaaataatacgaccggtgtcctacggccaattacacgtattttacgtgtcctgtggcaaattttgccgtctattttctatgctccacatttcattaggcctaacagttgtccacaccacaccaccgccacgtgtatatatgagtgtggaatgctcaatcgtccctgataattgtgccaaacaagaaatgtttttgttcgtgtggttacacttggatgagggctatccaaggacactgtacgtctttgtaatgtagggcaattgagaagagaggtgcttcttgtcacgtattaatgcctggcagtttttaacattaatactaaaaatctcgcaatatgtgaatcttcttttcccgattcgtcatgcggtgcgtgagtttatgaccccagtgacccttcatcaccctagtgaccccaatgacccgtccgaaaataagcgcagccatgagtttccgtgttcaactttgatcgttcgtcttatttgaaattttttttatgattagtatttttatttttactagattataaaacatgaataatactttatgcgtgactcatgtttttaagtttttttaaaaaaaaattcaaataagacaaataattaaagtttaacacagaaatttatggttatgcttattttgggatggagggagtataactatgtcatgggctcatggctgcccctaccctagaacatgtctgacaaactgcccatgaacaaaacaatgtaatatcagtattgacaccgtgtttagttgcaaacttttgtttcaaacttccaacttttccatcacatcaaaactttcctacacacataaatttctaacttttccggtcacatctttccaatttcaaccaaacttttaattttagcatgaactaaacacaccctgagtttccttgcaatcatgtaacttttggaagagcgaacaacaaagcagtgctaagagcatctccaagagactctccaagctaaattttggccattttagcaaaaaatctcactccaacagtctcataaaaatctcactccaacagtctctctactagaatggctaagccaaatagctggctaaattcctcccctcaatggccaaacttggccagcccaaacagcatagctattcgtgggtcccacgcgtagagttttctctcaccctgcactacccgtgtcctgaggttaggatgcggtggtgggacggcacgacggcgagcattgccaaggcctcccgctcgccggccgccggcatcgagggcatgaagggagcagcggcagcgagatgttgtcatcgcccctcttccttgccgacgccgtcgcctccgccctcgaccgcatccgacgtcgccacccgcagccctcccatcgtcggccatccagcgccgctgtctccatccacgccatccagcgttgcccccaccgcctccactccacgggtcgtcgtagagagccaccaccgccgttgctggcctagagaagaggaaaagggagagagaggaggaagaaagtgtagtagaggctgacgtatgggtcacagtgtcataggctcataatggagagtccgagagtgtaaatggagaggctgttggagcgaggaatgagtttggcttgataaatcaactggagagctagctatataggtgtttgaagagtccgatttgaagaggttgttagagatgctcttagaccatgataatattagcagcatggataaaatgttgtcgattgaaaacctaatcaaaagattctcagaaaataaatatcacaggagagaacttgtacataagcatcccagtttaacgcaacttcaccataccaccacaacttaatgctcaaggcaaattccatgataaaaggtaacaaatggagattaatatttaccagttagcaaaacaatgaatatcagcacctagaaatagcaacaatccctgcccagctctctgggtagccaaatttcttttttgaaatatgcttccatcaccataaacaaaataaaccggtaatctgaaattaatcaaaaacatcggaattctgttcagtttgagagtagtctcgtagccaaattcagatgaagcacaacgctaacagagtaacaggtaatgaacaaatgaagtctaattttagtattactgattcagaagagaacagagagagagagagagagtcataatcagacactacaggggcaaacaatgattctttttcattgccttcgcatttaaagataaactggacaggaggataaacagtgagattatgcattaccttcatgcacacaaatattctcttgacagaagcctactcatatctacaatttccaacctctgcaacatgccatttctcaaaggtacacatgaaaactgaaagcagttcatcaaaatgaaaattgtagaaatataacttacggttacctgccccacttttctatacattgacatccattatgtgtatcatcagctttcatgttgcttggatgatttagtaaacatcatatatgctattctagctccattttggatttgtgggacaaaaaatagaatatggtattcgacaattcaatccttcaatggttcacaaagataaggcaaacaatcaaactaatccactctaacattggctcattatgatcaacatcaaaagtttcatgttggacttgctatacagctattcgtctcaccattatttttctcatgtgtcatcatggttgttccttttctgtaacatttccttcctcagatcttctgccttaatttcatttccatattttgagtaggcctcaaccatgatattatgtattgcattactgggtacaacattattttgcatcattttctgatacagatattccatttcatttaatctccctgcaccacctaatccgctaataagttgatggtatgttctcaccgtagatttgatgccatacttatgcattctttgctgaagatccaaggctttatcaatattgcctctgtaacagcatgctgatattaaagtattatagctgacagcatcaggtatcaacctgtgattacttaagctgttaataatttcctcagcttcagatatctgcgactggttgcaaaggccttttataagcaaattgtaggttactatacttggagatattccgttactcttcatcttctcaactaaaataaaagcctgatcattgggaccatgctctacgtatgcatctatgatagcattgtacacctgggcatttggtaaaacatctttatgaaacatatcatccaatatagctacagcttctgggatttttccattcttacaaaaagcattgacaattgaaccataggagacaacatttggttttagcccattctcttgcatttcggaaagaacaatgaaacatttctcaagttgcccagtccttccataagcatcaatcagcgtattgaaagtttccacagttggattcactccattgtcctgcatctccattaacagatcttgtgcattggtgattctttcagccttacacaaaccattgattagtgcattgtaggtaatgtgatctggcttgatatgccgcgacttcatctgtccaaaggttgagaaggccccttcaagctctccagtctggcaatatccattgatcagagtgttatagatcacccttgttgggactaaccctgcatttaccagtgactgaagaacctcttcagcaattgaaactttgccatccttacacaggccattcaacaagatactacaagtgtaatctccaattgtcactccattcttcaaatattttccaaacaatgaaagcattgcctttgagtcaccatttcttgagagaccatcaaataaaatgctatatgtgaagccatcgggcaccatcttttgtgatgccatttcatccaacaaggctgacgtctctcccatcctgccagcacggcacagaccggacaggagcacattatacgtaatcgcattcggcttcaagccatgacacaccatctgatcccgcagcctgaaaccagcctccaggtcgccgcccttgatgtgcccatcaatcatcgtattgtatgtgatatgattcggcagcacggccctctccgtcatttcatcgaacacctcaacggcgtcaccacccctccctgccctccacatccccgcgatgaccacgttgtacgagaacgcgttgggcggcggcgcgccgtcgcgtcccatccgccggagcatcccgacggcctcgccgaggtcgcccgccgcgacgcacgcctggacggccttgttccacgcgaacgtgtccgggcgcgccccggcggacgcgaggatcccaaacgcgcggcgcacgtcggcgtggcggccgagcgagaggagggcctcgaggaggaggttgcaggaggagagggatggcagcggcgcgcgggcttcgtcggcgaggtcggacagaagccggagcgcgccgtcggggaggcggagccgcgcggacgcgacgacgagggcggaggcggcgtcgcagaggaaggaggaggccggatgagggtctccaggcgaggcggatgcggatgcggatgcggcggcggcggcgacggcggcgagggcgtggtagaggtcggggacgacggaggcggcgggcggctgcgcggtgaggaggagagacttggcgaggtcgacggaggcgtggaagcggccggcggcgaggagggaggcgagctcgtggaggtgggtggcggcggccgccgcggaggtggagcagagggagcggcgtgggaggaggaggcggcgagacatttgggaggagcggccttcttcttcctcatcagttcctctctctccccaaaggtttttttggagtttggtggggtataggctgtgttatcttcaaactttcaaaaattgcgtgacatcaaatgttttaactttcgaaaattagtctacgtttaatactgtatctgtatacgtaaaaaaagtttgatggagaaactaaacacggccttaggccgggggttctgcagtgtagtgtccgacttttatggcttttttgaaattcaaaaaattgataggatttgttggacgtagtttgtcatttcttgacgtttttattgtttagtaatatcgccaccatcaccacttcattaacaccacttcggtgggagatggggaactagggattggtgtgctagcagagcaaaagagggcagcgaggcgattttgccttatgctggctagggagattgggatgggtagaagatggatgggggaatttaggggcggcatgagtggcttcgaccttacgggagctccgaggcattttcgcgtgcattgggcaagatttggcggctaggagagggaggcggtgcacaaagctgtatgcggacggaagaggaagacaaggcgttgggtgcggcgttttcgtgcaggagatcgaaaggggtagaggtatttttgcacaggggcggagctagagaaaaaatgagggaggtttcctgactttctctgtgtaataccggtatgtataattctaaagtgatattgtactaaatagttgcgtacccaatacttataaacatcatctctctaattgatggcgatatacaacaagaaaatgcatagaaaaattaaaaatatgtgtatcataatgaagaaaccatcttataacttgccacttgcccctccgttgaatgcaagcaacaaacgctaacttaatcaataatcatgggttatgggtagtccagcaaaactgaaagaggggaacaacgtgacttgacttaccgattagattttgaggctgcggcctgcggaggtggtccaggtggagtaggtggcaaacgacgaactgctggccgacgtcgggcatggtaggggtaggcgataccggcggctggcacaagggcactagggcaggttgcactgccacaggcatccagggctgatccaggtgatacggacgtctccgtgtcgggcaagatcagcggtagatcgagacggcgagagattgagaggcgagggatgagtcacgcgttttgatttttggaagatggaacgatgccgccctgatttctggtcgccgattcgccgccctggctccctgatgagttgtcgcgcgcgcatggatcgatcaaaacacgtgcagtgcgactcctcatctcctctcggctaggccttctccaccaatatagaatctatgggctggccggctgggccttatcgagtagaagttttgggctagacaaatggaggggttcctcagtttgggctagaggggtgcccatgtggtggaggtataggggttacaagctatttcgaattttaggtcgggttcctgggcacccccctgggtctgttgggctccgcccctatttttgcatgcgagagaagaaagaaaaccgagcgaggcggcagtgtttgcttcggcgcgcgagggctgagaggagaataggggatccatgtgtggcgaggtgggcggaggggatcgagagggttctatgtgggacccatataaacatattttttttatcatatcttatggctgcacgcgagcgatacagttttgggagctgtgcacgcgtcggtgctaaaacaagcgcccacttgtttctttctctatgattttctttccttaatcccagattaagctgattaacaagttttggagctggcttaataatgctattttactgctctaagggcctgtagcctagtggttacaagagcctcagtagcaccttagatcctgggttcgactccccgtggaagcgaattttccaggatttaacggctttgtgctttcagtggtaggcaacgtacccgtcgacagcgaggcgcccatggtgacttcgtcaatctccaagatggatttgccggcccagtcttcgaaaatgctcacaggggtagggtttgcgtgcgttcataggggtgagtgtgcgtacgttgtattgtgtaattctaaaaaaataaaataaaaactaatgatagtcatactagcaaaagtgatgaggtggcaaataaatacgtggacaaaagtagcgtgtgactaaatagtgaccaagtatacataatcttctatactactccctccgtcctaaaatataagaacccatctgatcctacgttcttatattttaggatggagggagcaataagcagcacctgcttcttccgatcgaagtagtatccaagtattttcaggatttttcttgaaatcatttgagcattggaagtatttttaacaattcaaagatcatttcagtgattattttaattggaaaaggtttttaaatcctctcctaagccgttgggttgatttcagcccaacatctctctccctcgcgcgcgtgctgtgcagcccaagccaagtcgagctgctctgatctgttctaagccatccgaaagtctaatttgcctccctccttcaatcgggccgaggaaatgaagcccggcaggaagtctgttttgcatccctctgctacagtgtcgcccctaacctccagccggtcgatctcctccctgccgtgcccgtgtacagcgccgcctccccaccaaattcgtcctctccgttgctcctctttccaaattagttgtgggaatatattcctctcgatctcctctatcttgtccccaagaaacccccttaaattccatggtatatcgcgtggattcgacgcggttttgagttcctattttccggcgaaccctaactaatccgtcgccgattccatccgttcccaagccgatctctccctcttccggctataaatagcatcccctaaccgtcctcttccatttgcctctagtcccaagttgagccgtcgcccgtagcgccgccgccacgttgtcttagccgccgccgtcgctggcgatcctccggtcgcatcgcgccgccgctagcgccgtcgccgttgccgtccgtcgccgccttcgggtgcgcacggagaaggagtacctcgtccgccccttcgcagccgccgaagaccgccggagcgccgtcgtcgttgttgagccgaaccgtgccgccgttgaacctcgtcgccggtcgtcgttcgtcgtcgttcgtcgtagtttcttgcaccggtgagttcgcgtcgtcgtcctcttcgcgtaggtgtcctcggatagcccaaccgagctctcttttgccggtggtcgcgtggaagcagtgccatggccggcgatgacgtcagcgatgacgtcataaatccatttttcttagtttctttattagatgaaaatcgattagacttcggaaattcataactaaatcatcgtaactcggatttgagtggttcaaattgctaaattcatctaaaatctagatctacatgttaaaaatatccacatgtactgtttatgcttgttttttttactgttttgttgattttgttcttttgctttagtttccgacgttccggaggagagcgttttcgttgaggaaggttcggaagtgtttgcggaagatcaaggcaagtcacacagatcccaaacaaccctttgagcatgttgaacctgtttaaagctattgtttatttcaacttatgcattattttcgaatgtcaccgggtggtgagcctttcccaattaattaatagccgaagatgactttattttcctatgggttataatttgattagctagaaccttatatattggtttggttcagttaaatgctatatatatatatatatataattgcttagccatgcttagaaacattagctcattaatgggatgaatcatatatactacattattattcatgattatatttaatggtagctcacgatggttaaccgtgttatgataattaattgataattaaaacttgataatggtgggttgtgagcacatggttttgaaggtcgtgttcatggcaattaaggaccggttcgcgagctactattgtgagacattaaccgtgccaactacaagccagcgtgggcaacgactttaccttttgtataacatgattcattgcggggtgccagactgtgaagcggtaagaagtccgtgggggtcgccggggagtccatgcctctggttatatttatagagggggtgattatgatctaggaatggtgcactgtggtgagttgtgttgtgcaggggtattgtcacagcctctattcgggtactttccagtatcgcgacgcatggtagacataatgttgaggctgtgtcttgtgggtacagtggtacacctctggccagagtaaaactattcgaatagccgtgcccgcggttatgggcgagttgagcaatgtttttcgtgattagtctcacatctctcacaataattattgatgctataactggtaataatttgcttagctcctggtttggagttagatctatgcagccgggtttggttgttcaggatggttgggcctgagcagcatgggtgtgctgttcagtgttgattaaaattgatgattactctattgttttactactcttaaatctttgctaaatgctgcttttgcaaatgagactatattatgccatcatttggtatccttgtgcacttgtatatttgctgtgtggcttgttgagtatgtcatatgctcatttttgtaataatcaatcaacctcagttgaagaaaaatgatctagaaggagaagacatttggcttataccccagttgagttgcctgtgggagtggagctgaagccatcgctagaccgttaattccgctgttgtttttcttttcttctgtaattatgtaacgttattattatgatggattcgtatattaaattgtcagtttgtgtacctcggctaatttctggacgagggttttatgcacaaataagttcgggaattactagtgaatttccgggcgtgacataacctcctcctactaaataagtacatcttctgtcccaaaataagttcattagtaaatttatatatccaacgtttaaccatccgtcttatttaaaatatttttattgttattagattattaaacatgaatagtactttatgcatgccttagtttttttttataatttttcatttttttttaaataagacataaacccacaaatattttgagacgggggtgctgacaggaagaaagatgcaaagaaaatgataaacgaaaaacatacacaaatatgtgtatagataatctaatagtaatagctaactattgtacacaatacctcttcttaagttaactctattgctgatgtggatgtttttagctaattactgattacagtacactattaactttgctctaagagcactccaatacagtgacgacctcatatgtcacgtggaatatactactatcatatatgagccattcattgagacaacaaaggctactttacgccttgtctagattcaaagtttgatcttcaaattttcaattttttgtcacatcgaaattttctatacatacaaacttccaactttttcgtcacaccgttccaatttctttaaacttctaattttgacgtggaactaaacacacacttaatgtgttttctttccatatatcattacttgtacgtcagccctttcaatgttccttttttttttgacaggaaacaataggagaggctcctactgtgctaataaatatattaataatataaggagtttatgtacagagaaatatttacaatggaaatagagaatttacagaagaattagaaaatagagtcaatccatgattgataggaaggtttatcctcctccagtcctccttcactctttgcataagaagagtgaaatcctctctgaaagcatacttctggttattgaaagatgaatgaatattgtcaaagatgagcgtatttctttcggtcgatatctgccagcaggccgtgcccaccacttcaacaaaaaacggcttgttaaaattaatataagctgtttcctcatcccagttgataccaatgaaattgcagcacaccttggcataaggacaaccaaaaaacaaatgaaccatatcttccaaaacccctggcatgcacattctacaggatggaccatcttataatcaaataagttttagacctatggactttgaaaaaaccacggatgtacatgtcagccactctttcactctcttttcacccctcacctctaatcccctccctatataggtcccgttctaagattttaattttcgtggcacgcttttcagattgctaaatggtgtatttcgcacgaaaactttctatatgaaagtcgcactaaaatatcatattaatttattttttaagtttgtaataactaaaactcaataaatcatacgttaataccatctcgttttgcgtaaaaaaaacttaatcttcattttcatcttgagaagaaaagaacaccaccatagttcacgtcctttcccctctgctatcatttcctcctcaccactgccccgctgccccctcgaatgaggtggtagagcccgcaccatcctcttcttcatctggtgctgcaaatcaatgttatctctttaatccccttctccttcaagtactctagacaagtcgacgagtcccccgcctccatcgccaccaacctccaggaccgatgagcggatctagcgatgtggttggtgagctctgggaccaacaaacggcatgactactcaatccaagcagcgaggcgagctgatgctcgtcagagttggccgcaccagaggtggtcgaggacaacctccaacttctaaattaggcgcaaatgaggggatgagctcgccggcttatgagtggcaataggctcctctccctcctctgttgccctcgttctcttctcctatcatgttcaccgtgtcattgctgttcgggtagggttaaggtggagataagggtgtggaccacactacgggagcatgacctcacctaatacggtgtcccgatgcgttcgtcccctaaggccttgttcggttaatcctcataagggagggatttggaattattatatggtgtgtaattattccccctcaatcccctacaaaccgaacaacacctaacagggacatggatcattctcgaaatagggttcgactcctacgtggcgagcctatgcctcgtcttgtaggagcattgggcaaggcgtatgaaagcacaaattgcctgacaaatcggcatgttgcaatttgcaaatatttgcccacaatttccgttccgcagttatttagcgaatccgcttaaaaaatagccagctcaacacatctcgcggtactgacatcttagacactttcgccatccctttccactactgctactattgcacagccgcacaacccgacatcccctgctggcacaagaacagattaattttcggctcgatcgacgccatcttctattcattcgatcttgcaatcacaaataataaaagcagctcaacgagcctagatccaagatcgaaaatccttcggatggatcgcaaactgagtcaccaaacgcttctgatcttgagctacgagacatgtcccagcatttgaatcatatttgaatcacaaattttgtagtagtatgtactacaagtataagtaaacaatccaaaattgttgtgtgttgtagcgttgatccgtcacaatgaacaaacaaatcccctatctaaccaagcgaaaccacgcgacaaggatcgtgtagagtggatcggagcggcagcgaaacgcgggcggctaccgtgccggcgccggcgcggtcgccgcgacgccgccggcgccgcggcggcgcagcgcgttggtgtagttgatgatggagttgatgcgctgcagcttgaggtcctccctgaactgcttgatgaaccgctcggcccgcgcgttcacctccgccttcccttcctctacctcctctgcccgcgcccgccgcggcttggcgtccgccgccttcgccgccgccgcggcatctggtgcggaacgcggcgagcgcgcctgcgcctgctgggccagcgcgtacgcctcgtccaagctgatggactcctcctcctcctctgcttccgcctcttcttcctcgttcttgatcgccgccgctgttgcggcggccacaggcgagctccgtggcgccgccatggacggcgtcgtcgccgccacgacctccctcaccggcgccggcggctccggccggaacggcgccgccgcgacggcctccaccaactcctcctctgcctcacgcgggtagtagaagtaatcggaccccgacgagacgtcgccgtggacgtggagcggcgtggcgctgtagtcgccggagaggtactggaaggggaagttggcgacggaccggagcctctccatcacaacggtcgacgcggtgcgcgccagcctccgccgcgccgccgacgacggcgtcgaggtcgtcccgcccacgccctgccccagccacgacacgacggcgatggcgccgacgatgacgttcaggaacacgaaccacgccgccccggagctgagccacgacagcatctgcacctccgccatagacgacgacgacgatcgatgatccaatccaagaaactcacctcacagctgagtgagctcgatctgttcgaccggtgaatcgaatcggaggaaaggcgatgatgagatgagatgggtgggtgggtagcgagctcaggtgagctgggcacatggttatataggcaggtgagtgtgtgtctgttcgtggagaggtgggtgagaacggcaggagaagaaaggcggcaccgcgtcgcgtcgcgcgccgccgcgtccacggttggcatcgcgtggctcgtagcggcaagttggcaaccgctttctgctattctatcagcggcagagagcaaagctgcggaccatgcagcagcagcggcagcggcaggaagattcatgtgcgtgtacaggtgaaagtagatagtactagcgtgcaaggcttgttctgctctaggagttaatgaactggatcatgcagagtcttgaagaaaaaatgaacttgatatcaagccagacgtgacagccagcgacatgtcggtatttagctggtttgatggagtatttaggctctgttcgtttcgtggagttcccaactcccccatctcattttccgcgcgcacgcttttcaaactgctaaacggtgtattttttgcaaaaagtttatatacgaaagttgcttaaaaaaattatattgatccatttttgaaaaaaaattagcaaataattaattaatcacatgctaatggactgcttcgttttccgtaccggagggatgggtacccaactcaaccaaaagaacagagcctagggtgtgtttagttggccaaagaaaatttggggtgccacatcggatgaccagatgtcggaaagcgttttcggacacaaatgaaaaaaattaattttataactcgcctggaaaccgcgagacaaatttattaagctaattaatctatcattagtatatgtaggttactgtagcatttatggctaatcatagactaattagactcaaaagattcgtctcgtgatttccatacaaactgtgcaattagttttttctttttatctatatataatgttctatacatgtgttcaaagattcgatataatgtttttgaaaaaaaaaattggaaactaaatcaagccatactagttttgactctgagttgtcgaggctttgaccatttggaaaatctaattagatacatatcattagatttgtaatcaattgaactcaactgattatattaattgtctagtagtattaaatttaaattaaatttgtctactagtaattagcaagagggagataactaatagagattgagtaaagctggtgagttttcaggagcggagggagcaatttgcaggtttttttggctgttcttgtgaaactactgaatttgtttttacgcgagtcaaacaactcaattagtattcaacatggaaccgtgttagtactcaacagggaaccgtgttaatatataggtggcgtttagcgtagtagcgtactactgtacactattactctctcgttatcatctacggagtacagctgcatggccatccaggtggaaatcgttgggaatcgttatcttgcaaacaacttcacctgacatgtaaatttaaaattaattgttacctactcgtaggttcttctgttcctcatttgactcgtgacctgcaaagttcaaagctatcatgcattgtatatgcccaataccaagatcatgatggccggtgaacccctgtagattatttgcaaagttaatccgtgtctatcgagtgaaacatatactattctgctacacgctattcgcctgtcaattagctagtaacttttccccgcaaaaaaaaaaaaggtactaaccttgatactttatgctactcgtctgcttgatgctaaactggtgccttcgtgcgaggaaaacgtgagttgtctaatatgctacttgctacactactttattctaagtatcatgcttaaattagctagagcgatcatcgatgggctcgccttgtggacgtccacacacaccaccccagcgaagatccccatgttcctaatcaattaattcctgattaattaattttcccattttttctttctcttcatttcggacggcctttcggttcaaagtagagtcctccactgcagcaaatgatcggctatcgcctctccacttaaatcaaatccctttaatttctctttacaggaaagatacgttgttgagaccagcagctagcggaaccggccggacttttgcgatcggatctagttacaaatattgtttgattaatgtattacacgtgtgttgatctgtctatttgggtatcgattaaaatcttaatggccaaagatatatttggatcattgggtatatatgttgttgtaatcatatcattattaattgagacgacatatattattttcttgtaaatatatatggaatattctgcatccccgcactttcaggttataaaattgtactggatttcataatcagctgttagccatatagttacatgtatcatttacatgttcatgctccgtaagttttctaatattcaaattagaggagaaaaaacagaaatggtagaaattctgagaaaaaaaacaacgatatctaacttttaatctgcctaaagtttcttacttatccagaatcttaatactagagcactccgtataaatactaagcaacggacccacaatgataagaatatatcttacttaaataagaaaaataaataccaaagaaatcataaatactgatacttatataaaagaagtatccatcgagttacaagatcggagagaatgccaacaactctaacactcatccgagattccaatggagagagtgccaacatcttcagcacttctccagaactcccctagaaggaattccgacatatggtgcattccttccagcgcttcccctcactctcatcctatactctaaattctaactctactagagtgtaatctaaatatgaaagtgagttgtactccacttgagttgtgttgtgctttgagaatgaagtgataactccttttataagctctaacgacggttactatggcgatagtgaggtcggttcacccacaaccatcatagggaaccaatcaacatcctccacgtggaaggtgggggatgagtggctgcaagggtggtttagccgaaccatggttcggccgaccccctagctccaccatatcccctctcctttggcctggtcactatccagtcccctctcctttggcctgttcactatccagtaggaccttatgacagtgcccattggttgacccattttgaggtgatttggtcagcttgtaggccttccattccgtatacatgcgtctgattggctggagctgtgtttcttcgcatggcgagtggtaattttcatacaaaatccatgcattcacatatttcaccaatatttgtggaaatgatatttcaccactaccactaagtgtgatattttatttcaattgcttttatgcaggaattggtgatcagatttgacatttaaggatcgtcaacaggttttcctcacttccacaagggaagaagtaagtcagtgaaacccgagctagtttctaggagtttgcttgatagagcaagcttctccaaaggaaggtctaggtgttttatccttggaccttggtggttgggagatacctattagcctttggtcgttccttggagactaaagttttttcctggttattagcttggtgaggcaagggaacaatcgagatcctgctccttggagttccttgacatagagtatctcttataccgaattccatgcggattcacgtgcaaatagcccctccacgtggcattgtgggatttcagctttcgtccctctccttagccgtcacatcgcggatctcgatggatggatatcgctgcggtggacctcattctaaaaaatgaagtttgagggggtttttatgcaaaagcgcttaattcctacccttcccgtggccatcctcggtggggctcctcctcctggttggctggtcctcgccgccagcctcctcacctctcctccccggtccggtgcccccctctcctgttcccctctccgccgacggtaatagctcggtagggtgacgagcgaggaaaatctcgacggcggcaacctttcctccaccactacctctcccaactcgccggtgaggagctctcctccctccctccctcccatctaccggcgaggccctctcctcccacgcgctggcgcgccgccctcttccctcccgtgtcctcctcctcgtctctggatggggcgaagagctcggtggcggcgcgcgtggattgggagtagctcggtgtcggtgacgagctccggtgatgccgccacctctaccctcaagctcggcggcgtctgcgcatcgccgcccatccacctccctccttgccgatgcattcgaccctgtgggccagcggtcgagcttggcgccacgctcgactgggagggccgggcgcgggggcttggcttcgatgttgaggtgctcaatccactggcgtagccgtcctgtgcctcacgccctcaccaccaccacctccattctccccactgtcgcgcgatgatgacctgtgcaatcaagaaaggtggtagggatgcgactagctcaaaccacaacaacgagaaggaagtagtagaggtgaggtagctctgcttgtcatagtgtccttgaagaaaccaagatgaatggaataggaggctgctgcttgtcgtccaatgtccatccgcaacctgcttgcttggagcagccaccgccgccgctacgatatgctcgctgtgtgtcattaccgccttaccagcaagcagttctgtaaggtagtgtttggttggatggtttcggtgggtcgggtcggggccatccctttttttttttggagctgtttggtttgaggattaggtgggttgggttggttaaaaaggaagagtaaatttcatagaactacagatactttgcacaatctatcacaaaactacagatttaagaacttgtttcacaaaactacagattcattgtattcatttaacataaaactacatgtactttgcacaatatatcacaaaactacagatttaagaacttgtttcataaaactacagatttaatatcctcatttatcataaaactacaagtttagtgtctctattatcacaaaactacaggttgtagcattgtaaaaatctatagttttgtgataatggatacactaaatttgtagttttatgataaatgaagacactaaatgtatagttctgtgatatacactaaatctatagttttatgaaacaagtttttaaatctatagttttatgatagattgtacaaagtacttgtagttttgtgataaacggagacactaaatctgtagttttgtgaaacaagctcttaattctatagttttgtgataatttgtgtcaaatacctatagttttgtaaaatttacttaaaaaaagaatattccaccaatattcgggatgaactgaccacccaaaaaagaccggaccgatcgaacccacctctctcccgtcgcgcacgtgagttgcacgcgcccgcgcgcacgagcaggcggtggcagctcgcatcctccctccatcctccatcctccatccccctcctctctgaatctctactggtcaacatctcgcccttggctgctgcagcaacaagaggaagaagaaccggcgcccccacctggcctcctgtgtagagtaaggtgatagaggtttcagatgttttgagaatattctctgctcatgaacgcatccagtaactgctggaggagtgtggagaaggcaagcgattgatgaatccggtggctgggaggaccgatctactgcagaagatgtggacctgacactgggagcaggactactgagctgggaatttgtctatgttggtagccttaaggtatttttacttctgcagttaaatactaccaatatgatggcatgccaatccatgaacaaaaacattaacatgtaaatgattgaagcacctgtgtttggttgccctgcttgtttaattgtgcttctccctcagttttgtgcttgccctgggctacttgctgttcctaatgctactgcttttaggtactttactgctgctatattgctcatcttaaagatcacaaaagtaacaaaagcaagtactttttagttcttaacaatacagcactctgcatgtaaaatggcattggatttttcccgttcccctaatttttttgttcggaactgttgatgcatgcacttttcttccaattgctttcctgttctgacatagagaactggccttgcaagctgcggtgctggtttacaattcgttaatactacgttggacggttggagtaagaaactggtggttcacatcaatgtcaatgggggagaacactttatttgattttaggaatactttctttcctgtttttatttaagtgagtacaaatcaggcaacatgtatttattctgaaaacccaacaactaaacatatataaaacactatgaggtggtagaagtactgaagctatttgtagaccacaccaaatgaggaagatggtattcgtagaacaagtttattattgttccaaggagatcaatatatgacacttgcccacaagccttgttcccctggccttggcctaggttgataagctcgcgagagcgggacaacagggcatggactttctatgcttgtttgagcatatccttcagtactacattattttttttgagaaggaaagaaaaaacaaaaataagtctggctaatatatatgagaatggtccgaaaaatctatcttccattatcatcattacttttttctcggaaacataatctgaacagacctattagatattggagatgggactgtcgaaaaagaaatataccggtatcggttggaaggtgaaaattcgtatcagaaacagtaaatgtcagttctgcaacaaagaggaaagtgtagagcatcttttctttcattgtagcattgctaggtttgtatttggaacgctttcaatagtgtttttgactgtaggatgctgaaggcatacaaaattcgtatcacaaaaaagcatccggggcctttttgtgattgatgcttttttgtgattgttgctgaaaataaattactaacaaaataaattatagacatgtggagggataaaatgaagataagtactttcattactttggttcattggaatttagaatttgtgtgcacatattcgactttcaacttatgtccatgaactcattttcttgcagccttcaattgatctgaataaagcttatgcccgaaactatgtcatattttagagcaattagatattgtaagtaaattaaattcacattacagatagcagaaattggtactgatttgttatgtcgttagcattatttactctacttacggattgtttctgcattttctcagcacacaagtggaaaattaaatctggaaatgcatgcatcgttttgtaattttaataaatttgtaaactaataattaacctatggagagcttcctcgtacatttgtaaactaataattaacctatgtagtgccgtcaaaagtcaaaactcaagtacggttgaattagtaccatgcttaatcgtagcttcatgcactttttttattaattttggcaatggtctctatgcgtactcttcaaatcatgcaatgccatgatactaaataggaaaaagtacgaattaccctcccccgaactatcgtagttgtccgaattaccccctaaaccacaaaaccggacattcttcaccaccaactatgcaaaccggacgaattacccctctcgaccaaatccgcggtggttttggtctacgtagtatatgtgtggcagtccagccagcattctatttataaaaaaatgtaggacccacctgccatatcctctctctctcattctcagtctcactcttcccctctctctcatgtgcatggcagcaggcgggggcggcggcacgcacgcacacggacggggggctagaggcggcggcgtggccgagacgcacacaacggcgacggcgcgtggcgcaggcgaggctcgaggggagatggcgacggcgcgcagcgcgagtgacgccgacaggcgacacgacggcacggggacaggggccggaggcggcggcgaggaatgacgcaagaacaccccctccctccggggatacgatggcgatggcggccgcttccgccttagccatgcaaggcaggccgcctctgccgccacagcggggccggcggcgccgaagcgggcgctcgtgctggtcgcggatggcacagtgctggtggaggcggtcgccactgccgatgtgctcaaccgcaccggcgcgtcgaggaggacgagcgcgctgggcggagggaagtcaaggccttgagcttgcaaccgc

SEQ ID NO: 41169 - DNA, 18534 bp, Oryza sativa
ccgtccgcgtgcgtgcgcgccgccgccgccgcccccgcctgatgtcgtgcgtgtgagagagagaggggaagagagacatagagtgagactgtgagagagagaagagagaggaaaagagaggatatggcaggtgggtcccatatttttttataaatagaatgctaactgaattgctacacgtacgccacgtagaccaaaaccaccgcggattgggtcgagggggggtaattcatccggtttgcatagttggggagggggggggtgaagaatgtcgtttttgtggtttagaggggtaattcggacgactgcgatagttcaggggggtaatttgtactttttcctattgaatattgaacattgaattctgaaactgaactggcattattttgaagaaaaaaataaagataagtataaaaaaatcccaatcatgttatcttattaaagataagtgatcagggttcaagttgatatggaaccatattattaaatgtttaattttgattattttcctagccatgtactgaagtattgtctaattaatgacaccggaatatgcaatttgacctctttgaattacttgacatttgaattttttctaccttagccatgacggttttgtaaggttgccttttatgatacctgtatagttagatgcaatctttaaccaatcgaagtagacgtttttgtgtatttttattttttttttacttttcagaaataaggaagaaacacaaattggaattgcaaaacttgatgctaacaaagcatccgaatagggcattacatttttttttcatgttagcaaatatcaatggtgtaattaatactactcacctgataaatacataaattccttggcaatgctactaccgagtcattttttttgctcgtgtgcatgaacattttattttcctcttctgatctcaagtcccaacccctattaatttatttctttaggtttctgcttcaacgtgttaagaaataaaaaaactactgatcataaacaaggctatttgataaagcagattaccctaatctaaattgggcgcggcaaggccgcgcgtctatgcatagtcagtactatagcctcactaatcctcgtcgaggaatctccttgccgccctagaagtttgagattgtgcctgactgttttggagtctgttcagcagctccttcagcgcctggggattgacgtcggactggagtcggctcaacatgaaatcaagcatggtatgatagtcttcttcacggagctcctctccattcttcagagtaatatcacacaatgtgtccagaatctgggcgtgacaggcgcaggctttttgtagagaactttcctttcaaagagagaggtttctagtgatccttggatccaaacgttttgtcccttgtggctttgcccatctcttgtattctgatcggagtcttgggtagttacgaggatttaaaatccattgctagtgtttccaggaacacaaagtatatgatacttggatctgaacgttttgttctgtttcttggaaaggctttctctgttttcaggaacgcacattcacctcgcgacatcagatcctttcaaagaaaactttacaaagacattggatgagagcatgttagacctgaaaacacaaactttacaaagacattggatgatagctagggtttcccttaccgtaaaccacgcggtaaccattggatgataacttcactcccccgcggtaagacagaaccgcgtggtaaccgtcggaaaccacgtgaaattcgttctcaaatatttgaattaaaaaatcgatggtttcagcgtggttactgtgcagtttcgcgtggtaaccacgaatatcgcgcgattaccgctaattgtgtagcagaacagagaagctgttagaaaaaattgaaaaaacatttaaattcatgtagaaattgggaataattagaagaatatagaggaaacttgcaaacataacttttggggtgtaaaatacaaaaaatcaatatgacctttttctatattatggacttcaacgcaattcaacatttcgtagcataataattcgacaacaataattcaacaacctcacatttgaaagcattatgatgtccacatgaagctgaaataatagagtccacaatagagagagcaatagagagagatgagaggaccaggagatattttctccacttataggccttaatggactggacagtagtacaagataagaccttattatttttttcatttctaatgtactttcggtttttccctcaaaattgaatttatctaattctttttcaaaaaaatttcttcaccatccgccactaaaaatgaagaactatatccacgattttttttcagttttttcagaattttgaatgtgggcaaaattcaccaaaccctaccaccggtaacccctaccgtaccccgcgataaacgcgcagttatcggcattaagagaaaccctgatgagagcatgtttagccttctccgttttgtagaaggaaataatataaaaatagctcctatataaagatattcatttgtttgtaatccaattgtgcaccaccaccgacaaaccctagaataggtgtagaataggtgatatttactggaccggcggcgtctcctcgagtaaaggcttccacccaaattgcatgactaacaggtcttacgtgtaaaggatcatgtacccatgattcaaaatttccttgccaagcgacataaaacagattacccgaaaaggcaaaaatgttataataaagacattcctcactaatatcatcatgacattggaaattaactaatatcatcatgacattggaaattaatctcaaaatcatgtgcggtagcgataccaacccaacaaaataaaaccagtagctagtgggggtccttagctatgccttggcactactagaaaacagcttttcacaggcggcctaaacaggtttttgcaggcggacgagtgcaactgaacgattgtgaaaatagttacttttcacaggcggacaactagtccgcttgcgaaaatagcacctggcattaaaaaaaaaaagggcagccaccgcccactgccgttccagccaatagcagtagctttccattctcctcccattccctcatccagattcaacatcaaaccaaatcaaatacacaaaaacataacagattaacagacatcgtagtggttcacaatcaaatcaaatcacaaattttccatggatgtcgtcatcgccgtcgcacggacgcaccccgccgccatctgccccgtgccgccggccggtccgcccgcccgccggcctcccccctcccccctccggccaaatctgggagggagggagggaggggagccgccgccgaccgccccttccgccgtcggggaggtgtaggggaggggagaggattagaggagtaggggagaggaaagactcttagaaaaatatcagcccacgtgccacatatatataccacgctaattttcgcaagcacactttatgtggtccgcctgcgaaaatagcaggcaccgcttaagtggtccgcagcgcccttcaccccgatttgcatttttgtaggcggctatttggctctaagggtcatgcccgtctgtaaaaataaatacctaatattggcgaaaatgctttttcagtagtgtggctaaacctgggaaacacacaactcatctagttaaataacatgtgcactaaccctcttcctagcttcaaaatgggattaatcggtgctactctagttagctaagcgaggtggtattattgccgctacaggtgttactgctttctaccttgccgagctgctatgcagctgcaactactgttgctcaacactagttggacaaaggcccaaagcctctgttgctgctgaaggcgagctaagcagcccactacctcaacataccctcatccttttttctcttttttttttcatcaattatttttggggcacaccacggttttactttttttcaagtgcaagtggcaaaagttattgccgaatatattagaaagatagagttaatcctatttataagcaaaatcgggcctaaaaaccatataactgcacggtttgcagaagtgaaacctacgaaaatcttacacagaagacacaaaaagcatgaggcaaaacaattacgaaccacagaatgctgagggaaaagcaagaccctaagacgaagccttcaagaatatcaacacgacgaagctttcaagaatgtgaacaacgacataagccattgtcgacgcccgcccagaatgggttttcacctaggtgggagagagtccataaggcaacacctccaaggaggaatcggcacccgcagacgtcgatattgccgatcctggaagagcatgcagggcttgagcaaaagctctcgcaccatggaggtaagcacaccgctccaacctcagcaccacaacaagctcagaaagccacagtgcacgtgaagcaccggtgaggcctaagagccctatctacgtacaaacaggaccaataccacggacgaacaaactcctcaagcaccgaaagagaccacggccagatctggaagtagacagccaagggaaggggaggcaccaaagaggcatggtcggcccggagaggaactaagagctgaacatagggctgtggcgaccacctgcaacttcaccaccagtgcagagaggggagcgctgcgggggagtggggagaggatggtctcccccaacagtttgttctgcgagggggcatagcgaggaacacacaggaggtagccagcaaggaaccggcgcccgcggcggtccgctgcgcgggggggcgctgggggcagccagccagcgcacacccccagcaggccgacatgccgtcgacccggagccggttgccgccgcctgctgcctcacgagtcacctcgcgccgcgacacgccgcgagcgccggtcaccgccggccacctcacgagtcgcaaccgccacgccacctcgcgcccgcgagcagcgacgcctcgcgggcgccagccatgcatcccacgagccacaaccaccacgccgcctcgcgccgcagcggcctccgccggccgtaccgcctccgcaacacgcttccagacatcgccgtcatagatctggcgacagcggggccggatctacagcagcccaattaacctgaaggcctcgccgccgccggcgaacgatgcatcccccgcgctgagaaggggcaccaccgcgagaaggccccccgccgccatccttacacaatggatgccactgccaggagtaacatctctttcccaaatgaatggaaccaagatacattaattattatttggcagtaggataattacaatgccagatatattcacacccgtaccatattattattagcaaaaatacaaaaagaatctaatcctgatatcaaattgttcccttgaacactcgactgaattttcaaaattctctacatcatctccaagaaaattccgaatgcatacctccttcacatatgcatacggacgagacgatgatgacggaacaattagaacgaagaaacacctaatcctagtctgcaatgcgacgactcggccatttgagtcgcatcacctgctatgatcttgccattgtccagctccggcagctcctctttaacaccaatgtcgccgttcacgtccaccaccgtcttgacaacgtcgacgatgtcggcgttcacgtccaccattgtcttgataatgtcgatgttgctgttctcgtccaccattgtcttgacatcgatgtcggcgttcatatccaccatttccttgacctcgatgtccgtgttcacgtccaccgtctgcacttgctcctcctcctgccgaaggtcgaacacatcgacgagtgacggtcccgactttatctcgaaccccttatcatcaatctggttgtgctcatccacccctaccggcatttggtgatcggatgtgagctcaaccttgtgttcagcatcatagttggtgtcgaaatcaaaatgctgcattccatcgacattgatgtcgagatgcggcttgctactgacgtcgtcaccggcggtcgagtcgtagtagaagtaatcgtaaagctgctgtggttgaccgtgatggtgttcacgctgactctcgtcctgattatgatggccgtcggcgtgtaggatcgcagcatcggcttcttgattggcatagagcgcatcaacgacctcatgctccgcactgagtaggagaggctggtttgacgaggtgacatcgagatcggcgcacgcgtcgtccaacacgcctgccggcagcgcagcggcgacgctaccggacgcgccagcggcagccgcctgacgacacatcgccagatggtggagtacggtgttgagttcggccgtgtcgagctcgagctggcgctcgagatcgcagatgacgcggcaacacccgccgacggggtcgtgggcccgcatctcggcctggtagatgagcgtgcgcatggcgtcgtcgcacagctcgggcttgaggtggcggagcgtcttgaggatgttgctgacgccgaagaggcggtgcgcgttgaggaagcggcgctgctggtcggcggggaagtagggcgccatcgggcagtccgggttgcacttgcgccgctggtacttgcccccggcgcagccgcaactagtccctccccctccacctccaccaccacctccaccaccaccacctcctccgctccctccgccgctggcgccgcgatgcgagccgccgctgccgctgccgctgccgctggagtgcggaggacgggcggcgacgggaaggctctggcgttggtgggaggcagtggtggtggtggtggtggagacggggttgttgttgttgttggtggtggtggtggtggtgttggtggtggtgatggtggtggtggaggtcatggcggcagccgcggcggcagcggcgacgggggctctctggctcgccaggtcgcgaggtcggaggcgacggtggagggctggccctggcgtcgtcgtaggaataggagaggccctcagcagctgtccatgtcatccgccattttctccaccactcgtctccatcgatcgccggatgcctattaaaagtaaaacggattttcgatcgagcctagcatcgatccatgcatggtgcagttgccaacagctggtgcttaactgtgtgcaagctgtcaagagagcactgatatgatcgactcaaaagagctgcatgaaaagccatgaaaagggatatgatcggagagggaggtcgatcggtttggtggctggtaggcctagctaggagatggagttgcttgatcgattcagaatttccatggatctcgaatgtgttcgagcattgcggggatgtcacactcgagagtttgttgctacataaaaaggtttgatgtgtcaaactgctactaccattagaattagaatagctaagactgcagctaacgatgttaagccagaagtttagctagacttttccttaaagatttaacagtgtactctctccgtgttgaaaaatagttgttattttggacgagactatgttaaacttatttgaattttgattacgaataatttctaaaactagaaagatagcccgcgtatgcgcgggcatcttatttaactgtgctagaaatttgattaggaatgtttatgattactctattttaaacatgtttaatttttcaataatttgtgtggtgtttctctgaatgctagtaaccatcgctggtgtataaattctaaactaaaattatttaaaaccatgcaaattaggttttataagaaaaatatatatgtgaaactatatatcacttctacaaaatgcacttcttttttttaatatttagcatatcttatttttgcacattctaaactatgagtaacaatttttcttttgtatactatatatgtttttatgaattttaggatatattaattgaagatattttctattaaaaatatggctaatacgactacatcatctaactaaatgaactgaatatgttgaaatattgatttaattgtaagtatatagtattgcagtatgaatttatggtttagcagtaaaagtttttctaaatcagaaacagaaaatatattagaaaatgagacttttatcgttctcaagttatagtttagggttgtatacttcgaactgatattatgttagattttatttccaacataatgcccaaaatgtcaaattttatattatattttatttagaattttaattattttcattgtatcagtactcctaaatatttgaacattgctatttagaatgggttttagattaaaaaaatcttaaatttagaaaaacaaagttcagtcttcaattatttttatcatgttatttttttttctagatttctatttcatcaagcatcccttaaatgttttggtctctgcaatttggtatagaaatataagtgggttaaggccatacaacttggcatgggataaagttatcgcttaattgttttcaatctattgtctataacaaatagatcctagacagggtacacgttatgacataaaaaatgatataattaaaagctttttctctaatccattagtgacatcaaatatcataggtataatttagatgttatgatcatcttaggaacatttatttatctctaaaaagatcatttattcataaaagcgcatctaggatgaagtataagagaaattaactacttccattgttgaggaaagtatatcaatatttacatcaccaaattatttttattgaattcagaattgaatatgttttttataatataattgttttgtgttgaaaatgttactatgtttttataaactaattcaagtaacttgacatagacaaaatttaaaatgacttgtaatctgaaatagaaggagttggaagaaggtcattagatatttagcatggtataaataataggttgactgtttattaaaaacataaggtgggattttttattttttaattagaaattttagtattttattttatttattggaggcttcaaggtagatagatgtggtccacaatgtactgaattattgatttaattgaaaattgtaatagtttagaaatgtcatcaattgaatataagatttaaaaatttatgattattttaaagtctaatttatgttgtttctataagtgctagcttgagaagaaagagaagagaagcacatgacagagtaaaaggttgctagatttgttaggcggagtctatttgtaggtgtttttttttctcttaaatataattttggatttagttgctatggagataaagaacagagaatgaatggtagggaaagaggaacgggagaaatgggagggagggagtttttggattttcgtttaaagatagatctaactatataagatagtggatccattagttcaagtggaaaccgatggttggatattttgttttcatttgtcacacttatagagtttttcaatttattagagtgacacgtggtgatcgatttagaaacatttatgggtgtaccattaggcctagacatttgtagttagaggagaggaggaggaggaagaggaagagatgggggtgaatgaggaagaagagataaagggaggaggagatagaacttattaactgatcctgtgcgcctcctcctcctcgatctcgcgcgcacgcctcgccctctccacgtatgccgatcatttttcccggttgataacaccaaccgtcactaaagataatagaggagtttgacaccgcctgccttttttttaccgggactaaaaataatctttagtcccgattgttgttaccaaatgggactaaagatcaaaaagtagctctaaacttttgaaccgggactaaagataatcttatatttagtctggttttattgcaaccgggactattaattgtggaatttggtcgaccgatcaaagatggtttttcatctttttccagaagtgcattgatcaccctactaattagactaaatataacccaacctaacatggctaactaaataaataatttttaagacgtcatctttccgactgaatgaaacaaaataataaaataataattaatacaagctaactccaaacctaaccgctacatgcaaatgtccaatcctaacactttgctaataaaatattaatccatctgctaagagcaaggttaatagagaaagcttatcgtcggcaccaaagaagtccagctctgctttatagctaaccatatacatgtagtgcgtatattagtaatatcctcatattatctctaaaagctattttatcttttaccggacccacaattctaatttgataggctcatacacagaaattatctcttggcaggcacgtgttaactagccatttgctttcttcacctaggcgcttgtgctcagccggcgcttgtgcaatcgctcacttgcctctctctcatctcatctccctcatccacgtaggacttatttgacgtggcttggctattagccagcagagctggacttattatacctgctctaatattcaccatgcttcccacacaatgcgagattgttatctgattcaaaccatgcttcccacacaatgcgagacagggattgtgtcatattcagactacgcttgatgcataatgtaagacaaccggtggatatattgccttctattgtgtttctgaaatttacagcttatgattttctgaaaaaaagcatgctagctagaaaacttttacacaatgtatttgaccacttccatacctttaataatgacacccatgcatatagacagcgagtatgtataattaaaataatctttacacattccaacgcacgggaatttgtttctagtatgcatattaattttaaaatatacttcaataaaatcgaatttctataatatagaaaaagagtgatgaaatttatttttttaaatgtggttttctgtaaaacgacaattattttcaaacagaacggagagtaatagtttagccctccgtccatgaacaatcacagttccaaaaatttttttagataatatcagagttgctaatttaatcatcgttaaccgttgttgggaatcttctcgcaggttactgcccggccggccgtgattaaactaaacacggtccaaataaaaattaattctcacccacttgcatgaattacacatgcttaagcttaattaacaaccacgtacagcttagtccgtgtacgctgagagagagaagtggagatccaatgcgattttccactccagatgatcagcatgtcatgtgtctcacgcgcccgcgcgcactgcttcttctcgatctttcatttgtttattgttcgacaccaaccaaaccatctctcacagattcttaatatacagaggtttcgaggacgagcagatcgctgcaactgcaagaaagcaaagaccggggtgtagtgagagtgtgtgtgacaagatcgatggccgcggttgagtcgtcgtcgtcgccgtcgttgtggtggtggccgctgccgccgtggctcagcccgggcgccgcgtggttcgtcctgttcaccgtcgttgtcggcgccgtcgctgtgtcgtcccgggcgcatgagcaggcgccgccgccgccgccgtcgtcgaccaggcgcaggctcactcgcagcgcgtcgtccatggtcatggagcggctacggtccttctccgccttctccttcgtccacgcgatctccggtgtgcaagaggacgacatcaccgtaggtccaccgacgtcgccggcggcgtcagggaatgcagaggcggcggaggagaatcccattggattggacgaggcgcacgcgcatccagcggtggccgccgttcggccgccgccgccacaagctgctgctgctgctgctgccaccgccggcgaggtggctgctgctgctacggcggaggagaggccgaggaagaggagggaggcggcgaaggggaggcgcgcgttcgcggaggtggaagggaaggcggaggtgaacgcgagggcggagcggttcatccggcagttcagggaggatctcaggctgcagcgcctcatgtccgtcctcaaccgcacccatgcgctcgccggcgccgcctcgtcgtccgcaccgtagcggcgtatagtagacggtggcgtggctgccggccggccagctagctgcctgccacgccgcggcaacaccattgtactgctccatatatattccattttgctttgcttaattaggatatctaatttaaccttcatcacatgcgaaaagcaagagttatggtatatagttgttttttcttgtcgaggtcagcagggatgaagctagcgctcctcaaattttcttttctggaatgactagtacaagacggtacgaaattctagtgatagagtagaaaaaaattataatattacatcctgtaggtcgtaaccagaaaaaacaaaaaaatgtactgccgcccacacaccgacaacgccaaaccacaagtcctggagaagagtagcaccggactggccgctgctaaactaacaacagaaacaaccgagatcgcccaaaaccctacccttacaaacaacacaaaatccaactttatccacgtctttaggatttagcgagagagggtgagagagaagatggaacatctctccccctaggccctccgccgtggccaacttgtagtatttaggacgccgccacgagaggaagaaatttagagcgtgcttgcgccaaaagtttgggtggttttggtaaggggatgcctagatgacgtctccaaggagagaagcgatggaaacaccgccgccgccgtccgtcaaggtctcaagagagccgagactgggctttcgcctggcaacaaccgttgaggggtgagacggcacgacaacaccctcaggaggggaatgacacttgaacgccatcgattgtcggtccggccgaggccgggctgggttttcacccgccgtccaccacctgccaatctaccacagaaactccattgctccaccgccataaaaaacctctgccggcgcgtcggtacactgcaccggcgcccccaccggctagtatccgcgtgcagccacctcaccaggctccgcctccatgacatcacctcctgctgcgtagccatcacgcgtcggccgtcctcgatgccgccgaccaagcctacacgcgcttcatggctgccggccgcaacttcttcggtgagctggcgccacctccaccgtcacggagtcgaacctcgcccgccgccgtgccaccgggcaccgccgtcgatcgccagcagtagaccccgccaccggtcacttccccgccatttctaggcgcggatctagcggtcacttccaccgccgccatcacctccaaacgccgccgccacccccgccaaatgccaccgccccacggcactaccccgccgccaacttccttcctaccagatccggccggaacgcacaaatctgggcggttccaccgttccaaatgccgagcagccccctacccctgcgtggtgagagaagcgaagccccgccgcccccatccttgcggtcacgcagctttgccgacggccactcaggcggcggcgaggcagaggaggagggaaggagaggtcggcgatggcagccaagtcgcctcccgtgtcgcccgagggggatggcgacgcgagggccgttcgctcctcaaatttaacggagatccatgggtggatgtccactcaaccaaatatctatgagaaaactttaaaaaaattgataagataaattaatgtgtaatatattacttcacaagtatgtaaattcaaattcaacttctagtgtaaaaaaaataagaaatttaatacaacctttacaagttgaatttgaggttgctttgtggagtgatatattacccattaatctatcgtgtcaaattttttgaatttttttttatttcgtggaggcaattgaagggattgccgatttgttaaacggtgtacacattagtagaggcctgtggatgaaatcatcacggcaatgccgcaactctctaatcgatcgatttcatctattattgctgcatgggtatccgaaagattactttctcagcaacctttaccttctaaaaggattgttttatgtatctctctgacttgtatcagtttaaagcaacgtacatgggaatttatatttccctactcttattaatatatataagtcgaatattcaaaaaagcccgcatgccatccaaaaacctcataaaaaattagtcatgtaatttaaattcgagctattcaaataaaaatatcattgtttttattcgtatatgcttttacttgtatagcatgtgacatcagcgatccagaagtttcatagggcatgtcttatagtccctccattagttttttaatagataatgttgttgacttttaaatacatgtttgatcatttgtcttattcaaaagttttaaagcatccatgcctagatccagtagcttgaaaactggttggcgtcggatgcagccccaggagtgaaggtttgccggatctggggcatccgtggctagatccggcatcttgtcggctcagttggtgatgatgggtgatgatggacgctccatttatttttggagggtgtcggtggctgcggtgtaggaaagtaggtcaccttgacacactacgttgggctagggcagctgtaaacacacctgtgagcgagcacaactgacagtgggactgctttaacattggcagctcggtggaggctatggtgaaagcctagacggcaatgcctgtgggcgccgttctcttcttggaggtgacatttttgtctcctcgtcatgctgtgtttcgattcttcgaatgaaaacctagctcaaggccagcaatgacgacgtggtttggcatggtgtccttcttgaaggcatcatcgagaaaatccttcatatctttgctagtgtgggagtcttcctttcttctagcttgttgcatggccttgccgtttatgtgttgagcatcgtttgttgactgtccttttccgttgctatgttgtttaggttagttgaagactttgttggagttgtgattttcactcagttttttctaattaactatgtgctgtaaaattcagttccctttttttcttaaaataggatacattcttctttatttaaaacatcgggaatgggttgaccgttcgaaaaagaatttataattgatgatcaggaaggtgcagattgaagacgtatttcattatcccctatcccacaaaagcttgatgaggcacgatcctaaacatgcatatatgttgtcatatccctattatcataaatatatgtttcctttcactagggttatgggcttgtgtcaaagcagaccttaggaagattcaaatacattattgttctcgtctctcccaactaagactcaatacctaacgagatctcattttaattaggttccttttgtagtttcccagagaagttggtatatagaattgttcttgccattcctaatattttacctgattttttattgtaaatttgcgtacagatatattgaaaagtacaattgaatttgatatgcaatttttgctatgtgtaattatattttgttcacacagctatatggctatttgctccattataatcttgatacaccacaatataacggtgcccatatttctattttttaacaaaaaatatttttcttattttacacctctaagctatttcattggagcacttaacctctataaataattttctcactcattttataccccagactactgaaagtcattcaacttactcactaatgttatttcttctttttttttctctctctctatacaagtcgaattttgcattaaaatttggtgtgattgatagatgcactatataatattttttttggaatttttatttaaaaactagaactcatttaaacattgaggctttaaatttcaagtcaacaatcatgaaaatttcgaaaaatattttacaattttaataatgatgtcatctatagctctaaaaatttttagcttaaaataaaaatcatatgaagaaaagaaaaggagagatatcattaagaagtaaagtggcccatgtttaatagtttatgaggtataaagtgagcctagaaaatagtttaggatattaaatgctttggtgatatagtttgggagaggaaagtagatttttttttaattaacatgttaaattttaggacgcatattaggcttttagaaactcaaactttgcatatcttgaccaataattagttgcagctaataaaagtcatctgtagcctataggttcatattttagagagttttacaaaagaacaactttttacgagtaatcgtaaatcaacacctaatgccattgttactctaccgtagtagtatatgttgtttgcattaattcatacctaggaagttttttttaacgcaaaaggtagagagactctaccttataaccattgtattaatagctaggaagtactacaacatagatgcctgtttcttcgcttaagatggagaaaagcacaaagccagttcgaaagaacactgtcacttatccttggctttccttgtgcgcctgagtatcccttgctgccagatcacttaattctgcaacctggtaatatatataggtatctctgtaatcgctggctggcgactttgtcctctgattaattgtgcttcacggaaggaaggaaggagactgcagatcacaaccctgcactggctagctatatatacacatacgcgcgcaaatcattaagttcaggacagatactaacaataacagagagagagagagagagagagagagagagagagagagatcaggattaaggtaagctgagggagaggttgcaaccatggcacagcggttgctgcacggggtgatggaggccaaggtcctggaggccaagctgtcgtcagtgtcctcagaggcatcagattatggccatgggcagcccaagctggctgcctatagcaaggtatacatataagattcggagagctctgataacttgacgctgtttgtttgacatcccgatctactttcgttcactcagatgatctcacatactattctagctcacaagtatcaattaaagcaaattggcaacaggaaattgtcaaattatcaaatttttctaagagacattgtttcgcttggagctgactgtaagacgtaattgcttattaaggaccaataaataatttatgaataaaatttaaatatatatgcattcttagtgaatcaaaagcttatataaaaataacaaaatcaattataaaattaagattcaaaatttaaattttggatatggctaataagctcaacagcaaatgaatagcttgtacgatggcacttatgtataataacaattatagctagccaacgaaactacatgctagacaatttcactgatgtgaaagagggagaatagagataggaggggattgctaaacatttgcctgctagacgaagtactccctccgtcctaaaatattaaaatataagtgagataggaggggattgataaacatgctccctgtcctgattcgtagcacttaaaaaatgtcacatccgttcaaaatcccttatatttggggacggagggagtatattttaagaatttaagattgtctcagaaatattgtatttttagaatattaggtgtcacatcaatcatctcttgtttgaaattatcttcattttacccctaactacctcccacatccaattcattatttaatgaagagcatatatgtcatttttcttcctaatactttaccttccaagtgttagaaatgcacttgtaacataataacagatatagtactatatgaaacacaattttcgagggaaacccagtttcagcagaaaacatgtctatcaatgtagctaaaaataaccatagagcccattgaaataaataaagtgtactcttattggtgacagtaagtgcatttccagtggatagttttattttgtggtttccaatagtgcaacataatccattgaggcttgtaattatgaataaaattaaatatctccaatacactgtttcatttcgtggtttccaatgatttagtcacaatggactttcattctatttccaagatatagttaagtgcgtaaggtggtgtttggatccaaggactaaactttactccctgtcatatcggatgaatttggagtattaaacatagactacttataaaactaattacataaatgagagctaattcgtgtgacaaaatttttaagcctaattaatccataattagcgcatgtttactatagcatcacataggctaatcatggattaattaggctcaatagattcgtctcgcgaattagtccagcattatagaatgggttttattaatagtgtacatttaatatttataattagtgtctaaacatcttatgtgatagggactaaaaagttttagtcccatctaaacagggtctaaaccaagtttcatctagatgaaacccacttcttgtttctcttcataaatttcttgagtttagtttatatggcattggcatttcatttaataagattgaaaactattatgaaa

SEQ ID NO: 41170 - DNA, 4931 bp, Oryza sativa
tcctgcagccccgcgaggcggtggagcaggacaaccagtagtggcacgtgcaggtgttccggtccatcgacagccgcgcggtggaccggttcccggacaccgccggcgaggccgcgcggtgcggcctcgtcaccggcgccaccggcgacaccgtggagcgcagcatccaggacggctacatccacgccatccgccgcgccaagtacttcatctacatcgagagccagtgcttcctagggagctcctacgggtggaaccgtgacgtcgccggcggcgccgccaccgccaagaacgccgccgccgccgccgtggcgccgcacaccatccccaaggagctgtcgctgaagctcgcaagcaagatcaggtccggggactcgttcagggtgtacgtggtgctcccgatgtggccggagggcgtgccggagagcgccaccgtgcaggccgtcctggactggcagcggcggaccatggagatgatgtacaaggacgtggcggcggcgctcgccgcgaggggctcgacgcagaaccccagggagtacctcagcttcttctgcttgggcaaccgggagccgtacgtccccggcgagcacgcgccgccggagcggccggagctcgacagcgactacatgagggcgcagcaggccaggcgcttcaagatcaacgtcaacgccaacatcatgataggtactcccctctgtcccaatctatattacgtcgtttagtttccacataacgttcttcgtatgataaacttttgaataaaacgaatagttaaatacttaaatgttatctaaaaaatcaatggcatcataaattttaggacgaagagagtacattatatggaccagggatattgacaagatatggacatttgacaagaacacgatgatcaaaacgaaaccgttgacaatcgatcgccatgatttttttgcagtggacgacgagtacatcatcgtggggtcggcgaacgtgaaccagcgatccatggacggcggcagggacacggagatggcgatgggcgcgtaccagccgcggcacctggacaccccgaactcgtggccgagggggcaagtgcaccagttccggctcgcgctgtggcgggagcacctcggccaggcggcgttccaggccgccgccgccgccggcgacgacatgatctacccgtcgcgccatgggtgcatgagccgggtgaaccaggccgcgcggcagcactgggacatgtacgcgagcgacaagttccaggggagcctccccggccacctcatggcgtaccccgtcggcgtcggcgaccgcggcgagctctgggaggccgtccctttcttcccggacaccaacgccaaggtgttcggctgcagctccgacgagcttccaccggtcctcaccacatgaacttgtgctagcctccaatcacaataattaatatatatatatatatatatgcagcgaaaatgtattgcttgttgtacgaaaatatatgaggtggtgatttgtgaataaaaccatggtgtatgaaaatgcataaaatgcttctgctgcagttgtaaacatgaactgtactaatttatggatttgtgatatgagctatgaattcggatctggcgcctctgtgactgatctggctgcggtcaaccggcagcgtgaagatgtccttggagggcgacacgatctgagctggtggaggctacaacagcaggaaaactgacgtaggtgatggcagcgggcggccggtgtggttgacggcagcgagagacctgtgcaggcaatggaggctggtggaggccgcgcggtgtcttggcgatggccggtgacaccagctgctggcatcgacggcgggcgcagttgcgactccaacagtggcggcgacaccgatggtgggcgcgacagttggtggttgccatatgcaccaacggtaggccatggacttcgatggcgagcacggtgcactaaaggtgtgggagcagcggctggagcctgggaacggctggtgcaacagctgcctagctaagctgatggcggtgggtgactttctatacttagtgtttctatagggtggcatgtttgttagaatcatatggtaatgggaccacctatacatttgtcgacaaattttctcctaaaaatttgatagatgtaattatagtataatcgtagtgtaattacactgtaacttgtatgtaattacactgtaatttgcatgtaactacagtataacttgtatgtaagtttcacgtaattttgaatcgttagatctattacaagatttgttatagtgaggaagaaaaaaatcacagcacacacatatgtgaaaagatttgttcccacgacctccattttaccgaaataacatgttacagagagatttttgaaagttacattatagttacaatgtaattacatgcaaattacagtgtaattacactacgattgtactgtagttacatctgtcaaatttttggaagaaaatttatcgataaatatatagcaaaatcgtatttactaagcaatggcctaaattatgtagagaaggacttcgtaataatactgtatttttacaagaaagctaattggcacgcgctagctggcggcacggtcccacccccgcacggcgttttttttcccttttttcatgatttttttcttttgtttttgctcttttttctgattattttttaaacatttttagcacacgtatttttaaatagtttgtgttaaaagtatttaaatcatgacttgaaaatttttcaaatcttaacttaaaaattttcaactctcgagttgaaagtttttgaatctcaagttgaaagtttttaaatctgggttgaatattttcaaagttgagttaaaagtttttcaaatttgagatgaaaagttgaaagttttcaaaatttgactttaaaaattcaaaattcaagttgaaagttttaaaatctgggtttaaaattttgaaaatttgacttcatatatagattttcttttcaatttgttatttaaaaaaatctcgcgggaaaaagaaaatcttattatctactaccgtcattatctcaaacggttattatctaagactaatagattagtctaactaccttatcccaaagaaacacgcgccggcagacgcgccaactagcgatccccgtatttttatctcttttacctagtgagcagattaccattttattgtgttcaaaaacaaaattgttccttagcggtgagggagtaatttcttgggttatggaaagaaatagattgataaatagtgaaatgcacatgtacttacatatagttacatagattaacaactatattttgggagggaactattgggtgtggaaaatagagttgggcttatgactatattgttgaagatcaggcccaaaacatctatattggcgggctcaataagaagacaacataaaaggcttcccagccttctctttttgaaatttcaagttaaaaggaaaaaaaagtttatagaaacctctctttttctgaggatgctctatgctactacttcctatcaagtagataccaaaagttggtgttaatattgagcactccctggaaaatgggaactaatacttataatagtgattagtacaaaagcatcagtaccagactctcagttgtcaatagcacagtattcatgatcattctaggaaagaatcatatcgatcttgtttgaattaatgattctgattcatgataggcaggtgcagaggtgctggcgttccctgcaggatattgcaatgttttgtagctgccaaatatcatcacacagcatgacaaccttgtcgctgcccaaaaaaaaaaagcacatactattagcatatactccatataatataagactgactggtgaacctatttgctataaataccctactaaacttcgaagacttttccatcaaaatacccttcgaagccttaaatcttcagccactactacgaaaacctttttcgtggcggccattttagattttcgctggcggaatttggagccgccacaaagcaaaggccagtgaagatcacgattttcgctagcggttatcgaccgccagcaataattcattttcgtcttaagacgaccgccagcaaaaatggatctttgttggctgtcgtcttacacaggccgccagcaaaaattcattttcgctggcggctgtgttaaatcagccaccagggaaaatatattttgggaaaaaaattcgcatgcagctgcccagccgccagcgaagatttggagaaaagcccattgattcatttttaaaattcaaatccacatctagagatgtagattctaattcatatacatatggctgctcatttccaaattcaaacacaatacaaaatcatcattagcacaaaatcatcattagcacagatgtacacagatcaaacatcacaacatgcacaaaacatctgcatcatctagatcatcaggaaacatgcaaaaaaaaaaaaatcctaactgagctcgtcagatccgtgccgctgccggtctctcgtcgtcgccacctcaccgccgccggtggggaggaaggaggcgcaggatccgctccccgtcgcctcctcccccgcgccgctgacgccgagagccgctgccgccgccgcccccttccccgcgctactgccgaggcctcatcggcgtcggcagcagatccggggatccggcctcccccatcgtcgcggcggtggatccggccaccctcgtcgtcgtggcggcggatccgacctcccccgtcgtggcggtgacggctccggcctcccccgtcgatgtggctgcggattcggccacccccgtcgtcgcagcgacggatccaaccacccccatcgatgtggtggctggatccgaccccgagcctgcggtggagaggcgacggcagcccccggcggcagtggaggacggagagggagaaggagagaacgcgagtgag

SEQ ID NO: 41171 - DNA, 11732 bp, Oryza sativa
gcatggacggtggaggacctgctcctcgtgaactacatttgtcgcccacgtggagtatcatctgatacctcgtaagtatcaccgacacttcatacaaatcatctaatacctacaactatgagaacccaagtatcatgtgatacctcgccaagtatcacctgacatctcataggaatcatccaatatctataagtatcagaatccgatatcataagtatctctttgtacctcgtaagtatcacccgatacctcgcaggaatcatatgatacctcgtaagtatcgacgagtatcaggtggcatcaacggatatcaacatccggtaccaataagtatcagtcaatacctataagtatcacttgatacctaaccagtatcatcttgtctgaacgggttcgttgtatagcagcctcctaattaattctagcccactccaaattcaaagaaaagatgaaggtaaaatatatgtactctttgtgttgcatgaatgtactggtgctaattgtacaacttacggtcataaatatttaatgctcgactttttccatagctatcaaaatacaactctgaccacaattttatattggaataagttgataaaatctactaattttatcatattataatagtacttgtcaaggaaaatctacaaatgccattattattttgaacaaaggaattattacttctggcctttataccaactaaagatacatcaaccaaatttatatatactaggatttgaaccctggtaaattgagccatgtatccacgacttcactaccacactaatagtgaactaagcatttaaaagttattgaccaaatttttgttctaaatacgagttttgctaagctcaactataaatgctactgttggtatcctgtagtaagaaatgagtgaatgggcctggtgggacacaagaacatgcagagggctcaaaacttcaaatgctcaactaccatgccagatattgggccagtgacagataagttgattctcaacttttcacataagaaatcatcttgctcttcttaagttccattgatgcacaaaacaagaaaggcaacaacttttttagaagactaacctttacttggatacttaacttggatcttgcatttgcaatacaatctaagttcatggtaactagcctgtcctttctttgatgtatctcaattctcaggtcacaactcacaagtacagcttggcaagcttctcatcctttggattgttcatgttggcctttacggttgttggctatcaccatccaaacccccaaaatattaaaagaagggcaattttgccatggataatgactacctgttaatttaggcggagtagtatctttcccctggtgttattgtgaaatgatgtacttcgaatgatactactctaaagtggtgaactttggacggtataggtccaatctttcattcgattaattacatgtgatacaaatcatattaataatagtttaattcgactggcaaaccacacgaaattagtttaactcctatgtttaaatataacaaagtgtttgaaaataaaatatatatagtcattttctccaagcaatccatgtattccaagattccaactactaatttgagttgtcttacttagaaatatatagaaacagcatagcccaaagaaagttgtgcaagaatgagataaattggtactagcattttagcagcatgtaaaaaattatgagtaaatttcagaaaaccccatattttgtcgtcaaagttgtggaaaaccacaggtattatgatgtgtggcacatcacaggttttatggtctgaatgtttcataaaactccgcaatttttgaaatcttgataaatttcaacatatcttaaacaaaattttggaagtagtaaaaaattaaactatcgatcttaatcaagaaattaataattaaaattttcatttgcactctatgttttaaaattttaagtaaattcgcgctcaaaatgcataaaggtggggttttgtgaaattttaaaaccataatacctagattaggtgtcacatttcataatacatgtaatttttctttaattttgaccataaaaaaattaggttttatgaaatttacttaaaaattaatgtaagtattcaaaatcaagctagtacgtaccatccaatataataccaagtacaccagatccagtaccaacggctacgaccagatgtccctttgaaggtacgctcgtcgctggctcactgcacatcgtaggctgtcttgctgtagctgggcagttgtacagcggacaaaaacgtactctcctctttcttccattcacagaaagattgaatgaatgaacacagtggtccttccatagccacagacagtacgtctgaagaaaacaagacagtcaatgagggcacactgggtagttgctggagtaaaattcatcagttcttggacccagctctgattcacaaaagcctccatgagaactggtagtacacagagctgcagaagcatccaccactgttctggaatcttggatgatcaggtccctggccacataaccaccaatgctatctcaaattccactgtgtggcttaaatggcttgctgggagaggctgttaccatcaatgaacgccggccctgctcaaccacatcgagtgagtacttcatgattagtgtcttctcaggctgtctgctaggtgctagctccctagagctcactgacatcaacatcgatcaagcctccccccctaactcgtgcatttgtgaaggaggttaggatgcagccatcagctctgagtagacggtccatttcattgggggaggggggggatcggagtcaccacctcctaactgagttgcttcattcagtgatggacaacctagctgagaggacaatggggaaatcagttttctgacgaatcacaaattgcatcctgaacatctcacttaaacattattgcaagctgcaatgcagacagatacaggtaatatttgcaccctctgggctgtcctgtgccgtgctgtggatgtatttcgaccacagcttctcctgattgttgtctacaaaataagcacagagaagagagcattcaacagcaatgtggttttaaataacatggcatcaaactattaaaaatttgtagtcatatgatcacaagagggatgcaagacacaacttcagtttaatgagttcggtttcatattttctgctcctatgttccagtgaagtacttagaatcatcaggcaagaaaattgaccagcgtcctttgtcccttttaataactatgttttaggcgaaattccgaactaaaaacgaaaaagataatcccttctttctgacgcacttttcgtaaagatttgaactgtaatacagcttgatgaggacattcaaaccaacattacagtaacaggtaatgaacaagatacacaagtaaagccaagccaaacaccatttacaagaaattcaagtccgattacgcgcagtcaggcaaagaagctacaacaacagatttacgcgctactttctgagatgcatttccatattgatgagaataatatactacctaagtcatctacacttctcttactcaggtttacgtgcgaggatcctccaaagggagtggtttacgagaagaacaaggttaccacaagctaatggaagcctctgcttccaagaataactcagctcagcctgcttcgaatgaccaagcatgaaacatatggatggaaagcctatcaagtttacttttatatgcaacaaacgaattgtcatttggacttctaaggagggagttatggccattctactgaaaacagtccagcaatcaaagagccgcgcgagaagctgaagaaacctctcgatataccactataatttgcccatttacctcccaacgtgatgagttgtgttaacactctgttgggagggttgttaccactataaatacttccttatagctaccatttcagcactttttgatcactggataaaccaatacattatattgcagctgagttgccgagtgacttactcctatattcttgtgagttcatcctgggcttgcaagaggtccctcctggatcccctaatttgtgcttttggcttccgggtctcttgtgtggattagtttcggtttgtggttctgtggtcgtttggagattaggtcggagttcaggaggcttcggatcgtccctccccatcacttggtcgcaaccaaccttaacaggtataaagctagttacccctgctgttcacggccaattacctgtcaatcgtcaacctactatcgtgaagatcgggccatcctagcatgttcgcaccacagctggtcctttgtatccatcgtcttctgaaggcttctgcttgtgccctgtgtacgtttgggggcaagttgctgacaaaaaccaaagttttcgggttccagttgtatgaatgatctggtaggttctcatggtcccctacaaatttcaagctatttaattgcatagaagaggttgagatctaccctcacataaactgagaattgtatgcactacactcagaatcttaacaggtacagtaactgtctgttacatgaaaagaaaatccaacattattaaataattctcaccaattcccttgaaagaccacaaacctcactaaactgctggggtcattcttagtctgctcacacttttcagaaaaacacatgaacaccatcgtggttgcaaaggacgaaagaacaaaacagaggatgttatgtattatagatagctgttatactccagattgttactattatagtttagttctcttcttgctggcaccaaacaattttggtagttgatgtcatggccataaatgcaagctcctctctttatgaacaccgtttcaaaggttatttggatgtctaatgacatttttttaatacacggtactttcaagttcatatcaataagttcaacaaatacggtccatccatatctatcatctttacctctgacaaattatctatcatctttacctctgacaaatacggtcctaagcttctaaacggtgcgatttttataaaagttttctagaaataagtttcttccaataatttttaaaacaacttttacaactttgtaatagataatttattcgtttgtacccccaaaatattatcacaaaatcagataatccatcatccactcagaactaaagaacaaagaacagggccaacaatgccttcatctagggtgttgacagtgttgtcatctgcgcacttaaaaattatagcgttttgtgatctgcaaacttcaaagttacaacgtgttgtgatctacgaactacaaacttataaccaactgactgactatgcaatattaccattatagtatgataatgacaacacatatgcttccggaaatattgacaatgcaatggtagtacagtaccattttctgtactatggactagagaacctagctttactagatcccagattagtttcgaacaccttttcttgtaacacatgacttaaccgatgtttatctttactagcatggaaaagggaggttaagatctgtacctttctcccgagtctctctcctgcccagacagtcattttatcagcctgaacattgtcttcctttgtaacaatctctctgattttatttgttgaaagcaacatcaatttgaggatagcgaaggtagagcaatatctcagtataaactgctgagcaacaatgctgaaaacccctgttccgccaaaatctaatttggtctaatgatgaaaacagctgatgacagcaataattgtctccagaagccctaatattagatagtgatagtaatgtggaggcgtggagctcaataactgagcgaaaagttttaacaaaattctatgcatgctcaaactttagtctcatgagtccattaagcacaagttaggacctaataaaacaatttcggttcgtcttaatagaacatgtctttttcatttttttgcacctgtcacagtcaatcaaccaagactactttcactgtattttaaactattttcacttgagtcatgagctggatctgaaatgcttatcatataacctgttttcccatgatgtttcattataaaatgtacatataaatttgttaggtccctaggaaaccgtttatgagtagtagagtataagctttctaaggcacatcttcagtgtatattctattgggattctgactaccattgcactataaatctataatataaataacaaaaatgttgcctccggcactaatgcagtccactttcatgcttttgaggacccatcctctttaacaagttttcaagcattctgaacataacgaatagaagtgcagacattaaggctttggacctttcgtactgaattggttatgcagtcaatttgaatatgatgcaaatacagaagggaagtaaataccttggctttaaactgctactccctccggtttcattttaattgacgctttggacaatgacatgctctacaagatatacctttgaccttatttttctattataatatatacaataaataaatgcatgtttacttttattatagtgttttcaaagacaaatctatatatgtttttctagtttctttaaactaaatatttttaaagttattgatggtcaaagttataaaagtttaacctcaaccttgtcgaaaacgtcaattattatagaaccagagggaagtaacccatatgggcacaaaaatagaaacattaattagagttcaaatgagagtaagaaatgacagataggcatagcatgtccttcttactattgttacatgtaatcaaggggtgatgggcatattcacagtggtttagctgtagttagttggctgatgagtccataaatctaagtagtactcgaagtttgctgcctctgcattgaatagcacttaatggtatgggtgagctctcttgaatgcatgcacacagtggcactcccaatctcacagtgctgcatctgtctacataaacgattggaatgcatttgggcaagactgtgaggcagaacagaaatcagagaactgaggacagaaggcaagtaggaagaatctgagctgtctgaatggaagggaaaaacaactagggggagaaaaggaaaggattatccaagctttcgtgtatcatccgagtgtcccttgtatgcaatgggtttgatcaatagaggggtcttcttcaagatcttggccttcctctgcttcatcagatcatctcaaggtacattcaatctatttcagttcatatgttccttaagcgtcagcatgaatcattttccttcgacttcctttccactaaaacgaattcagtaggattttatgatggtcaaaggctggtttctcagagatgctggaatttgatcactcaaatttcaataagctgcttctatcaaccatagctttcatcatgacattttcatatttttatagcaaaaatggagttcagaattttggctgacactcagaatcataaccatgccatttgcaaccaactcctgtttatattactctctgatttcactatttttcgttggccagaaatcttaggtatagagcgatgcaataagaaatttgcaggaagaggagagggcgaaaaagacataccttataatctcggcctgtagtgaatattcagaagaaacctgatgaatggcaatgcagcatttagcttaaaccgattgagattttcttatgtataaagatataaaaggaagtgataaaaaccgtacctgaaactgggtagcttcagataaaacatgaatacttgtatttgcaggaagaaatcattttaccacattggatctccctcccctactgaaggcaagcagtttctccagaatacagcatgaggcatatgactacatcattgttggaggtggcacagctggatgcccattggcagcaacgttgtcccagaagtacaaggtgctcttgctggaaagaggagggtctccttacggcaaccggaacatctcacatcttgagaacttccacatttgcttggcagatgactcgccaaattcaccatctcagggatttatctccactgatggtgtcatcaatgcccgggcaaaggttctaggtggtggaactagtgtcaatgctggtttctacagccgagctgacccaaggtaaagaatttatcatgtatatagcattctacacatggcctgtctatctgttcaaatttatttttcacttatctctatgaacttaaccattgtcgaagaagtagcttccatagcgtgcataataacctcagatgaaaaatcagctgacaacttaaggcaaaaaacagggataattctgaaatatttataagaagcttagccaatttatggtgtctttgcatgtcgcgttctctaaccagcattttatacttgtgtcttaagcaattaacataagcttccactctgaaggtctacagatagccaatcaaagaagcctaagttgtaccggagtcactctaactattaggcagtgtattggctacttctccatgttcatgaacttactagtccaaccaagctatctcagtttccatttatacccatcaaagtacaaaaatactaccttgaagacagtcataatgggcagaccaaaaggcaaatcagggaacctacccataacaaattccaacatgtaccacaacagatcccataactgtacctcactgggggaattattatagaccttatgccttttggttgagttgtgaactcaggacaagatcttgaatcaaattggagatactccagtataaggatcgcaatgttggattgagttatagaattgaatatcctatcagattctacaaacaatacattgttccaaatttgcatgcttttcaacaaggatattttcgaattgtacttcagaaggttttagttttgccccagatgtacaaataatagccgatcccatgtataaaaggtgaagccttgcaagttgcaacttaaaggtcagctgcaagtaactattgtttttctagggaagtgaatacttattttcaattactaggattggtataattgtgaccatgatccaaaataatctgctagaagcccatgaataatatgattatatcaaattaagatccttcctatgttcaaatcagttcaataactgtagggcataagacctgaattgagattacaaacaattggttaggaatggcttggcacaattcattaatatatgccccttttttgaaattttaataaagtaagaatgtaattgttaaggtaattgctgaaatcccaactataaggttagcataagatgtgctttgcgcatagcgtgagcggctctaatggactgatattctcatgtcaatattacttttagtgatacagtaatgctaataatatattaagaatagaaaaaagggttcactgatgaatgtgcttgtcctgtagctttgttcaagacgcaggctgggatgcagagttggtaaaccaatcatacccttggatcgaagagaggattgtttattggcccaatattacaccgtggcaagctgcactgcgggacgggctgcttgaagcaggggtctcaccttacaatggatacagctatgatcatctctttggaacaaaggtcgggggaacaatctttgatgaggctgggtacaggcacactgctgctgacctccttgctgctggaaatcataacaacctcagggttctccttcatgctagtgtgaccagaataattttcaacacagaacaaggtaagaattaatccaaggcaggcctagctcttataatccctatccactttaacagcagacgcgatagtaacatcatctcttgcacagagcacaggaagccaaggaccattggtgttgaattcaaggatgagaatggggggcagcagcatgccttccttacccgaaacagagacagcgagattatcatctctgctggtgcaattggcagtccccagctattgttgcttagtggaattggacccagaaaggaacttaaaaagcataacatttctgtagtccttcgcaacgaacatgtgggtaaagggatgtcagataatccaatgaattccatctttatacctaccaaggatgcccctaagcaatcactgattcagactgttggaataaccgacggcggggcgttcatagaagccagcagtggtttcagccagtcaccagatagtatccagtgccaccatggaatcatgtccgctgaggtttggcatcaatttcaaagactttacttgcataaaattttgaattctttataagcatcatggggtgttggtgtatatcatacaaaagcttgtgtagttgtgtacataaacaacatccacatcagcactctcagaaaacaacacacgctaaattagcttgtcaaaagccatctttagtttttggtaagcaacttcattaagcttatcttcaggagcccaggattaagatatcagaggaacccagaatctaccaacatgtacacagaaattcatctcaatggttttaaactagagtaaattaaggttttaaagcagagtttcttctgggattatttatggacaaaaaattgtaataataagaaacttctttgaatttgtaaaagccaaaaagaaaaaaacgttaagcttatttacttttgagaagcatgctaactttcaagcttatcatccctcatgaattttgtcactgcaatgtagattgggcagctgtcaacgattcccccaaagcaaagaaatctagatgcagtcaagaagtatgtacataaaaaatataacctacccaaagaagtattcagtgggggttttatactttcgaagattgatggtccattgtctactggtaatctagttcttgtggatactgacatcaatagcaaccccacggttaccttcaactacttccagcacccaaaggatctcagtcggtgtgtctatgggatcaagaccatagagagaatactgaagacaaaccatttcactaattttaccctcaatggtggtggatatccaatggaagtggtgctcaacatgagtgtaacagcaaacataaacttgatacccaagcacacaaatgacagcacatccatggagcagttttgcagagacacagtggtcaccatctggcattaccatggcggatgccatgtgggcaaggtggttgaccaacaataccgtgtgattggtgtctcaggccttcgtgtgatcgatgggtcgaccttatttaggtcaccaggaaccaacccgcaagccacagtcatgatgatgggcaggtaaaggcaaaaacaaactatagtactctcctttaatctacaaaattaaatttcaagggttgatctttcttttgtcatattgtctttcatggtcagatacatgggagtgaagattctaagaagaagattaggacgagctgctggagtataactgattcttggaccttattgattatgtaagaatgtgacttaggaaaagaaaagtatatagtaatttttgaagcaattcaatatcatatcaccacagaaagaaaattaggagttttcgtttgtgttctagatgtggaaatctatggcatgtaatatcatctattgacaccattgtttctgcattatgaacaagtaaattatattacattgtaattacatgaactgcaaagttctactacctctgtttcacaatgtaagtcattctagcatttcccacattcatattgatgctaatgaatctaaatagatatataatgttacattcat

SEQ ID NO: 41172 - DNA, 20677 bp, Oryza sativa
aatgagcagcatgtcaagctatgtagaaatgtagactagaaaagatcatattttaaatctatgtagtaatgcaaaatacagaaaaaaaaaaggttttattatgccattacttgaagtctgaaatatccaacatacgtcatagttaatatcaaaaggggaaaaaaagatagaaacatcatacctttatctcatcaacaaatgctaagaagtttctttccatgtctcccaaaatcgagtcccactccactgaatttcagagcatgtcccagagaaaagctgccacagaatgaaacgagatcatcacaaggccatcaaaagcagcacgacctggctatgatcgaagacggaagggtcaagataatagctgcctacagcgcagctatccgttcctgcttgctccgcgtcggtacgccttcgccaccgaaccctcccgcggtgcagcagcggaggagccacggcggcgggatgatcgatccagtcggtgaggtgtggtcggggcattacagcaaacacctggtgggcgcggcgcaccggtgctatgcgaaatcgccaaccagagactagagcccgcctccttcgcatagcctggcgtggatggtggaggcgaggagctatgtgaagaacgcagaaggtgggcacggcgggcagagctgatcggcggcggcggcgccaccggcgccggcttattcatcaaccgaaaaaagaaaaaagaaaaataatcagttgcggggtccggctgcagcgtagcgtgcggtagaaagccaccattcgcattatctgtcattaaggggtgaatagtagatacgaacagtgaaaatataatacatgctacagtattttactatagctatagtagaattaccttaaaaaaagaattaaatagtgttcgatggttctatattggtctactgtaaattactgttgattaatcccgtgcatttatgctgcagttggaatgacaaaggataccatcccgacagccacaatactatataacattagctattttctaacattaatcaacagtaatctacattagaccaatacggaaccatcgaacaatattttcatacgtttctacagtaattctattgtagtataccttacattttactattcatcaataacattcaccctctaataaacattttactattcgtcaataacattcaccttctaatagcagagggtacataccatttagttttgagataaaatgtgagcatgatgagtgaaaagacaaaatctgtcaaaatctcaataaaattcaaacaaaacttggcaaccaaaatttaaacgattcttttgaatgttttaaccaagtgaagtagacgaaaattgttcatttttagttgaaattcatttggtttatggaaaactcgttgcttttcctataaatagaataaatgaagaataaatgttacagaattgagagaaatgctaaagaaattatgaaggaatcggaaataaaaaatgcagaataaattttacaaaattgagaagaatggtaagaaatgaggaataatcagttgataattagtgttaccatcctgtttttctctgattttttttaaggctaccttggtgatttacacattgcccctttgtgccctcggctcctcgtgctcgcgcgggttaccactcgtatgaggtgcgccggtcaatccgatttttaggccaagtgggatgtgcatgcgtgccggtccccgctgttggttggtactggtttcatcaataggctattttgtaaaaaaaaaaatctcgtgtttgcatgaaatatcatatacgtcctaggacagcctaccacgctgttatgtttcttccaaaaaaactcttcgtcttttagagaaatacaacaggaagaagaaaaaaatcttgcttataaggatagagctgtaatcattaaaattacaggggcattcttgaaaataaccacatctgaagttgcatctatccccctagtgggttttggtgattaatgacgaataaggttaagggactaatgagttttattgagatactcaggtgattagtcccaaggtaaacttaggtgagcaagagatgcttggagacctccccccccacaacaatcattcaagcggtattagaactcgaagggtgcataggatagtttaattttgcaatcgagtcttaggaaaaccatactattaggaggggttccaagtatggttctgggatataaaaagtactcttagtgagatcttagtatcgaaatatttttgggagctatttttggaaatagccctgccccggacagagaaggctggccgaaagttccggtctctggacccggaagttccggaccttcgagagtgaaattttcctaagtattgtccggaagtttcgggtgtcaggaagttccagactccttccagttcaaaaatgtgagtaacagctagatgacgtcacctagccgttatatatatatccagatctcacccagctcaccttttggccatttttacttcagttatttcatgccctaggtttctcttgaagttgcatttatccccctagtgggttttggtgattaatgatgaataaggttaagggactaatgtgtttattgagatatacaggtaattagtcccaaggtgatcttaggtgatcaagagatgcttggagacccctacaacattcattcatgcggatttgaagctcgaaagttaataggatagttttcatttttgaaattgagtcttaggaaaaaccgtactattaagaggggtttcaagtgtggttctgagatataaaaagtgctcttagtgggttcatagtgatagaatatttttgggagccatttttgcaaatgggtccagaccggacagagaaggctggccggaagttccggtccctggacctggaacttccggaccctgcattggatgaaatttgcctaagtgttggccggaagttccgagggtcaggaacttccggacttcctccagttcaaaaatgtgagtaacggctagatgacgtcacatagccgttatatatatctagatcgcacccagctcattttttggccattccacttcagttctttcatcccctaggttgttctagcctctcccaaggtccctttgcttcctccactcaaatctagagcctttcttgtgagattgtgagagtagatgagagtgtaggagtgatttggagaagctttgaaaactaggtgtggttgagcactttggatatcttgtgggctgtcacttggggcttattactcttggagatcttctcctatacggataggtgtcgcccgcgagcttccgaaatcttgtggatgtcccgggaaagtttgtgaaggttttcctcacccctgcaaggaaacgaggtaagtgattaaggattcttgtgctgagttttcagaggttctcctaggtagagcaacttgcggttgtggtcttttctagaaggatttgtgagttggatcttggtggttattcaaattctagaaaatgacctaggagtgttgagttgaaggccttggacttccttcccgttctttgtacaagtgaggcaaggggttaatcgagacccggctctttggagcacctcaatggagagtaggatcccaagatccgaacttcggggaaaaatcatctttgttccctctgtgatgattgtgcatgttactgtgattgtgcttttgttctgtcatcctgtagtttatttcgtgcaaattagctcaactccctgttagatcttcaggtttttctgttgcccggaactagttatctcgtgcaaattagctcaactccctgttagatcttcaggtttttctgttgcccggaagttccggtgctaagaacaccggaagttccagactgtctgagcagaccggaagttctggtgttctacaccaggaggttctaggcctgttgaattttaccactacgatttgtttgtgattttcaggaaagcctattcaccccccctctaggctacatctctgcgcgttcaacatctacccccaaaccctaccctgaccgtctcccatctcctccccaccacgacccacccagatctggatcgtctgcctttacgtggtgactgcatgagcgtgccttcagcacccatccaccatccaaacaatctgacggctcacatggggcacgccatagctgacataaccagccatcgaagcccacgaaaacctaacaagaggcagcaatgacatgcccacgcccatcgccgcctgcgctggggattggcccggagcttgttcgatggtatgtgctgccgtcagtcgagtgacctgaagcttttccagtggcacacgccaccattggccgctccgagagccgggctggacgtcgtgttcaatctccgccagcggatcttccattgaggacaagtttatagcggcggcagcgtagtagcagtcggaggcaagcatgacaaggtcttctcgttgtgattccgcagaaaacctgattgagggcctgtttagatcaatttgctgcggcaaatttttttgtaaaagatttggcattgcaattttacaactaggtgtttagatccattttacccaaacagtggtctaaaaaggaaaacttttgtcattttggagagtctaaacaggccctgaatgcatacgtaatgcgttacttgctacatggtcgaatcagaacgcaaagctttgcttgatgcttggtgtaactataatcgtgttatgctactaccaggattcctaattcgcgcgtacgcgccgcgggcgagcacttccggcccacacggcccgtacgcgcggtgctgccagcgctaatcgagattttttttcatagcgcacgtttaatgtaagtaactgtttaaggataatgataataattaatgaaagatttttttcttttttgagatttttttactaatagatagaaaatttttaagttacatttgaaaacttttgacttaagatttaaactttgaagtcaaattttgaaaactttcaactcatatttgaaaactttcaactccgatttaaaaacttacgactcaagatttgaaaacttttgactcagatttgaaaactttcgactcaggtttgaaactttcaactcaagatctaaaaactttcaactcaaattttaaaaattttcaactcaaaattgaaaacttttcatattaaaatcgaaaactttcaactcaaaattcaaaaactttttaactcatatttgaaaactttcaagttgatattttgaaaactttcaaatcgtattttcaaaattttcaagtcaatatttgaaaattttaactcaaaatttcaaaatcaattgtttttatttttttattgataaattactgtagcattttcgttaatcactagtcagacgttgttgttttctttcgagaaaaacgctaagcgctacttaaagcgaaggtccacgtgcacgcgacttaacgtcctcgcgcgtgcgcgcgagctagccaccccctgctactactcgatcttggtgcatccatatttttcaagtttcacagacagcaagcatgctgaattgtttccaattgctgcatccaatcctagcaggaagatcgtctgccttcacggggtcgtcgtccgttcccggctgctggtggtggcgcatcctgacggacgagtccccgctgtggacggcggcggctatagcgacaacgaggacgctgcgtggggtttggtgggctggttctattggttaggaatgagcttaggaatattagtaggtgggcacacacccagagtaacataatttaatctataacctctacgacggattaaatttatcacacataaatagattagggacttggaaaaaaaatctcgtttcacaaactttatgggtaacctcaccacccacaagaataggtatttacacacaagatgtatctatccaaccaaacaacatcttctgcatgctaccattccatccgccccatgctgcaaccaaccaaacaacatctcatcatatccaggttcatctcatccaagcaaccaaacgcctgcatgtgtatcccctaaaccaagctaaacttagcctggatgagggagatgagccagactagagggatacgagcaatcaaacacacccatgagccaggctagagggatacgagcaatcaaacacacccttaactgtttaaggatacgcatcatgcgatagccgtcggatacttggatggcttggtgcagtcaccccgtgaaggcagactatcttgatccgccccacccgtggatagactgtctccgccgccgtctaccctccccgcgacgccgacttccactctccccccgccgccaccttccggcctccccgctgccgtgcgccaccaccgcccctcgctgccgccaccaccaccgcctcctcccaccctcttcctccttcccctcctcacctccgccctcctccgctagattgacgaccgcagcaggtgcgcctcctcctcccttgatcagaagacgacagaagaaaagaattaaggtaggatataactataagtggccaaatgttacggcatgaaaccaaatcgctccaaatgtgagctgagtaatgtaggaaaggctgttgctacaaccagcccgtagctcctcatcctcctcctccgtcgatttgagaacagcctagctcctagcgcccgtcagaccagggagcagcagcgtcctgttggcccggcctcgtcccagcgagccatatgttacgactcgagatctcagcaagaagaattagagatagaatctggaatttagaaggaacaaagaagaacagagcagatacagacttggagagggggaaaggattggtatttagaatatgtttgttcaatacagttcacctctttcagtacaagggtaatctatttatagaccttgcccgaagctactggacccaatccttccccttcacgtgcgggttgtcacgcctctcccgtctgggccgagcggtagccgacggcccacttgatttgatccttcctcccgcgcctgagcctgatgacgaatactctggtgtgacattcctccctccttgagaaccagcttgaccccaagctggtgcagctggaaacttgtgacgaagttcctcaagattctcccatgtaatagctggagaagaagtacccttccattcaacctgaacttgttcaattagtttggcaccccgttgacgaaggtggcgttccaaaatacgatgatgaacagctaacggaccaatttcagaatctagtgtgggaagagaagcctgaacttgttcagctggtgccaatgccttcttcaattgagagacatgcacaacaggatggatcatacttgtagacggcaaatccaacttataagccacactgcccactcgttgcaagacttgaaaaggtccataaaatttgaaagataatttccgattggccctggtcatgacagattgctgcacatatggttggagcttaaggaacacccaatcacccactgtaaagacacactccgatcgatgtaaatctgcttgatgtttcatgcgttgctgagcccgcagcaaatgatgatgaatcaaagcactcatgttattgcgatcagtcaactaggaagccaaactcacaggagcatcaacggcagtaatagttaatccgaaataggatggtttatgaccaaacaatgcttcaaaaggagtcatagcaatggttgaatggtaagaagagttgtaccaaaactgagccattcccaaccaatgcttccactgtttggggcaagagtgcacaaaacaacgaagaaatgtctctaaacattgattaaccctctctgtttgtccatcagtttgcggatgataagaagaactcattcgcaattgagtgccagctcttaaaaataactccttccacaaagtgctagtaaatacccgatctcggtcagaaatgatggcacaaggcagaccatgaatgcaatgtatgtgatccataaaaagttgagctacagacaaagctgtgtaaggatgtcgaagagccaaaaaatgagcaaacttcgaaaatttatccacaatgaccaaaataacattgcaatggtctgataatggtaaaccctcaatgaaatccattgaaatgacttgctaagcatgatcaggtacttccaaaggttgtaatagcccaggtaacttgatatgctcagacttagctcgttgacaaacatcacaagcctgaacaaaattgtgcacagattgccttaaacctggccaagcaaaaagttgcttcactcgatgataagtagccaaattaccagagtgtccacccacagttgcagtatgcaaattggccagaatttgctgttgcaaagatttattgttaccaatccaaatccttttcttaaaatacaagatattagattgcaattcataatgtgcatgatgctttccattattaagcagagaagtaagaatccactgagtgtcagaatcagtagcatatcccagaggtacctcctgcagccaagcaggaatactgacagatagcgccgaaatctccaccatatcaacaggagattgtcgagataacgcatcagcagctccattttccaaaccctttttatagacaatgcgataacgcaaccccaataacttggtaagagctttctgttgccaagtggtggacaatcgttgattatctaagaaggccaaactatggtggtcagtccgtattacaaattcagcatgttgcagatatgatctccaatgctccatagccaaaataattgccaaactttccttctcataagtagagagaccttgagtgcgaggtcctaatgctttactgaggaaagcaatagggtgatctgactgcattaagatagcaccaattcctttgtcagatgcatctgtttcgacaacaaattatttctgaaagtctggcatggccaaaacaggagctgagatcaaagcagatttcagagtaacaaaagcctcctcatgaacagatgtccagacaaacaactgtcccttcctcaacaagttagtcaatggtttacaaataatcccataattgcgcacaaacttgcggtaatagcctgataacccaagaaaactgcgcaattctttgactgatgtaggagtaatccaattccgaacagccacgattttgtcctcatcagtagctactccattggcactaatcacatgacccaaataagccaactggggctgaggaaaagaacattttgattgcttaaccttcaagtgattatcagataagatctgcaaaacttggcgcaaatgcacttcatgctctgccaaagagtgactgtaaacaaggatgtcatcgacaaacaccaatacactgcgacgcagatatggagctagaactgagttcataatactctgaaatgttgctggagcgctagtcaacccaaaaggaagcacacgaaactcaaaatccccatgatacgtcttaaaggcagtcttatgctcatcatctggatgcatgcgtatttgatgatagccggaacgcaaatccaatttagagaaccgacaagcacccgctaattcatccaagagttcatcaatgataggcaaaggatatttgtttttgacagtaatcgcattaagatggcgataatcaacgcaaaaccgccaagaaccatctttctttttgaccaaaagaaccagagaagagaaaggacttgagcagggtttgatgatacctctgtccaacatatcaacaacttggcattcaatttcatccttctgcaatggtgtataacgataagggcgaacattaactggttgcgcaccaggaattaacggaatggtgtgatcacattcgcgaacaggaggaagtccttgtggttcttgaaacacatccgcaaagctctgtaacaattgctgaatattgtccggaattggcaaatcagaactagactcagaatcaagggtgtataactgaactagaccttcaatagaaccggactgatataattgatgtaattccaggaccgataagacaggattagcaggtactgatggaaccaccccacataaagtaatcagctgaccatccaatgtaaaccgaattgttttctgctgccagtcaatatccatagggctataccgctccaaccaatccattcctaaaatcatatcataactctgaagtggtaacaccttcaaagcagaacaaaaatgatgtccctgaactgaccaagaaacattagccaattcagtttcacaagacaacatttgtccattagccaccttaacttgaaaagaaacaggtaactgtatcagattcgacaactgaggcatcactgaagaactgatgaaactgcaggaactaccagagtctactaaaattagaatatcatagccctgaataatcccttgcaaacgcatagtttgagcagtagttgtaccctgaatagcatggactgacaaagagaacagagaatgaggctcagtatcctctcccgaagaattaccagaatcactgtcattttgttgcagtagagcaaatacctcctgaacagcattcaattgcacagaacctgaacacttgtgagatggtgaccatttctctgcacaaatataacagagaccttgggctcgccgatgagccttgagagctcgcattctatccgcaatagcagtagtcttgacaggttcagatgaagacttgctagcccctgcactagattccgacaccttggtaggaggaagaggaagaggataagctcctttaatccgcggaacatgatcacccaatttacgaaattccttgggcttctgagtctccatccattcctcctgtaaacaagcaatagccagagtagtctctaggtcgcgaggacgttgcatcataacagcatgacgaatgtcaaaacgcaacccttcagtgaacctatgcacaatcatgagctgattgtacataggatcataagcaagcaattgattcataacatcatcaaaacgctcataaaactcctccaccgtcccggtttgcttaatctgctctatctgacgaatcaacatctgatgcctatctcgatcaaatttcctatccactgctaagcaaaaatccgaccactcagaaaaccgcaaatgagccttcgacgagcgtaaccacgaggctgctcttcccgtaaagtaaatggtagccaccctgacccaaagtattggatgagtaccataaaccccaaagtaatgctcacatctcatacgccaattttgtggatctaccccatcaaactgtggaaaatccaatttcggaatccggtgattatagcctcgatcctcagaacccccaacttcatcccgatgcaatgaatcacaagcaaagtgatggggaaatggagaattagtcgtacccgtgacaggaggtggcacaggaggaataatcactcctgttgccttcccccggttgttgattgcaacgcggtggccatttgagccagaatctcccgccgacgtcgaagcaacgaacgactccggcgtgggaagtagcggtggacgttgatcgttgtcgtcgccttgcttccgcgtggagatggcacctacctgcaacatgttcgacgaattgcccaactcgccacgaagcttctccagaatctccacttgtttcttcagctcacccatctcagattgaagtcccttgactgctgcatccacttgaggtcgccagctagccatcgctttatccatctggagcaccaccgcttgtgtttcatcctgcttcaccgcaacggcgccgatggcgttctggattccctcaagcatcttctcgaatcctcccgcttgtttctccatggcatcgacttgaagctgtagccgcgtttggaaccttggcttctccaggatggaaacgagctctgatactaagatgttacgacccgagatctcagcaagaagaattagagatagaatctggaatttagaaggaacagagaagaatacagacttggagagggggaaaggattggtattcagaatatgtttgttcaatacagttcaactatttcagtacaagggtaatctatttatagaccttgcccgaagctactggacccaatccttccccttcacgtgcgggttgtcacgcctctcccgtctgggccgagcggtagctgatggcccacttgatttgatccttcctcccgcgcctgagcctgatgacgaatactctggcgtgacaccataaccgctggctgcaccattgaccgtccttccgcacctatttggcccagcgccgtcccgacaatggagcaagggggtggctctgcgcgaccttctctttactcgctttatctggctgtagccatagcccagacgatggattaggagcggctgtcttcagtgctcaggtattgcgccctattttctgtgtcttaaattgggatttgttgtctcatatatgcaggattaattatgctttggactacaatttatcctctgttgtatccacacttgatgactttacttgctggattgcttcttgtttattacattcacaaaagaatacgtgctttcgaaatgctttagatatgatacgctttgcatgacatgaagaggtagctgccagtaccatatgttaaaaatacacggaatacttttatataacacaggttggtttccttgatattttccgtaacaacaacatggtactggaattgatttcttatcatgctacttacagttgattggaatatattgatatctccttgagctaattaattagatccaacttagacatcacgagcagattcagttcaacctgtttttattataatcatcatattattttgataattggatttcattaattctataagagtgtgatgttcagttccaaattattggcctgtacactgtatatctagctgcctagcatctgatgtgagaaggatgttgatgcaatggaagtttgatctatgattgttcaagaaattaaaatgctggaccttttcttatatatcactaactttagtatgactaaattcgttgcagggcgcgcatatttgtaagcaaggaggtaagcatggactgtctgtctagctataatttttttatgaattcttgacattgctacttgctacctgcctacctccatgtctcgaaagttgtatacaccatcctgtttacagactgtcacctccttattactcgctgactagcttcgcagttcacaccctattggacataatgctttagtgcttattattactgtcatggacatgttgtgatgtaattctttgttctgaaacagagtgaaacgcaaattcgtcctaaactagcataaaaaaagaatttcatgaagttcatgcatgctaccttcattcatagaaaaaacaaaatgcagggttgattttctttagaatgaaagccaaaagttgctgatatatttctttaaaccatctgttatcagggcaattttaagttcagatattcttcatgtccaatttatcgcatatgcattccaggatagatctgcaactgctgtaaaactatttcagaaaggttggaatacactcaggcaatcctatttttaaaagccttttaccatttattttggtcttcccttctctaatacaatgttggacttactgtctacttgcttcagggaagaagggaatgccattcgaagtgagctgaaacaaataggtgatactgaaaagaaatcagtagttgtgtaatagtatcttgcgttattgcctttttctatgccaaatggaatttgagaatggaaattgcctcatcttgaatttgtcatatattagatgtgtgcctgaatcctatcaggtctcacgagcattctcgatcagattcccatgtatctgggttttgatcaggggtcagcatattttctggtatctgaattctgaacactatgatgtttactgaaacaattaggtgatgttgaacctgtcactgcaatttgtttttccccatatgcatatctgttggctatttttttttcgataggaaagggtatataagttttattcagtcattgtcggcaacgatattataattagtgtgcagaaattatttttcacggcttcgtatctcataattgcagcattacattattttatcataaaccaatttttacattaagataagatagtattttgaagattggagttctgtaatgttaatttatagcaaggttatttttctattgcagatatctggcctagcttctcaggtaaagaagaagatatactaacaccctcttgatgattgtgaactatggtgttcctatctaactgtccaatgccagcttcacatatggcattatctgctgtcggcaaatttgaaagcaaatgtattggtcgtaggagaagtctttgatagcttacgttgatgattgctgcaactttttccctcagcccattatatattttgtttaacatgtgaatacaatgttttggacatattgtatcttgcatatgcttctattttgcaaaaatgcctttatctcatctagtctcattaacagaggcagagcccggcgaaagataatcttattagcagataagataattacacaaagtcattgggttccacgaatcttcaacaccgccggcaagccaaagataattacataggaccagaatcttttcccgatgaattttaggactggcgctgcttgatacctcgctgcccagattccaactctaatacgcaccgagtttgccacgataaggggcctccggacctccatacatgcagacaagaaggagagaaaagtgatggcgcagacagactttgccatggtgagagcaacgggagctagcacgacgtacatgcccaaggcgaaggcggcgaccaggcttgtagctgagctccgcatcatgaccaacgatagggactggtatacgtagcggatggagatctcccgcgacggcatcccagagtagagcaggctgacggtagctagcagagagcaactgaatgctagcgtgtttgcggtgatgaatgcgttgaaggagtagctcccagcaagcgtcggtgtcccgccgttcgcgtggtcgtctgctctgtatcccccaggtaacgtgaaagctgctgcaaatgtcaccgttgcaatcagaacagatgaaatgccgagaactgaagttgcgttcgtcaagtactctgaatcgatttcttcatccctcctctttgaatgcttctcatagaagtggtcctggcgactgtgaccaactggagctctggcaagtgctaatgattggtgtatcatacctcgtgaattctgcaggttaacgtatcgtatatagtggggacagaatcagacaacttcatatatgtagctaggataaattgacacaaaagccagaaaaaaaaaacgattactacctttttatagtagaatcttgcaggaatcataatccatgaaagatcacgaggtgtcagcccgtctttgtttggtaaattcaagctcacctccctattccgaaacaagaggttgaaaattgagacaagtccagctttgacagcaaggtgcagcgcggtatccccctggttgtcctgcacatttaacacagatgcaagttcgggccttttgcacacaaatgcaacaatactatgcctcttcttctccacagcaacgtggaggaaagtctttccttgcatgttccgcaatgcgatgcagccaggggaccttccgagcaaggttatgacagccttgagcgtcccattggaggcagcaacatgtataggatatgatcctccgttatccggttggtacatagcagattcattggcatcaagcagcagcgtggttggacttggtttcggatggaaatattcagaccatcttgacaaacctgtggtactagttttcagcgatgcagcgaagtgaagcggagtgctcccatttttgtcgccttgactagtaaggtgtaagagaacaggcatactcctataccggcctccctgatcaatgttgaccttaacatccttgcacttgtctaacagtatagacagcgctgcaattcggtgtcgtcggttaagcaagtccaaagggaaaataaggctcataatagtaatacccaatcaacgccagtacataactggcatcaccactagtttttgaattaccagcactttataaaagaaggaagtgatattagtgccagagctagcaattaatgatatttgaattccaaattcaaattttgtaatgccataaacaaatattatgtatccatctcttatggccagactactcgtatgtgtaaaacccttttaggagtactttataaatgctgtgcatactttgaatactctaaaaaagtatactctttgatattaggcagcatttctttcactgtcttgagagactatgatactagctagtattaatttacttgtgtttttttttgtttcgtttgcacattcttcttatggctggttactttggatgttttacttggtacagatgtccaaggagaaccaaaggtatcttgagaaatcctgtagtctcaatgggtctcagtgcggcacataacaggattgattgcagagtttcaatggccggaatatattatgaatggaaaataaacaaggagttggccatacataccttcgccgcggtataccgagatatgcagcacgttttggccttcaggcccagagtatgacaatgttgtaggacttctatcaagcaggtcccgtgcaatctccaagcgccccagcgaaacggcgaggtacagcggcgaggcgccgatgccacgatcctccggaatcctggccagctccggatcctccgacacgagcctctccaccaccatcctgttgccgccgcggatcgcgccgtgtagcgccgtctccccgagcttgttcctggtgctcaggatccgtccgttggcggcgccgccctcgtgcgcggccaacgagatgagacggcagaccatggcatggtgcccggctctggcggcgcagtgcagaggcgtgtcgcctctgttgttggtcgcgcctagcaggtgcctcgccctgccgtggatcatctccgcgcactgcacgtactgctcgccgtcgccggaggtggccaccacatggagggccgaatcctggtccgaatcaagagtcaacccttccaggagaggcgacgctgctgctggacgatttgcaggttgaccttgttgagctagatcactactagtactactagtatttgaagctccctcctccggcatgcggatgacgagatgggattcagcagccgcctcctcatggttgacgagaagattctcaagcgccttgcacgcaccagatcgtgcagccatcagcagctgcggatccataatcacaggggaatccatcgcgacaccacgccaatcgtgctctggagagggagatcgtttagggcgatagcagtgcaggcacccgatattgagttaccccgtacgccagctaggcctagcaccgttgaaagaaacaacctccacactgcacgagtgcacgtgacctcaaatagagcccaaaaaattttagcccacagtggtgtatccttgattgagtgtaccaaacagcagaaagaaataaattaccctaaactttcctcaactacacccgcatctccttttcttctttttttttttacttctcgaggcttcttgccatctctcgcgactcgccatctctatccgcacaaccgcgccttctccgcccgccgaatcgctcctcagctcagccacgccgcatcgctcctctgcgccgccttcgagcgttttttcccctcccccaatcgagcgaaggcgaggctcagtggcatgagagattgcgacgccctcacctcccccaactccaccagctctcccattgcccctccgccagcgcccctcctccctccgccggcgccggctcgacgacgccgcctctcccctctcatccctgggcggcgagttaacaagctccccagccgccgcgccgtttctccctcctccccatccgtcggcgcatcgatgcagaggagcgcagcggcctcggggatgagcggcagcggcggcggcatcagggatgagcggcggagcttggcgtcgaccttgatttgtgttgccgcgatgttagcgatttttccaaatctcctcggggccgagcggcaagcggtgattttgttgccgcgatttgtgttccttgatttgttgccactattttggtgggcgtgttccttgatttgttgccgcgaatttggtgggcgaatttggggaaaacacttccacgggtggcgcgaggtcacgagcgggcgggggcgcggggcaacgcgctctatagcgcttctctccgtgggagcgagtgtctcttctgaggcgcggaacctagcgccacgcaagctcgattccgacgtggtgcatcatagcaccgatccacggtgttgcactgtgaagggccttagccactcattccccgccctcgcagtcggacgggctgccatgagaaatcatcatgggaactgcaggggcattcgcctccttgtccgattactccatgccatggactccctccctggcttccttctacgtaggattgcaatcaacgctcttctccctcttcttaccctttctgcagccttaagtctgagctaaactcggtaaagcttgctctaccccagcagaccgttcgttttctctataaagcagggcatcagtgtgttggcaattttttgtgacaagttgacaacaacgattgcagcaccttatgccttgcggtgatcctagagtcgccaaccacctcgatctagcaaagagctaaatctagatgggttttgacaaataaaccggctagtggagccgatttaagataacttctcgtttcgtgggcaaaacggaaggttttcaggacaaacctacaaagaaatgtcgcactctcgcaacggcggcggacagtttacggtgcaaaccgacaaagatggacaaactaagagaaaactgaaagcaatatgaaaaacgatttgattgattgattgtagattggttttttacaatgaaccagccatgtcccttatataggggttggtcttgtcctctacaggccctcctccacatccaactcggggtagaaactaaaggaaacccgaaacatgccttcccgagcaaggaaaccatgaaacccgacgaaacgcagtcggactcggacctgccggtcagaccggccacacaccgtcggtctgaccggccctcaaccgacggtctgaccggccctcaaccgacggtctgaccgcccaacacacggcggtcagaccggcccactcggaggaaaccggtagacttccaaattttggcaatctttcctattttaatcctaggtgccaaatttgggtgtaaacacatgcccccctgcctttttgatgaacaacgtgaatctaaaagcatagaacatgttttggtcttaggactataatccaattaccggccatagtacctcctaagcgtcttgccacacactcgggaagtatttcttcaagtatttcccattgattgctcgctgaaaacgctccccttgaagtgtctccaagaaatatgcatttccttgaacaatgccgcatactcgataaggaccctcccaactaggtgaccacttaccgaactccctggatcgagtacccaaaggcaaaattgtcttccaaaccaagtctccaacttgaaacaactttgctttcaccatcttgttgtacgccttggccaccctcttcttttctttttctatttcttccaaagccttcaagcgcttgtcgatgacttcatcaaggttgtctcccatcaatgtcttgtaatcttcacttgacaaatcatcttgcctgatgtaacgaagagaaccaagatttacctcaaccggtaaaacggcttcttgaccataaaccaactcaaaaggagtgaatttagtggcaccatgtttagatatcctatgcgcccacaatgcttcggaaagcacttcatgccacctctttgggtgttcctcaatcttctttttcactaatttcaacaatgtcttattactcgactcggcttgtccattagcctgagcgtagtaaggagaagaactcaacaatttaataccataagattcggcaaaattcttcacttccttagatataaaagaagcacattgatccgtagttaatgtttgtggaatatcgaatctatggataatatgcttcaaaataaagtcaattacctccgtatgagtcatattcttcaacggcacagcttcggcccacttggtgaagtaatccgtagcaactagcacgaatctatgcccctttgatgacggaagataaatttgaccaatgaaatctaaagcccaacctcggaacggccatggtttgattataggattcaacacggcggcgggcgccaattgaacattgccgaaccgttgacaagcttcacatcctctataatatttgaagcaatcatcaataatcgtcggccaataaaaccccgctctcctaagcaaccaattcatcttgtgggccgattgatgagtcccacaaattccttcatgtacctctctcatagccactttagattgatcttcatctaagcactttaacaagacaccatctatatttcagcgatataaatcttcatcaagcaatgtgtacttgaatgcttgccgccgaattttccgatcaaccttaagcgtgggatctttcaaatatcgaatcaaaggaatcttccaatcttcttctgtttcttgggcacaaatgt

SEQ ID NO: 41173 - DNA, 2719 bp, Oryza sativa
cccccagcgctctgcccagaactgatcagaccgctcggggtcgccggtctgaccgacggcatgtggccggtcagaccgcccttggtcaccggtcagaccggccgtgcaatgccggtcagaccgctcctggtctccagttttgccaatttcgcacaaagatttaaaatcaagcaccggctcttctaatatcagaaataatcctttcttcacattataaccagatgcttgttgtgccaagtcatttgctctagaattatcatgcctagcaatatgtctaatagcaaaattatcaaaattggcaataatatccaaacatgaattaaggtacctatttagtgatccatccaagtatttgtaaactccggcgacttgttgcaccaccaattccgaatcaccaaaagcttccacgtacttagctccaaccatctccatgacttgtaagccgaataacaaagcattgtattcggcttgattatttgtacaataatattccaaacgaaccgatgcttcataacacacgccattaagtgaaaacaaaactacccctatgccttagaccttctttgtaagaagaaccatcaaaataaatcctccaaggtataacttcaactaggcaaatctcttcctcataagcaatatatacatgatggtccactataaaatcacatatgatttggcctttcatagatttcaatggttcataagccaaatcatattctatcaaaacatacgcccacttgccaattctcccacttagaattggcctttgcaacatgtgtttaataacatcagtttgacaagcaactatgcatgtaatagataacaaataatgcttcaatttggtacaagcatactataagcacaaacaaagtatctctataaagacatacctcgtctcggcatccaaaagacggcggctcaaatatgtaatgatatattccttgccatcttcctcttgcgtcaaaacggcaccaatgactttgtcttcggaggcaaaatataaccgaaaaggttttccggttttaggcgcccgcacaacgggtggagtagacaaatacctcttcaactcctcaaacgcatcttgttgttttgccccccaagtaaaatcggcctcctttttcaagcgaagtataggaacaaaagcatcgattttacccgctaggttagaaataagccttctcaaataattcaccttacctagcaacttttggacctccttcttacatttcggcgctttgaaatcacgaatcttttctatcttcttaggatcaatctcaacccctctctcatgcaccatgaatcctaagaacttccccgccgacacaccaaaagcacatttaagtgagtttatcttcaaaccataccggcgcatcctctcaaaagctaacttcaaatcggctatgcgtccttccataccatccgatttgacaacaatatcatcaatgtagatctctaagataatacctagcaaatcatgaaagatcaaattcattgccctttgatatgttgtaccggcattcttcaatccaaaagtcatgacaacccactcaaacaaaccaacaaatcccgggcacctaaaagccgttttgtacatatcttccttcgccataaagatttgattgtagccggcattaccatctaaaaagctaatcaccttatgacccgaagcatcattgatcatcatgtcggctataggcataggatattcatctttgggagtggctttatttaaatctctaaaatctatgcaaactctaatcttaccactccccttcttctccaccgggactatgctagaaacccactccgcataacgacatggcctaataaaccccgccttcaacaaccgatcaatctcctctttgactcggtcatatagcaaatgattaaaacgacgaggtggttgtttataaggcctaaaacccggtttaattggaagccgatgctcaacaagctcacggctaagacccggcatctcattatactcccatgcaaaacaatcaacatactctttaagtatctctattatcttaaccttataatctgctctcatatttttgtttacaaaagtcggccttggtttgattccatcacctatgtctacttcctccaatggatcggccgatgtaaacccttgtccaagcttctccacttcatcaaaatcttcaatagtttcaccaatatcgttctttgtagaccgatattcttgcaccctcttttgtaaccactctaaattagcctctttactcattatacaaatttatatggcttagccgtgctacactagctggctttacatagataggtacaaatttgccatcggagatactaataaaatcatagctagaaagatccctccccgataagcattgaatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatccaacaacgacccaaaataacattgtagttacattgcacatcgacgatgaagaaagcggttagtaacgtcttgttccccatggtaagctccgccgaaaagatacccttcgcctccgttggtttaccattgaagctattgagaatcatgttagtcttcttcaactcatcatcctcacgccccaacttcttgaataatgaatacg

SEQ ID NO: 41174 - DNA, 9883 bp, Oryza sativa
gataaggataacccgacggcggcattgaataagaaccccatgacatgtcttgtggatgatgatatggaggtgaatgcgaccgtctcggtgaatgaccaaatcgctccctaggaggtgatcttggtctttttcctttgttgggagccctctcaccaccttgctgctcatacttctctaaaagcatatcaaaagtcactttggtcttcctaggggctttagaagttgaaacttcactcttattctccttccaaacgccaacctccggcttctttggcactatcatcttaggtcttggttcgccaatgaccactccttttctcttagtagatttggcttgctccggccgaatcaacaccttcttatcattgaaattaattgtattcaccggaaaaggatcatgatcaagcttcatcttggagccatcagtgaacttcaatcgtccttcatctatggccgattgaacctgtcgtcgaaacacattgcaatcattagtagaatgagaatgagaatcatgccatttacaataagctcgacgtttcaattcttcttgagatggtatgacatggcctttaggtaatctaatttgtttttcttgtaaaagataatcaaagattttatcacacttggccacatcaaaactatatttaacctcactttgccgatctttatgaggagacggcattagattagaacaaacaaaaggcttgtttttgttagtccatgaccattcagcaacatacatatcatgatcaccctcatcttcactatcactagcctcagggtaattaaccacattaacattaggctttttctcatatggtctaacaatttttttattatccttaacccggctttctttagccagagccctttgcataagttgactaacatcaagaaattgctggccatctagtctttctctaagtggagcaattaaatcattaaaagcaagaccagccaaatctctatcagttatattcaagctataacatcggtttctaacatccctaaatctcttaatataatcaatgacaggctcattatatttttgcttaaccgatgttaaatcacataacctaagcttagtttctccagtataaaaataatcatgaaatctcacctctaattgagcccaagtatgaatagaatttgccggtaaaaaagtaaaccatgtaaaagcggtaccggataaagataaagaaaacaagcgtaatttaaaagtatcactattagcctcaccacattgcgctaaaaattgacctacatgctcccatgtggtactaccatcttcaccactaaacttggtaaattcgggaactctataattacggggaaacggcacattatcataatagtcaggatacagctttttgtaaaccctggcacgattcctagtttcaatcccgaatttatccctaataatctcactaattatttccttcatattatcaggcctatgttgatttggcagtggatttggtggcctaataggttgtgtttgtggcgcaatatgattatattggccctgcctagtatcgggaggataccccctagcaacatcattataagcattaggaacatgtgggggaacttggggactatttgcagcagtagatacaggagcatcaaatgttctaagatgatacaaataactagcattagtcattggatctatcccctgtatcggtataattgcgccggtctgaccggtccagggcccggtctgaccgacatccagaggcgcggtcagaccggcctgagtcccggtctgaccgccgggataatacccggtcggaccggccgcttggccggttggaccgaaggcgaagtcgcggtctgaccagccatcaggcccggtcggaccggccgcatgcgccgctccattggtcccgctactcgaacccatctaatctatgggaaaatttgaaccatgccacacaaattttgcaaaatttgtgatatgccaccctgacccacatgtcattgactcatgtgggtcgtacatgtcattgagatacgggtggcatatcttaaattttgcaaaattagggtggcatggttccaacaaacccttgatctataggagcttggttagcagtggtagaggctttatcttttgacatgtaatcggccataagagggccgaatttaaatcttaaaaactcatcaaatttaccctcaaaagttgcatccaacttatctttaaaaacagtcatagatgaatctattgtagatgctacttgctgttggatagattgtgttacctcttcattgcttaccaaatcagaagcgagcttaggacgtggcctgggcttgatgatcacgccttgacgagtcctagtgcatgctctcatcagcgcctcctgtgtgatctccttgatgtactcctccatggacttgcggtcttccccttcgaaatcatccaatgtgataggtatcacattagatggctccacctccgtcttggatggcggcttcgtcatggcgaagtcgaagttgagttgacgctgaacggacctccccagcggagtcgccaaaatcgtgttggcaactttttgtgacaagttgacaacaacgattgcagcaccttatgccttgcggtgatcctagagttgccaaccacctcgatctagcaaagagctaaacctagatgggttttgacaaataaaccggctagcggagccgatttaagataactacccgtctcgtgggcaaaacggaaggttttcaggacaaacctacaaagaaatgtcgcactctcgcagcagcggtggacggtttacggcgcaaaccgacaaagatggacaaactaagagaaaactaaaagcaatatgaaaaaagattcgattgattgattgtagattggtttttttacaatgaatcggccatgtcccttatataggggttggtcttgccttctacaggccctcctccatgtccaactcggggtagaaactaaaggaaacccgaaacatgccttcccgagcaaagaaacctcgaaacccgacgaaaccagtcggactcggacctgccggttagaccggccacacaccgccggtctgaccggccctcaaccgacggtctgaccgcccaacacacggcggtcagaccggcccacttggaggaaaccggtagactttcaaattttggcaatctttcctattttaatcctaggtgccaaatttgggtgtaaacacagtgcaagtttaataatacaacccactactagtttctaatcatctataaccaatgtaatagccaatttatacaatagttacttactatactattaatatctggtcccacctatcatacacattacattttggagtccgtgctacagctggctacagttctgtagcccgctgcttttctctctcttcttttatctctttaaaatatatttatagctgtcttatagcctactattgtatctgctctcgtgacttttatctaaaaaaactttttgcagcctctgctaaattttcgtcttgtgcaagtgtaacacctgtacacggaataaagcgacctacacataaaacgagacgagtgggtaaggtgtgattaattaagtatgagctttgacacacttaaaaattgaatttatttgattcttctaagaaactttaatactccacagttttttaataaaaaaatacacaaaccgtttagcagattagaaagatagcttacggttgcgacacatgacacatccgtaggctatgttcttgaaatataattcataggaatcatattctatattcactttcaaaatatcttgatggtgaaatggttgatacgccgagcgggcaatgaaaaataatacttccttcgtttcataatgtaagtcattctagcatttctcacatttatattgatattaatgaatctagataaatatatatgtctagattcattaacatcaatatgaatgtgggaaatgttagaatgacttacattgtgaaacggaggaagtagcaatagtcgtcacagaacgcatgcacggaaggtgagcagaacacatacgccgatcggccgatgcgtgaaaggcgaacagaacaaacgcgagattgccgccgcctgccgcccacgtcctcttcttctcacggcgaaatcgcgtgaatccatggcagcccgcatcggcgcgtgtcgcgccggcgccgagccgccgacgcaattctgcgctgcgcgcctccgcggctggtttccgctgcttcttgctggccgcgccagctgccctcgagtactggatgaggaggacgcgcggtcactgaatactgatgtctgtctgatcaggtattctgttgagtgcaacaccaatacatggcacatcattgctaattcgccatcaccaaatgagcacaaattttgtaacattgtgaatttatctgttaatttgtaatatatctgatgtgttagtttttgtcgtgtattgatgtatggtcctatgctaggttaattcagttgttatgatagttggacaaactgacgaagacatgatcgcatgtgtttccgattcacttgtcatgcacatctagacatttgcgatcaactaattggtaagatcttaaatttagatatgtaaatttgtagcgtaatttatataagttaaactactataactagtaatctacccgtgctaacgctacggaaatatttagtaatacaaatcaaataaccaaaataagatatgttttgccaagcatataatgagatagaatttatagtaacaaatattgtcaaatttattattatatatggatgatatgaattgttaaaaataataataataaagttattttaattgttcatgaagtacacaatttaatttatcgagctgcctggaataggctgctcatacaatggaagatgattctcaggaacaaaaactctgaacctgtacaccaacaggaccataacaattgaaattatctgcataaagaggagatataattcaaacatgactgatcagagttttcaaccatatctggagtgtgcttgagcttaaaacaatgtcagtactcacgtattctataatgtttttgtaactcactgatcatgctctaaaccagaggactgtttggaatcagaacaattctgttacttatagattttgtacaaaagtttaaacctaatcaggaagatttattattccgtgcatgataataaataaatttagccctaatcaggaagtctcatatcagacgggagtggttcgctactttcattgaaagccccatagcaaatttggaaaattctactgatagtgtaatacccttactcccacaaaatcttaaaaaaaaaaaaaacatgtacgaatttggtcatttcaaacataacacctaatattacagtatttccgaagatcagttcaggagcaatcaattattttgttctaatcctcacatggattaggatcacatagatgatttagaaatcaaatttttgcagaatcaaaccaatgtaggagtacacaacatggagtgctggtttgattgccactgatgcaaacaaatggaacacaataattaaccaatcacaaaaatgtaaaaaggcattactgcatacatatgacaccaatcagttagacaattgcactttttcaaataatcaaagagtatatagcaggttactgaaatatggcatttgagaaaaaaaaaaagaaatgaacaatcaccccagatctaacgggcatgtagtgctcacagtacttgggagtccagggcagcctcctccgagcactgccacttcttgccatccataagttataggtccagcttcttccagaagttacattaagggaagcaacggattgtccaattatgtcggcagtccagtatttataagctgtattctgcagtagtctatcttggcacacatcacaggcaggagactggacccccaagccaacaccatacatgtgaaccattggtagatcaataaccagattacgttgaaaaataatactcataaaaaagaaaccgttgttcaacctaatagcagaaacaacacatgaaatattcattcagaggtaaattaccattcattcagagaccgcaattggcacatctgttcatttattccatcaatcattgtgcttactgcattagattttttttctaccagttcaattttaaactaaccaactccacataaaaaaatggaggaagtactgttgattactgaagatatgagaaatgttgctaaaattcaataacttgtcactatcggtggcagaatatttaagatacaccatcgatgtcaattaccagaaccatattatttagaacttatactcaggtggctcactactgaaattaagaaaagagcatgtgttcaaatcaatataaaaaaaatataaaacaattgttaacaaatggttcagcatttctactcttcaagtctataagcatcacaatgcagtatcagtataagctatatcaaatttctaagagaaatgagacaccgatacttccatccctgtaaaaatgcaacagtagatttaataattggacctattacctgtctgagcacttattaaggttgtcaagtgacagattttctaatgcagagcaagatgaaccaatagcttctaaagcttcgtcgccgacaccaagccataccatctttaaggattccaaatattggcatcctttgcaacagagattattcctttgttttcattaacatgcttggactccacggataggacttccaagttatggcagtaggttccaatagcatacagggatctgtctgtaatgcaaccattgcagaaagaaatatcaagagagaccaataatttactatgtatctttacaaattcaaccagtccttcgtccgtcaactcttgaacaccacacagctttaattcactaagattgcaaccctctgccagagtaatcaacccatggttttgaacataaccaccttgtaagaatgttgtcaataaacaatgaaactcgggggaatacaacactaaatatcagcatgaaatgaaacctcaatgcaaagtttacaacatgaactgctggcttgaacaatgataaacctcaaaaaggagaccattaccacaacggaactcactattgctacaatatgatcctcaagtttcattcgaaaaaatagttaaaataaaagaggcatctatgatcaccattcaccataaggaagcattaatttcttcatagtttgaaagattttcccgccttggaaatgaaagcagatcatgctacatgtgaaacaatattgaatgcacgaaagaaaacagaacaagtacaactaacaagaaattaccgaaagcactaacgattgcagattccggcaatgatttgcaattcccacctagccccttttcagaaatgtgcaaaaaccagtttagagtcagcttttcaagccctttgcaaccctcaagacattaaaacttaaatatccctcaatgagatgaagtagcccagcatcagtaaatgaggttgggttgacaccgtcactgccattttcttcttgcgtatcttcacttggtgtggaacactgcatatgttgctcatctgacttggggctttcgttatcccaatcttgtgcctgtgacaaaaataatgcattagtgacttgcaaaatttatagacagaccacatcaagaaaatagtttccagagatctcaattataaattatatgcagctctggcaaaatgctaatttatcagggagaccagaaaacaaaatccttaaccacggatttaggcgatgaaccaataaaacatcggatcattcattcaattcaacaggggaacacaagagatgcaaaaatttagcgcgattcacgaactccagccagcgaaggactcaccctgctccgctccgcggcagcggcggaggcgccggcggcgatgtagaggccgtggtcgaggaagacatcggtgaggcccgggaaccggtcggcgacgcagcggaccatataactattctacaccctctcccccaactgaacccacctccctttcccatcccgcgcgtcgcgcctccctcctcctccttctacaccccctcccccaaccgaacccacctccctttcccatcccgcgcgacgcgcctccctcctccttcttgcgcccaatcccatcgccgcctcctcccgatccctctttttttcgtttttcttcccgtcgccgatcccttcccctcctcccgatccccctcttttttcatttttcttcccgtcgccgccgcctcctgatcccttctcccgatccctctttttttttctttttttcttttcttttttcttttttcttttttttttctattctctccctcccgatccctcttttttcgtttttcttttttgttttttttctcttctctccctttgctgcaccttggaaagaaaactaataattaaaatgacaaacaagatttgaacccatgatcccatgtttcatagcaatctctcctagccaatttttcctatgacactgtgattaaaaataattgtttgcttgctttgtatgaatgtccaaattttatgataacaaattatttagttatgttattgcaagaatcatacctttttactatgatttggcagtaacattacaatagaaggataataacacgatacgttactgcaaaatttataggttgtttggcactaacaacatggcgaattttgtagtaacagaagaatatggagtaaagtgtattggcagtccttaatcttaatcttgtagggttgtgttatataagtccctaaactctcaaaatacatatccagatcccagaacttgtcaaagtgtatcatctaggtcctaaatcgacacatcccctctaggatcctgcgtggcgctgatgtggcataccacatggacgtgacgtgtccttttctttttttcttcttttatttttctttttcttttccgttttcttctcattcttcttttttttcctttctttgctcagttcacatagaaaggagaatgaagaggaaaaagagaaaaaaaggaaaaaaaaataaatgggttccatttgtcagtcaaaataataccacgtcatatccatgtggcataccacatcaacgccaagtaggatcctgaaggggttatggtgaattgggacctaaatgacacactatgacatgttttgggacttggatatgcattttgagagtttaaagacctagatgacacactcctgcaagtttatggaccgccggtatactttactcgaagaatatgcatagtaacagtggtactatactatagtttgtaaagctaaaatattttaaatctaaatctttagagagtagtaacgtatacgtcatgtcttatttttctaacctatttgcatcatggcgttcgtaaaaaaaaatgcttaacgaaactagaactatcataactacttttcaacgtcattactgcagaaagcagtcgtgttactacacattggccgttgcgttactacgacgttccagtgagacaaggactaaaaagagataaatctcaatctttagagagcaatatctctcacatcatatcttgtttttctaatccgtttgcaccatgacgttcataaaaaaacgcttaacaaaactatatccatcatgactgttttttgacgttgttactgtgagaaagttgtcatgttactgcacgatgaccgtcctattactgcatgattcctgcaagacgagaacagcaaagtggtgggcgggtttgaccagcaggaggatgctttgaccgaggtgggaggggggttttgggccctagggagggtgggggaggggggtttgatccttggaaagaagttgggaacctgcacaaaagaacacacccttaggttgcattcataagtatggtttgactgggttagtaagtggtgcagacaacgg

SEQ ID NO: 41175 - DNA, 4182 bp, Oryza sativa
  unsure (1)..(4182): unsure at all n locations
tccagtgcagatccaaggttgcctcgagtgcgctaagggcgtgccagctggtttgatcctgctaccagcaaggaacaaaaaagaaagcgagttagccgataggccgatgacgtatcgttgatggtctcagccgatgtagttagaccaaatcggctatagactgagtagatcaaagaatataaaaccctaaatatgccgcatcggctgtaatatgatctgcttagtttgataaaatagattttagacgatatcatgaaaatagctgatggaacggtatttagagtaagataggtaaataaatataatgtactagctaatactctagtacaaacttatataaacaaattaatccatagaaatatatcaaataacgatcaactaccaagcttggcaacccggccgatactgatctagatttgatatatttatatggagtgatatgtctatataagtggcaaatatacataaaactaatgaagaagcatgtatattaggtaagattggtttaaactccaatactatctctaattataattaattctaggttagtttttaggattctagacaagagtaggggtgatgcatcttaaagtaggtaaagaaacctaaagtataaacaatcaaggaattaaatatttttcaagatggtagatgccttagttaatctaatctagtaagacaatttagccgataccggcaagaaccctaaaacaagaaccagccgatagagctaaattgagcatatgatagcagatggttatgataaaaggactaaaacatctaaaccgacataatagccccaatagcacaagccatcgaaacggattacctcttatcaagagaactcgtcgaaaagaagaacaaaaagggtgacgatgcgctgaagttgtattggattgtctctattattacaatggtttggggtttatatttatacccacgagtacaaacttagtccattagagcaagtttaatagtatagcctactactaacttcaattcatctatagccaatgtaatagccaattcatacaatagttgcttgctatactattaatatatggtcccacatgctatacacacattgcgtcttggagtccgtgctgcagctggctacagatctatagcccactgctcttctctctcatcttttatctcattaaaatatatttatagctagctaatagtctgctattgtacctgctcttatggacacaactcaaactttcctaaaaataagatacaaacaagactacatggcggtctcctgccaaatctctaacaaacaaacttaaatatcctaattaatagatacaattgccttaattgagctttatctctaattggctatgacggttattccaatctaggcccaaaccgagcccaagtcatattgtatcgactacttgccatatcggctaagtcaagcccctgccctgtttccagccgatacgatgccagccgatgcacagtccgactctgaattcaactcaattccacaccaaatccacctcgatctttctctttcttctccaagtctgatgcaaaattccgttgttaacacatgccccccaattccgatgtattatataatgcagtggaatttgctctcatcaaacccacgaaattttagggttttctgttctgactgttaagcttataagtagtgcccactgcttcaaaatctccttttccggctaagtcctccacaagtgctcctacttcaaggatcccctctgtctctggcgacatggctcttggcggtgaatccctccgttctcaagcggttctgcgcaaaatgcaatggcgaccacttccgatgttcctgaggtaaattcttcattctttatcatcctttgttttccaattgcttcattccgtcacttagggtttgccctttcaaatctcttgattcaacatcttagagggcaaattgtgattcctgttctgcatgacccaacacactatttccttggtccaatgggtgactcaaacccaacttacttcattaacgttgagaccaataggatcccttttagagaaacaaagccagaactagcccattggcccacagtcttcgggtctcggccatctaaattagatgaatggaaggaatggtacaggagaatctcagcttctaagcaatccttgtggaaaaagatgggaatagctaagtgtctgtcactatccctagccgatatgccaaaaaatgagtccatgttatcagttgcgacctatttctggtctgatactctgaactccttcatatttggtcaagggccaatgacaccaaccgttctatacatcaagatgctaactggtttagatatcacttcatcagccaaccccatcaggttgaaaatcaagagtgaatataagataaagaccaaggttggtggtggctggttaggatatgcaaccaataacatgggtactggcccagtgacagatcaagaacacatcgcctttctcaacctgtggttagagagatttgtattctgcggcacaacttgtggtcccacagccatccttcagcatctagcccaagccattcatgagaagaaaccgattcccttgggaaaatatcttctaggagcagtctattaaactttgagccagacatcgactagattgttaatgggcttatctgtcaaacatgggggcccttggtggttcatccagctacggctgaatatctatgcagttaatgccatcaaccagtagtatcttcaaaattccatattaccttcccttgatgaagatgaagatgatcatgcacgcatgtcttttggagaggctgtttacatgtttataccccgagtgcaaacttagtacattatggacacgactcaaactttcctaaagattagatacaaacaagatcacatggcggtctcttgccaaatctctgacaaaccgatttaaatatcccaattaatagatacaattgccttaatcaagctctatctctaattggcaatgacagttagtccaatctaggcacaaattgagcccaagtaatattgtattggctacttgccatatcggctaagtcaagcccctgccctgttttcagccgatacaattgcagttgatgcgcagtccgactctgaattcaactcgattccgaaccaaatctgcctcgatcttttctcttcttctccgagtctgatgcaaaattccgttgttaacagaaacaatgaaatttaaaggaagtcaacgaaagtgaaaataaataaataataatcatttaataatttaaaacaacgcaattgtaagtatattttttcatgctctatcttttttataattataaacatatttttaatgaattcttcttatttctaactatttcaatgagttttaaatggacttcatactttttcaagttttaaaaaattttaaataattttttcatgaattatctttattttattttttaaatctttttaaaaaattataaacatacttttaatgtattcttcttatttctaactattttagtgtttttaaatggacttagttttctttttttcccttcatttcctatcctttgatattcttgttttacattttcatccaatgtctctaaaattattgctcttattttctcgtcaaatttattgtctcctctttttctgtaaacgtttttgagagaatgacgtatgaaaacatagctagaaatgtaatatgttaaccatacatcaatagaggatgaagttttttttttgactgaaatagaggatgaagttgctaaccttttggatattttttatttgtgtaatatcaccaaaatactttagcaaaaaattttggtatgacctctcttcctcctcctcttgacagcaatggcttgggctggaggaagaataaggcatataaaaaggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41176 - DNA, 788 bp, Oryza sativa
cacgccgccgggccctcgatgcggcagtgcacgtcgtgccacggctccctcggcccgcctttggcgacggacgcgccggggaagctgggctggtggaagtcgtcgcggtgcgcggtggcgagcgtccggaacagcgggtgctcctgcgtgtcgtaccttccgccgcagaggtcaatgccgccgaggaacgcgacgaggccgcgcgggccgtcggcgaccaccgccttctggtggtgcgtgaacacggcgtcccgggggcacacgacgcagtgcacgcccgtgccgcggaagtagctcgccgtgtcctcgccgcgcgccgcgcccatcctcccgtcccgccgcgccgcgccgaggccggtggccgcccgatcgtcccacaccagaagcagcacggcgacgcgctccccggccttcgacttgagcaggtgccccagcgtctgcgcgggccgcctcgggtcgcgcaccagcgcgacgtcggtgctcaccgaccagccggcgatgtacaccagactccgggcgttggcgacggcgtcgaacacgtcctcccagcacctgctgccggcgagcggcggcgcgacgtgcgcgtcctggtacagggtcaccttgcatccgcggtgctgcccgaagaaagcgcggggcagcccggtgtacggcggcggcggcacgggaccatcgacgcccttgccccaccgcgacgtgacgtcggacatcacgtcggtgaaccggagctggacatgaaccttgtcaaggctttcgagtggcttcctcttctgtcgcagagcgggagc

SEQ ID NO: 41177 - DNA, 5507 bp, Oryza sativa
ctggtattaaaaacttgatcagtctatgctaggtcttaggcttgtgaaaagaattacaaaacttgctttgcgcgaaagaaccatagccatcctttgaattcctctgtcatgtgcatcattgctgtgatggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccaatgatttaagactatgcctgcgggcttatgatgtaataattcgtattagatactcgtgtatttgcacttggtatttcagctatgaattcgtgtgtaccagactacttgatacagggaaatggtactgtttacacgattgattcctgttataaaaacgggggtccacagagctggtatcagagccatacgactgtaggaaaagaccaaaaggcgccccaccccttttctaagttggccaagggagaaattcccatttagtaatactttcaaaaataaaaacgctatgtttacaaaaactcggtacaattttcatcttactcttaactattttctttacaaaacaagttttactctcaactgactttgggtttttcttaaaattagatggcagatccggattcacccgctacttgggtgttgagcctacctcaatcagaggggtatgtcattgagctgcatcggatgttgaggcgtctgcgatactctgggttcccgtcataccgagtgagacagtgtggctcagtttgggaggctcgggtcgaggttcacccccgagtcccttccgagttggactacagctttcagacacgtcaccaccgagacctgccagagaccgcgatgcaggatgcagcccaggaggccttactccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgaccaccagagacgtgtgggggagttagagactgaggtgaccgacctcacagcgcagcagctgcagttggaggaggagcaccaggcttggggcagtgagatagactcactgaaggcacagctccaggtccacggcgaccagttccagcagttatctgaccagtacaacgatcgccgcgggatgatggatactcttgaggggcagctgagagagagtcaggagcacgtcagccagctggaggagcagcttcgagcagccaagatcagcaccacaggggcttctacttccacagcagtaggccgtgaccgctacttcttcctcaccccgccgtacccaccagcattccacgctcttctgggagaggctagtatgctagctaccgagtcagcaccctacctagtggactcgacagcggcacaaccacctgtcctggagttggtgcacactccactgatccctacaccttctccgcagctgggttccagtttggagactccgatccaggtcgactccgagacagaggggaccgacaccgagccagagatcgagccagacatcactgatccttcagaagatgagacccctgttccccgcatcaccttccttggaggtcctcgcaccctcagcactgctcgcaagagcacacgacctccgggcaagaggcccaagccagatccagaggccactacctctgagccgtggggactcaggtttgcgcgtgccagcgaccaccctctacctgccccaggatcctgcggatggctggaggactagactgacggactccttgcagcttcgatctcgtatcagatggtttttggatagtatgcgagacacccccctcccttacctagattgacgagtagattgatgattagtttgatgtatcttttggatgaaccttatttggactgcgtatgtatgcggtcgattgcatcatgatttatgtaccatttgtgaaactctgttatgttatttatgatatctattgttgttgtgttataaatgagtttattccaccatgcttgcaaaacaaagttcatatcaacacaactcccttaatgggataaagccataggagctagttagaaaattaggatatttactccatcaacctacacagatggcaagccgacgtcgggcaacaaccagcaatgacgaaactcagacacccgacttaaccactcttgctggagttatggccacccaaactcaacttctgcaagctatcgcgaacaaccaaggcaaccgcggaggtcaagctttggagagtttatgaggaccaagccacccacattcgccacagctgaagaacctatggatgctgaagattggttaaggatcattgagaagaagctaactcttgttcgagtacgtgaggccgataaagtgatctttgcggcaaaccaattggaaggaccagccggagattggtgggacacgtacaaagaagcccgagaagaagatgctgtagaaccaaactgggaggaatttaccacagccttccgtgacaacttcgtgcctgccgcagtgatgcggatgaagaacaatgagttcaggagactacagcaagggaataccacagtacaagagtacctgaaccgtttcactcagctggcgcgctacgcgactagagatcttgccgacgaggaggaaaagatcgacaaattcattgaaggcttgaatgacgagttacgcgggcccatgattggacaagaccacgatagtttccagagtttaatcaataaggtcgttaggttggagaacgaccggaaggtcgtggagcacaatcgtaaaaggaggcttgccatgaaccgctcgcctcagaccgcaccccagcgtcctaaagggacaacctcctcggcatggagaccaacagtggtgacaaccagtcgacctgccgcctccagcaatttccacaggccggttaccattcagaaccgcgctcctgcaccgaatcaggccgccactggatcagtaaggcctggaagctgtttcaactgtggagagtatgggcatttcgccaataaatgtcctcatccaaacaagacacccatttgcaccggagctaatgcaacggctattcacgggactgctacccctgccgttggacgaggtctattcaggactccgcagactaacaggaccgctaccggatttggacgcgggcaagtgaaccacgttcgagctgaagaggcccaggaagaccaaggcgtactgatgggtatgttttcactcaactccactccagttaaagttctcttcgattcaggagcatcgcattcatttatatctttgaaagcaagtcaacaacacaatttaaccagagttaaactaagacaaccaatgttagtacattcacctgggggtgagatagcagtggatacagcttgcattgacgtacccatccgccttagggatgtggtatttccctccaatcttatggtgctaataccccaaactcttgatgtcattctgggtatggattggttagcaaagcatagaggaataattgactgtagacgtagagaagttaccctgaccacaccctggggatcggatatgagagcaaccatggattaagatcctaggctaaccgaacgtgccggaggtatatttaccatgctacccctaaagggaatgcccgtagtgcagcgatttcctgatgtgttcccagaagatttacctggaatgccaccagatcgtgacatagagttcattattgacctgatacccggaactgcccccatatccaagagaccatatcggatgccggtcaatgagttagaagaacttaaaaagcaaattagggagttgcaagaaaagggatttgtacgccccagttcgtcaccttggggagccccagtgctattcgtcaagaagaaagatggtagcatgagaatgtgtgtggactaccgctcactgaacgaagtaactatcaaaaacaagtatccactaccacggattgatgatctcttcgatcaacttaagggagctaaggtgttttcaaagattgaccttcggtcaggataccaccaattgaaaattagaaccggggacatacccaaaaccgcgttctcaacacgctatgggttatatgagttcaccgtaatgtcgtttggtttaaccaacgctccggcatactttatgaatcttatgaacaaagtgttcatggactacttggacaaatttgtggtggtattcatcgatgatattttaatctactccaaagatgaggaagaacatgcggaacacttgcgattggtactcgagaaacttcggaagcataagttatatgcaaaattcagcaagtgtgagttctggttaaaagaagtcgcttttctaggccacgtaatctcggccggtggagtagcagtggatcctgctaaagtggaggctgtcacggaatggaaagcacccaaatctgtgactgaaattcggagttttctaggcttggctagatactaccgaaggttcattgaagggttctctaagatagcccgaccaatgacacaactactcaagaaggaaaagaagtttgtgtggtcagagcagtgtcaggaaagctttgagcagctcaaagaaaagctgacctcggcgcctattttagttcttcccgacatcaggaaagactttgttatatattgtgatgcttcaaggcaaggactaggaggagtactgatgcaggacggaaaagttgtggcctatgcgtcgcgacaattgcgaccacatgaggaaaactaccctacccatgacctagaactcgcagctgtggttcatgcgctaaagatttggagacattatctgattggaaaccattgcgatatctacactgaccacaagagtctgaagtatatcttcacccagtcagatctcaacttgaggcaaaggcgatggttagaattaatcaaggactatgatctagaggttcactatcacccaggcaaagcaaacgttgtggccgacgctctgagtcgtaagagccattgcaattatctgagaatggaagggatggtccctgagcttagggaggaaatagctcagctgaacctacctcgtgggcagataaacaccctggacattcaatctcttttgagaacccaaatagaagaagcccagaaggacaacgaggaaatccgagaggtgaaggaacgcttagctgcaggacgtgcaaaggaattttcaaccgacgaaaaagatgtcctatggtataaaaagaggatttacgtacccgaacagggtggactgaggggattaattttaaaggaagctcacgaatcggcatattcattgcaccccggaagtacgaagatgta

SEQ ID NO: 41178 - DNA, 2546 bp, Oryza sativa
  unsure (1)..(2546): unsure at all n locations
gaaatagctcagctgaacctacctcgtgggcagataaacaccctggacattcaatctcttttgagaacccaaatagaagaagcccagaaggacaacgaggaaatccgagaggtgaaggaacgcttagctgcaggacgtgcaaaggaattttcaaccgacgaaaaagatgtcctatggtataaaaagaggatttacgtacccgaacagggtggactgaggggattaattttaaaggaagctcacgaatcggcatattcattgcaccccggaagtacgaagatgtaccaagatctgaaggaaggatactggtggcccaacatgaagagagatgtggcggaatacgtagcactctgtgatgtgtgccaaaaggtgaaggctgagcatcagcgaccggcaggcttgctgcaaccccttaggattcccgaatggaaatgggatgaggtaggtatggattttattgttggattgcccaagaccgcaacaggatatgattccatttnnnnnnnnnnnnnnnnnnnnnnnnngacggcaagattcatccccgtcaggacaaactatagtagtgctaaactcgccgagttgtacatgaccagaatagtgtgtcttcatggtatacctaagaggattttatccgatcgaggcacacagtttacctcgcatttctgggaaaaagtacatgaagccctaggaagttacctcgcatttagcacagcttatcatccgcagacagatggccagacggagagaaccaaccaggtcctagaagacatgctgagggcttgtgctctggattttagcaaggactgggagagatgtttgccctacgccgaattctcctacaacaacagctttcaagcaagcctaaaaatgtcacccaatgaggcattgtttggtcgacgatgtcgtaccccgctaatgtggtccgagactggagaacaggcggtatttgggcctgacattattcaagaagccgaagaaaaggttcgcttgatccgtgaccgtctaaaagtagcacaatcacgccaaaagagttatgccgacacccgaagaagaaacctggaatttaaggagggagattacgtttatctaaaggtttccccgatgaggggaacaaaaaggtttaaggtcaaaggaaaactggcaccaagatatgtggggccattccagatcatcgccaggcgaggagaagttgcatatcagttacagttaccagagaatatcgcggatgtgcacccagtcttccatgtgtctcagctgaagaaatgtttacgagtgccggaagagcaagccccgctggaagagattcacattagcaatgatctcacatatccagaacacccgatccggatattggatgaagccgaaaagaggactaggagcaaagtgtggcgtatgtacaaggtacaatggagcaatcacactgaggatgaagccacatgggaaagcgaagaattcttgaggacggagtacccacatctattcgaaaactggtaagaaatctcgggacgagatttatttaaggggggtaggtttgtaacactctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggaataaaccgtaaaaacaaaattggtaaaatacatacaaattaaaataaagattaggtggggatagaaataaataaaatattatcgcgaccatatttggatcaattaaatttaaatacgatggaataagaattaaccctaattaaaactcaaacaaattatataaaaataaaatatgagtaatattaatctagggtgaattattagttaagataacacaaatattgagtaaaatgcatatatgcaaaattaggaattgtggaatcaaatttatatggaaaatacactaaaatcgggttaattagaaaatggcactgtttattgcacctaaggtgttcggcgcggtcccctaacccagctcctcctctttccccctctctctcgtcgccagccgccgcgcgccgtcgccctcgtcgcctggcgccgcgccaccgtcgccatcgccatctcatcgccgcggccgcgccgtcgccgtcgcgtcccgccccgcgccgcacgtgcatcccatcgccacctcgcgccgcgcgccaccactgccgcgccgtcgccgtcgccgtcgccatcccgtcgccgcgtgcgcgttccatcgccgcctcgagccgtgctgctgccgctgccacgccgcgagcccgcgccgcgccatcccatcgttgcggtcacaccgtgccgtcatgtcgccgcccatcgcatcccgccccgagccgcgcgccaccgctgtcgccgtcgccatcgacgtcccgtcgccgcgcgcatcccatcgccgctgccgcgccgcgcgctgtctcgtcgcctcgcgccgagagcccgcgcctcgcgccccgtgctgcgccgctgccgcctgccgcgccgcacgccgt

SEQ ID NO: 41179 - DNA, 1979 bp, Oryza sativa
ttcctgcagccccatcattcatagttgccgtgggggagaacattttctggagcgggccatgtctacttcaagtccatttctccgatatacattccctcttccgtaggaagagactggacgccaatttgatcgctatctggtgtctgtaagtgctagacttgaacgtgttaataaatcactatacctatatgcgtagctcatttgatcatccattgttggcaggatgaattacgtggaaatcgaagcggtgagaaagcctgtcggctatctaaacccgtgcaggataagtcagtcgaaccacacatacaggctagacgagaagaagctaccggaacacatcaaggcgatgactcccgaagagaagacagcttacataggacaaaggcatcaggaaaagctgctcgatgtcgctacttacgtagcaatagcgcttgaatctgcgcaggacaaggagtgcgttcatgccctgtatgcctttgagtaagttttaatatccattaagagtatatacatataatcacggctcaactaacaattttgtttgcagcgaccattggatagtctttcttctctatccaaagtacaatgaagtcatcgtcttagattctctcgacaaagacggcaagacatatcaggaatttctaagaattatcgatctgtaagttatatattatcgtaacgtgtttcaatcttcgaggaatgtaaattaattatatctgcaaatagtgcatttaaaaggtattaccagcaaggcggacaacacaaaaactcaagagaacgcatatggatgctgaacagtactacttaattttcataaatgcatgtgtctatccatttgataacctaatataccttataattaattgatgtcgaaagtgtcacaagcaaccggtgggaaccgtactatgcggatattacacctgcgagttcctaagggttaatgggaaatattacgtgaattacgacgaggaaagtaatacacacttgttaaattaatcgctaacttgtattatggcgaataatttccttaatttttcgtgatctgatgcagcttccaaaattcctaagtctgaaagagagctcgacgataaatccattgagaacatacagcgggacatgtgctacttcattcaccgtgagtgcgcacatcagcttgggaagtttttttgacaaggatggagttttgagcctgccggagaacaaaaccctgtctaactggagtaggagtttaatatagccagggtttctcgtgatctagatgcagctagcttgtatatgtcgtcggacggttttgtaagacattcaattacttgtatatgttatgtcgtcggtcgaattttgtcaatgtacatataggtgcttcgaaattatatatatgtatattattatgcttcatactccgtgtgtggctctaaaatacttgaaagagaacataatctatcgatagctcaattagttataacatccacgtgtgactctgaaatacgcgcacaaacaaaagtaaaaataatatatataatattgtttttaattttttttaaaaaaattacaccttcacaggcaggccacgtgtcagaagtcgggcagtccatatcttcgccatcgggccacgtgtccccttaggtcatttttcctagcgggccacatggcctaaaatactgtaagctgccagcgaagaaatatcttcgctgtcggccgtcctaaggctaccacaagcgaagatacttcttcgctggtggctggcttaattatgtccgccaccagtgaagaaatatcttcgctagcggccgtcctaagaccaccaccagcgaagatatgtcttcgctggcggcggacagaggacgggggggcgccaggggagctggtgcggccgcccgggcggaggtgcgccggccgccggcgaagaaggagcggggcttgtggtagccttaggacggccgacagcgaagatatttcttcgctggcagcttacagtattt

SEQ ID NO: 41180 - DNA, 19557 bp, Oryza sativa
ctggcggtatataaccgctagcgaagttctacattttcactggtctttcctttgtggcagctgcgatttctgctagcggaaacccaaaatggccgccataaaagatggtttccgtagtagattcccatccatgtactaactccgttcaaaaaagaatcaacctaggatagaatgtgacctatccttagataataaatctggataagtctttgtccagatttattatcccaggatatgtcacatcctatctttatccagatttattatcttaggttgattctttttgagacagagggattatacatttattatcgtagattgattctttttgagatggagaaagtatacatataaacttgagtacgtttattaatcatcttgagggcccgaaccaatataaatccttgttacttgttctctggatgcgatctcgcgtacaccatggtcccaacaatccccatactctacaaattaataccgttcacgggtatagcccgttgaaaaaaacctacgaacaggtcagcgactgtgacattagaagctttatgatagattttcctttttagctttatagcggttgaagaatgtaattttatttccttcatgttgaaatttctaatcaagtgtttcctctacgaagatgtaagtaatagaatctctacataaatgtattaattttggaagtaattaactcgcaatttctgattttttttattgactgcatttaaattaaatcgtctcaaatgatttacggataacgaacttactgttattaccgtcccggttttctggtggtcagcaagcttatacaagtggtattcactttcatcagggtttgagttatacatggaagtgatagaactaagatacgtccctatcaacaaattaaatagttgcatatatatatactagagctgatgctagcgcgctaaggtttcacggccgtttgagtcgtacagttcgtacacctagactatttttttcttctccggtacgtatagttgccaccggtttaacagtcgatttcagatggcacatatatatatatatatatatatatatatatatatatatatatatatatatatatatatatatatatatatagtctataccatggatcacaattccgaaggtatatgttaagattataggcatataatgatttaatctattccataaataaatcataatattacagatgaaaaactagcatgaacgcaccattagatctacacatgtaaactacacagtataacatgaacagatcaaatatgcgcaacatattgaacacgtaccgaggtggcggaaagaccggctgctcggtcgaaacttttcgtaggcgtctacgaaggcacgcagcacgcgagcgaagaggaagacgagccgtcgcggacgaacagggagcagtcgtgcaaagcgcttcccaaaaaccttattgctgccttctcccggtgcaggacgtcgaaggcacaagttctggagacttgctttcccgatcgcaggtgcacgccggcgagcaggatggagtaatctatgagcgacggcgcagcacagagtaggaggcaaaccctagattgatttcgcgtgtgttgcgtgaagacggcgggtcagtttatatagagaagggtcgcttgatcagggcgcccgcacgatttccattacgcgtaaccgaaccggataagtcgcgcgtaacttatccggactccacgccgtttgcacgcaccggatttttcggaacgtttccaaaacaaaaacgaaaccggataagtcacgcgtaacttatccggactccacgccgtttgcacgcaccggatttttcggaacgtttccaaaacaaaaacgaatctgaatttgcagcaaaacaaaactgcaaaaagaaactgcatctgcgcaaggtgaggaaccaattttggtggaccattcgacgcgtacatcgtgcacgtgcgccgcctgccctgccaggcgaggcgagcgagcgtgcttgttccccctcttctctccaccacacatgcttcaagtggctaggagggcatcctcccttttaaggaggtccccctatgctagaataagcaaggtggtactaaactccacatgcatgccatctcatgaggtgggcttttgttattttctaaagaattaatcttcgagtgggctaaggcccatttattaattccaacagggaactgcatatctgtttgtcgacagatttttggggcaaaatcacccacatttttccagcctttagatctagatccaatgcatagaaaaaaatgactacaaacaaactttttaccgtctgggccttaggaaacaaaaataaacaacaattaggctgaaaaacaagcccaaaacacagagcccaatagaaattagacacgaaattatcattcaaaactttgacacaatacaaatggtcggaaccatacaaaaacaaaccaaaaaaaaactctatactagtgtagaaaacagattcaacagtaatattttcactgcagagaaaacatgtatcaatcagtgatattttctctaatacctttaacaaccgatttgatcaaatgagcacatctcatatgttgagcttgaaatgccaccatgaaactcagcttctgcctgaacagcacatgtcacgattgtagaaaacagtgcatcagtaaacagctaggatatacaacgagatatctgcaaaaatggggattttctttgtgcacgaaattttctttgtgaaccaaagaactgaaatcatataatcctttatgccaaaattaactctgaactaaaaattcataataactataaaaatgcccatctagcagggcatcagcctccccagattcaacatagacattccaccgtgacaagttcaattacaagaaaaaatgaatatctagctaccaatagctaagttagttacaagaaaaaaataataagaattacatatgtaactaaggtatatttccactgtaactagactgtaagtggtgatgagttgaactgtaagtatgatctaagttatactagtgatgaatggtgctgcatgaaacacaaggcaacacagataatagaaaataacggtacaaaacttagcctacattactaactagcaaaaacaagtttgtgcctagggttcctcaaactacaagtttgtgcctaagaaaatgaagatgcctagggttcctcaaactacaagtccctcagttttcacacaattcattgataaaaccaatataaaaaaagttacaatctaattaccaacagttagttacagtgagagataacataaattacaactgtaagtgaggtatatttccactgtaactgcactataagtgatgatgagttgtactgtaagtgtgttttaagactacatgaaacctaaagtattgacttcatctgataaacaaaattcataactaaaaataccatttgaaaacttaactaaatcaccagatgtaagaagagggcattaaatacagatttagatcagccattcaaatgcctcaagagatatttttttctggggtattttcctaagagaaaacatctaaacgttacaaaagaaataaaaaaacactaataaaccataaaaggcacaagttctccttttctgtttgaatgaaaggaattaatagacacataagagttatgtccaggcgacacttgttatgcaaaaatcaagcagaatctacgcaaagacaaagaaaagaaagttaatgttggttgcatacactaacaggcaacataaatgaagtggcctcacacttgcaatgacgcaagaagcctagctaatttcagtaaaaacatataactaattcaaaaatggatgatgaccctacacatcattgattggaaaaaaacctacaacacaaggggaagcagcgcaaactcacacatattctaacttttgcatgcacaactgacaaaaggagtccctagggttcccaaacaacaagtgtcctagttttcacacaaatcagtaataaaccaatgtcaatcaattacaaaatctaactaccaacagtcagttacagtgaggtataacagaaattacaactgtaagtgaggtatatttcgactgtaactgcactgtaaatggtgatgagttacactgtaagtatgttttaagttagaattactataatttcatactacataaaacacaaaatatttaagttaggtagtctacaacatgattctaatgctttcaattacatacaccaaccatacttgtgttaaattacatgtaggggttgatagaacaaaggctcaagtaacaaggacagttgaaggttagaatatcatgcttacctattattatgcatcatatctgatcttcgtagaaaatttcatctagcacaaatttatatataaaaaattagtcatgacacatgtagtaaataaaaataatctaactacctacattcagttacagtgagaaactacaaaagttacaaccgtaactatagtgcatatggactttttacaactgtaacttttgctatattaattttccatgagaaagtatatgggtgtggggctagcaaaatggcaagcttcacgtaactagtgtatacaactatcaatctttaccaagtaagtacaatattgcaatggttcattcataataaagaataaaaaatatgcaagcatgcatgctgctgatgttctgaatgatgaaggaaagtacatctaaactttatatagaacaataacagaagggaattgtaacagaagcacatggaaatcatacatcaccttgttttgcaaattgaacacaacatatatctttaatcaacgcacagtttagatgtaagcttgctgcagcctgcacagggttgctcaatcaagattgtattgtagaagggatcttcattggttctatcgtataggacacaatgaatggagctctaaaggtgcttgcaacttaaccaggtgatccattcaaacaagatttaggtgtataattgacactgctttgtttcataaaacaaagaacatgataaaagcttttgttattctaaggtggacacatttacaatttattgttaacaaacacagaaggagacgtgcatgttaagaacagagggaaaaaacaaaatccccagtacaggacagaacaaaacagagggggaaaaagatgctagcaaacctgtaaatctgccaaaagcatgtccaatttactccgaaaaatgcaaatcacacaaaaaaaaatccccatctaccagacacaaaatcgagctcagtgacaagaccaaaaaaaaaatccagccatcgtttccaccgatggctagttcggtggttacaatttattctattcccaaatcacacaaagcagatgtacttaaaaaacagatcagacctagaaaatttcaaatagtgtgtagctttacctataaataaacagatcagagcactactcacctggaacttaacaaaataaaaaatcaacagctaggcaatctcatcggcatgacatagaaatcaacggatcaggggactaatcaaaacaagggcaggacggaagtgctccgcgtgttcaggttccatgacatagaaatcaacagatcaggggactaaaccaaaactaccgattccaaaatctaaaacagttaaacaagcatcagatccaaacattaagagctacctaaagcatcaaaacctagccggaataagattgaaaaaaaaatcaactaatgatgcaaacaaataggagacaaggagagaaaaatcagcagaaaactctccggcgagctgaatcaccatggcgacctacctctctctcgcgcgccggcaagccctctctctcgcccgcgccggcaagccagctctcactcaccggcgagatgactctctctctctctctccggagaaaacaatgaagagaaaagaaaaaaagagagaaggaaagagagcgagaagagagctgaggaaaaacaacggctacggagtacagacagaaaagcgtggagcccgacatttgagagggatggcccacatttgactataggcgcggtctgattacacgtgacgcagctgcatccccacccccgcatgcgcacgaatcatagcgcaaatcctacggtcagaaaaacgacaaatattaggagagaaatttaatgacaaatatctagcaaaatcgttccaacagtatatatatgtgatagtcgttgttggcatatagctagctagctagctatagtatatgccaattgagtgagctagagtgaccatcgatcgatcgatggggtcatcaacgacaagatttcctcacctcctggtgcttctttgcctcatcttgcgtttgttgtccctccatgcttggttgatcgatttcgacttcgatttctctgacccgtcgaccttcaacgtagacgacctgcggctgcaaagcgacgcggcgctgaaggagggatcatctgggatgatgatcgagatgaccaagaacagcacgttcagcacggggcgggtgacgtaccgcctgccgctgcggctcatctgggatgatcgctgccggacctcggtctcgtggggaagatgaccgcggacatcgagttcgacggcgccacgaacgcgctcgccctcacgctgcgcttcgacgacaacgccaccctcgcgcccgcgcacatcatcagcacgcgcgcggacgtgaagaggttgctgacgcaggaggtggccttcggcttctccgcgaccactggttcttggatcgagcgccaccgcatcctgtcctggtccttcaactcaacaacagttgctgtcgaggatcagcctcgcgagcagtcgacctctactagcttctggtaacttgcacgccccctgtactctccctcagtgaacaaaacaaattctagcggttaagtgtgacatcctgatctaattagaatttaacctgtgtgatccaagagagatagggtgtacgtttagcaccatcttgctagtttagtaagggtgaaaccaacttataatgacatgtctcaacatatcactcccgggctagtttagcaattgtaaaaccaacttataaagacttgtccctctaaccatattactccgggttaatcattttacacgaaataaatcaattcctattctttctgaccttttctttttacaaacctatactttcttgccatttgtttgcaaattgaaattttttttgtcatcttcagtgcctcttacttaccattggtttataaatcgaaaaattttatcttcaatgcctcttatttattaattttttatcaataagaaatattttggttaatgagagatatatatttcagtcttttgtcttccttcttaatttactgcttgggatgctacgaattgtattttttatgagggaatagctagattactctcttaaagttgctacttccggtaaaaaaaaaagttacttttaccattcaaaatttatctaaaatatagctacatttcctcctctcatccatagaatacacaatcatctctcgttaaatttctctccaattactttctcatcttaaacaatgataaatttttccatttagttttacccctctgtttagttgctttgaaaaaaaatataaattaaagatagttatattttgtggaaaaaaataggacaaaagaataccgtaggttcataagacataaccacttatatttttagacaactaacatacagacaagtaacatacagttaaatccatataatattatcagaagtttttgttttaacaacattagctactccactttgatatgcccaaaacatacattctacaatggcatattctttcattactggagtgagcaaataatagtattatcatatcacactcaaatagtataaactagctgcataatttgtgaaattatttagagctagtttaaattagaattaaatttgacacaatcttatttgtctgctttattaagtttgtttgttattaatcatctgatattttagttatcttactttgcacaacattaaagattgtaactttgctataacggaattatggttttcaggtgactgaagtcaccttcaaccttacactggtttgggaagggaataaggatggagaagctaagaaggggaggaacacaccagtgatggcgactctgcagcagtggcagcgcaacaaagagatcttcctctggcgatggtgggacagtagtggtcatagagtttagaatttgggggtatcaggggggggttgttccttacaacttagagggatggccttggatgtcgacaggaccagcgatgggctgtggcaatgggtggaccgcgaggcagcatgggcactgctggagccatgaggatggaagctatggtgggtggggttggctgcttggggtgggcatttggttagaccaaaacatttagtcttggtctcagccatgatcgaaatttcatgacatccatgagaatcacacaattgccaacaaatttcatgtccaaaaaatcatacatatgaaaacatacacacatacataaatgacatatcggctcttcgatcctaggtctaagtaggaggaatagttatcagggtggaggatggcagcgtgtggtcaggggcagacccagagggtagtccaggtaggcacagaactaccctagaatttggcccagaaaagaccaggtattcatttttcgtggcccatcaaagaaagcctgacccaacagaaaaaaaaccctaactctcttctctcccctctccactcactctcccggcctcccactcccgacgggcgatggtgctccagcgagccacgactccggcggccggcgctcccgtgactcgcaccgccgcgcctcccgcctccggccggcggcgcctcccgcgtacgcgcctcccactgccttcgcgcgccgcgccagcgcccgcgcgcccgcgccctctccgcccctcgccgacgcggggggcctggccgcgccctctccatcccgcgtcggcgcgtccggccggcgcccgacggcctcctggctcccgcggtcctgcccgacgcgcgccaggggccagatggaggtcctgctccggccagcctctgacggtcaagcagtaggttgtcgccggtgccggtgctggtgttgccgtctccttcctagcttgcccaactgagctcatcaagtgtaggtaattaattagcttttactcaccattgcgtgctaaatcctttcatctggtggttactgcactattcactctgagggtgcctgagctctgcatcatcgtctgtacataagcttctgtgaaattgcccttttctgcacatatcattcttcacccatcagccatgttacctactcgttcaagtgcatttcacatttcacactgatccttgtgctttataggtttttaagtgttcttacgttttgtcatatctccttagaagggagatataagacaactaattgaagaatttaacagtcaaaaacatgccttttactcctattcgatcttgtgtatgtccttggaagggatatatgagttttgagtgtcaattctctagacaaatgacatcagactgcgttttctgaacaactgtcctttttatcacaagcaaacttctacatatgttaaacaccatagatggttgctctatcaaatcaatattgtgagctgttgcaacataatagtacttactatttcgattgtattgtatttggattttttttttggctaggcctaccctgggttcaaatcctgggtccgccactgcgtgtggtaggtggctaggggctggggactccagtggtgctggtggcggcgtcgggcggtagagcagtaggaggtggtggtcggtgctggcgttggctaatgaggatagtgactccatgctggtagaggactaaggaggaggaggaggagttgaggaagtggctgcgcggaagaagaggtggtggtgaacaactcaggaggcatgcgatgcggagtcgcggaaaggcagcatgcgatgcaaagtgggacgatgtggtgtgcgagtgcgatgctgaatcaggacgggagaggttgcgtgggatgcagagctgagtgatgactgctataggttaggattaggatcttagtcgacctattggactgaaattcggtgtattcagctaaccaagcgtactaactgaattgaccaaacaaaatttggtcttttaacccccgagaccgaattggtgacaagatttctcagtctcgatcccgaccattttggtttaggctttttcttcctacccctattggctgtagggacaacgaagggtcgtgaggttaggagttagcagcgatgaatttgacaacaataggcaatggtgtcgccgccggacacgggagaaagagagaaggggaagtaggaggcggttggtctggtgggcctcgctagcgtcgttgacggccactagctagccgacgtggctaggagtgatgtggtcggtcggaggcaggaggttggcaacgagagagcacactgagccactgaggattgtgcatacggatgcgtgcggaggggacgtgaaaacggggagaagagaataaggttcactgttcacacacgaatcgagatgcaatcttggttgtctgatggattgtccaaaattttgggtattttcagtcacatgtaaactagacagttccttaatataagtatactgcaaaagatccatttttatttcctgaactgtgtgctaaaactcaattgatgtcacccctaaatttcaaattcaaataaataacgccataaccatgtttgaaggtggtttttgtttgacatgattctttttctttaatttgctggtttaggcttctgtataagtttctatatttctttaatttgctggtttagacttctgtacaagtttcaatatcatattgatgccgacgtacgtagatagatctaccttcgacaaacttctgttttatatatgcgagtatggagctagtattctttgtttgataaaaaaataggcttctcagttgttcaattttcgttccagtggcaagttatatctatctatctatctatcttctattatctactccttccgatactagcatatatcccatccgatactaagttgatatattctgatacagagggagtatctattatctattatctatctattatattaaaagtccattagacttcctagaacgctcataagctgccatgtggtatcctacaaacactcataaatcgtcacgtgtcactccaataaaatagaaaaaaatcgaatgaaaatctggaaaaacaaataggtggattttaggtcgttagatctatatatcttggaaaaaagaatatctcaaaccaccctttcacctgcccctatgctatatgtacgtactcatgcctccgttccttaatttgctttttttgtttatctccatgacaattaaacctgaattatctgtggtggcaagaaaataaccccacaaatcaacctccacctaccaggtttaaccggttcttgctctattccattttttttaactttctcctctagctggcacttaagaacaataatagacttcaaatattcataactttttaaatcatatattaaatttatgatcagtttgagcaattgtatttttaattaaaccaataattcaatatccatattgactatatttcagtgctaagagaagcatttttttccagaaccacatccatcttggggccttcactaaataaaagaaaaatactagaatttctaaataaaagtgaaaatacccccaccttaagttatttaataaaattggtggacctattgctcaccgttagacatctcacaactttctacgaatttagttactttctccaacatacatataagggctatttacctatacaaattatattgatgcttgtctaaaataaattatctttttagtagataaataaatgcctttctaaataaatgatcttcttaagataatcatagaatctaaattgtatatataacatataaagtcactaataaattagaaaaaaaattaaatgatatcatctttttacgtcataatgtgtacccatatagcctatttttatagaaaagtgattgaatataaaaaacatgatcaattgaacatcatattgaatcgtatcaagcgtgtgggttgtaccaggaatcttagcagtgaaacaaccctcaacaatgtaccaagtcaattccatattggagttagagaccatgttatttatttatttttggtaaacttgctatattatattataaattcatgtcatctattgtagaacactctagaaatgtgtttcaagcggtatatgatatccagtgcaaatgcaaatgatatatagtttcattgaaaccaaatccattgttgcgatataatatttttgttataaattcaaaactacacggtttcaagacattttagtttagaatttatatgctgcaagaagaatagaagaaaatcataacaatagttgagagcaaacccaaacaaattattgacaagaaatatgtttacaatagagtaaaggaaagttttaataaaaattcacccgcacataaacattcacaacaaaatttcaaacatagtaaataaggtgtccgcgcatgtacgcgggcttctttcctagttagaaaaaaaagatcgatttttgatgtgaaaaaaaaacagtcacacgacaaataattggcccatatagttgagattaattatgtacatgcatgcttgatcgtgacaaatacaggtcatcacaccaagctggcagtaatcgttggagctacgactgggtcgtctcttgcgatcatggcgctatgattcattctctcgcggtttagatggaaatacggagacggagcatttcaaatcgacggaaaaaaaaactactggacctagacagttccagtacgccgatttggttgctgccacaaacaactttacgatggaaatagggagaggtggatatgggatagtctacaagggaagaatgaggtgcttagaggggcaaccagaagtggccgtaaaggaaatgcagaaaactggagcagtcaaggagacaaggacgacttctataatgaactcaacaccattagtgaagcaaggcacaagaacctagtcaagctagaaggttggtgctgccatataaatgcctggaatttgtgtgatttcttgtgttggtaccgccagaagcacaacatcacattcttccttgtctacgaattggtacgtaatggcaatctcgacgaccacctatatggaaagaagggcacactacagtggccaaagaggtactatacacacacacattaatataggattgatttattcatcaagtggcagattttttctattatgtgccaatcacatttacaacggtaattcgacataaaacaaattacaatcataaccattttcttctggaatacaacaaaagagtactctaacttgaaatttaaaatatacactatatataggctatgtgtcgtacaaatttaagtcactaacaaataaaaatatttaggtgactaacacatactccctctgtccatattatatgtcattttggcattttcatttatctagattcacaatttgaacacttatataaatctatgcattaatctattcaaaatgtagaacatcttataaaacgaaagagaggaagtagcaaaactgaagtatacaatctatatctttagggagcatttactagtctcagtcgtttaagttttattgccaatcaatcagttttgcaactaacatcgagcaacttacttctcttttttaagtcaaataaggaatattaattctagcttaaaataaaaggttacactttggtatggatcctaccaatataaaacaaacaaatataatctatatatgcataaaaatgcatgattttaaacaaatattgatcgagtttttcagcagtggtacgtaccatttttataatgtataaaataaaaaaaatgagagaaacaagaagttgcagtattaagtatatatactaaagatatcttaccttgcaagtctaacctattcattgtgcagtttttgttcactgaaaaatatataacaaaaaaaacagacaattgacaaatagccaaaccagaaaaagaaacatactagagtacattaagcacaaaaacacatctagcttaatccctaaaataaaccaaaccgaactaattaaaagctgcggtgtgctagctgttgtactaagttaaaacttttagctggtaaataagtaaaaaaagaaaaggtgatacataactaagaaatgtgttattgacaaattgtctatgcatggaaggtttcagatagtgatagacattacttcagctctagtttacctctatcatgagtgccatacctgcatctcctgcatagagacatcaaaccaagtaacatactcctggacgaaggtttgaacgccaagcttgccgacttcgggctggcgaggatcacggaaaacgccaagggcaaactgctgatagtggccatggggtcaattgatcagtacatagctccagagtacaagatacacggcgagcttgaattaatatccagcaccgacgtctacagcttcggactcgtcctcctagagatcgcttgtaccaggaaagacagggagcagatctggaacgatatgtacatgaaccacgccggcgtggctgccgtcgccgatcccaacaagctgaagggcgagttcgacaagaggcagatggagcgtgtgatcatcctggggcactggtgctctatgaaagacccaataaagcggcctaccatgagtgatgctatggatgtcctgcagcagtacgactacaggaatctgccagatttcaactcgctcagatgagatctgatcagtgtcaagtcgaatgtggtcaggtgtgtctagagcaccctgcaggcaaccggtaatatatcccttaatcgctagcatcctcagccacgcattcacaagatagtcaactgtgtgaagatctcctggtgtttgatcgatcacttgtggttaacgcaacattattgttttactttttgtatatataggtacggatatggcgcatcatcggattgcaatattatttcagttttcatattgaattcgatttgtttttcagtttactggaggtaatatcattcattaatacttcctctatctacttttcataggcatatatattttcaaatctgaaaaatttatttttgataggcatatttcaatccaacaacctatcatcttaataactttctcggatttaatgcgtattaatgaatcctttgtttacaaggaatgactagtagcatgtttaaatagatgataagtagaattatttattcttggtctgtatatcaagaatgaaatatgactatcaaaaatagatagagagagtataattttgtgttcagttatgggttatctaaatcgttagtttgatttaacggtttttaagacatttcagaagttacttgttaaataattattattttacattgaaaatatatagtttctcgttacaaagcgtgatatttcgttaccgagatatcttttctttctcggaggattctttttttttgggtaatcagctgtgtcgaggacacccagcctgtacattatactagaatagaaaaaatgtccctgtgttgcaacgggtaagatgtttttgaatcagtatacgtgaaaattctttaaatcgggcgcccgtgcgtcccgcgcctcgccgaaaaatcgggcgccgcgcgccgcgcctctgtaacaccccaggtaaccacgtacctagagtgccacaccagaaaacactcaaaccactaacttccaaaattattagaaatttcggcagagtctctcctgtaaatacggacatccacgacaggcaattataagttaaactaataacaatatcattcccataatacgatccatccttataatctatggggaagaaactattagaaatctaaaagattattacaagaccaaaccaggatataatttaagtgtgattatggacctaagcaatatagtttgatagtgtgcaagtagatgtgtatataagggtgctacttcccgcccatgcatgccggtctcaatgcgtacctaaaactaaataaaacacaagagtgagtataaaaatactcagcaagtacaatatgaatctagaaaatacatatacacatcattgacaataaagcatgaacagaaggctttctttctttgataggaaacacatttccaaacaccaagtcaaagaagatagtagttcccatcctgggcaggcatgaattgaaatagtagtttccatcccggacaatagtgaatacatcctagcatttgccggcgaagccgagtaagcgtgatcacgttgaaatatattagaaataaatagatagagtaaacaatgcatgaatcacacaattagttcgtcatgcacttgcctccaataaagaattggtatcatgcatgatctgatggaccaccacctaatcacaaacaaaaccttagcaaacatattcaaacatgcgtataaaactatgaaaaaggtgaacctactgccccatcccatcaaaactcaataacaaggaacgccgcttggactatacacaggactgctgcttcaaacctttatatcttgaaatatgaaaaggctatgactgaaaatgtatacattttgaaaatctacagaacaatacatacaactttcgtgtcgaaagcatatttttattctgccatttaaatggtctaatttgcgcttgaaagcaggcttcagaatctgttcagaatttcagacagtccacactgaaacaaccataactggagttctactcagcccaatcagggtgtactttaccaatatggaaagctaagaaaaacctctacaactttgtctataggcggcctggctgattccactgtttaacccctccaaaaacagttcaatctactactatccagattatgacacaaaaacaacagtcatactaaaataattatatctcctaaaccatttgagatagaatcacaccctttggtcagaagatatatccaaacattatctacaacttcctagttatacacttttgcagaaaataacatttagagccccgaaacatcgaaacactgaagcactgcaaatctgcccacatgcagaactacaataaaccgaaccgcaactacccaaactccttctctagctttccctaaccacaaattaatgcactaaagccatgctagaacaactgatacaacaaggagataagcctcacctagggtttctttagagaacttgtgaggagacaataggggagactccggtctaacccctcctactcctctcctcctcctcgttccgttttctaattcgcttcttgatccaacctatgaaggtggagatctagggagagcaatttgctgtagatgggagagatgcgaacacaggaggaggggaggaagggcgctggccaggaaaaggggtggcggcactatgaggggaggtgagattcggttcccctctctctaggttttaggggagaactaatgggctgggtttatgggccttctcatgttggcccacttctaaagatatttttcttttatttatttctgttaacatctttattttaacaagtcaacccaaactaaaaaaacctaaatatcttttaatatatagggtattacagcctcatccttgggttcatcattattagctttatcacctttagccttgccatctttagatgtgcctgattccgaatcatcattgggaaccatctttagtttatacctttggatgaccgttcctgagcgagtttgcttgaatgaatgtaagcactgactcttcaagttgttcatcatctgctcatactctaacatctgttctggtgttagcttatccagtgttattggaatgatgttgtcagggccaatgtcagatggtggtttagaagtctgcttgttgtccaccatgatgaaaaatgtcacaactcgcatcccaccgagcgtgccaaaagcgtgttgatgcgaaaaacacacactgacctgggagatctgcttaactccaatacaagtcctaaatcttgctcttgggttcaaaggcgtgccagttgatttgatcctacaatcaacaagaaagaaacataaagaaaccgcggttaaatccataaacgatagccggtcggctaggagctgatgacatatcgtcaatcattaagccgattttattggcaatagatcggcgatgaggaataaagcaatataaagttatatttactcgatcggctgtagatatcaacgatatataatccttctcttggaatatatttaaattaagtgattgggatagatcgagcagcaagtcgagacagtataaatcacttatatttaaagatactttaagataacgattatacatacgtttatagcatagccgaacaaatagatctaacatgtatcggctaatactccgataccactctatattaagatattaaaacagacaaaatatattaaatagccagcctaatatactttaatgcaataagatcttaatataaagggcagatttagcatgtcaagcaagcatatagggtataaaatagctaaatcaggtaagatcggttgaaactccgatactatttctatcggtgatcagaaaacaaactagatattgcagttatgaatattatttaatagatcgaactcaatcatgcagcattaagtataagaataaatataagatctagacaagatgatgaaacctctaaaatatggtggatatgttatataatctagattaataacgaaatctaactcgatcggccactctccaatgatagatatcagccgattgcaggttagattgggaaactaataaggattataaaacatatatgataactcgatgatttacataaacaagattagagtgtcataaagatgaaagcactaatcccaagaacgcaagacgccataacaagtttaccttttgttgaagatcgaaatcgatgtagctcaacccaaaagcaagaactcgtcgaaataaaagtagaaaaagggtggtgatgcgccgaaagtattattgaactgttgttgtaaattacatggggtccagtcatatttatacccgagatacatgataggtccttgccggacacgactcttatctctaacaaactctaagatacaaacgaatctttatggcagattcttgccgaaacatatctctaaagaaattattcaaaatatcctaattaatagatacaattgcctatctgtgagcttatctctatcgcggtaatccttgtgtagtccgttgatcgatcccaaagacggttttacagccatctcaacgaaatcggctatatcggctgtatcggctatcttctgtccgacccatctcagccgatgcagtcctcagccgatgcccttgcagccgatgcgtactatattctttgtatacgattctccgccgtgtcacgtcccgtttttcgtgtcttctattttgctcgatttgaaaattaacgttcatgtttattcgcctaaaatagcttaatgaaaatttcataaatgaaaaagggtttaatttgactaaataatttaatt

SEQ ID NO: 41181 - DNA, 6763 bp, Oryza sativa
gttcccataggttgagacatcatgcccccctgctgctccactctgtgcaaccaggatgttgagttccgccaccacgtcgtcatcgtcgcagccgtcatcagtgaaccaacgctgctccttcgtcacccccttccaaaccaacttctgtcaccattaacaccacctgcaggcaaagaagtcatcgccgtccttggaacccaagccgctgctaccatgccgtcatcttgttgagaccacgtctacaggtgagctcttgatgttcatcctccattatttccttccatttttatcacccggtggtagcgctatgtgttgttgtttcgtccatcacgaaagcagcccctgtcaaccttcctcctttatatgtatttaacagagcccttgccttcttttcttttcattcacacatgtccaaaagctatcgtactgctgctttgcctcggccaccatgcccacagtgtgcatgtgcgtgcaccactgttaatctctctctttagatgacatatgaaccatagcagttggtacacaaaataactccaatcaacctgaaaacacgagagaatattcctttctatcttctattaattcaattttccattcttgctgccacctctctattgtgatcgtaaaggcggccgtcagtcatcaccgatctgtttgcgcaccatgatggtcgctgtcgcaatggaacccgagctgaaccacattgtcgccatcacgttcctatgaatgtcgctgcggtcggtaatctccaatgccctagcagcaccgctgctcttatcctccacttccatcgtcttcacctgcctccggcatggtctctcatcaagttgctattgtctgccggtgccaccgcctcactgttaaacgatccggtgttcctaccacttgtctgtttgtggtcatcacggttccattccaaaattactacaccgccatcactgttttcttcaccggagtagtccatgccagcaggagcacaatcggtgcatacaccatgctctgctctatcttctctcgtggcttgttcctggcgttgataacaacctcgagctcaagcaatagttgttgcataagcatcgcctccgttttcgcccttctatttccccggtgttgtctctacaatattcctcccctcctacgtccaacgttgtcatcctctaccatgaacccggtgtctcttcttcatcccagtgccggtgcccctttaatttttattcccacatgctgagatgccgtcgcattgtttctatgctcccattgctaccgaactactagtgaccatgtcgtcgtcatcatatcgtccactctggagggccaacacagctgctgtcctctcgctgccttaggtcggcaagcacgtcacaccgtcacctctatcattgtctcggagtctggcatggcatgttcgctatctcactcccatcaatcagtgaaccccatcctttagccacgaaaatgattctaataaaatccacaaatgccgaaaaatatttcttattttccattctcccaattcaatcttttgtcgatcatatcttcactaatcagcatcaccgctctctttcatgagcctgccatcatcttctcccggtatgctcttgcttctttcacctacttcaatccgaagttttgccatcaccatgccgttgacgtccacgctgcgaggcattatgtcacacacattctggtcaggccagcctcttaaaacccaaaatcaatccaagttgtctatccccacaaataaatctcagccatccacataatcattccacaactctcctccttataaacaattctccattgatcatcctactaacgagtggaccccacccgttagtccaccaaaaataattgttttgtctcataaattccagataatattttctaaatatttctctttctttattcacagttctctaataattgaaacttcgagaggtcacatctcttccatccaaactccaaatcgacccgttgtttttcctaaataattctaaaattgagctctacttcctgatttatttggttatttcatttgatgttatttttctattttttttcttttgtttgtttgttttctcctttttcgatcgtgtagatgttgttgccgaggaggttactgttgcaggtgaaggtttcgtctgaagatctcgtgggtaaaggcaagtgtacccttgaacatgttgatcccaattttaaaaattatcttattttaaattatatgcattgttttgttttacaaattatcgtgtgggtagttataacctacttgttaattatttcatgccttgaattattgttgattatccttgattatttgtcacctagactgtatgagagtcaaacatggggtattggctcagggtagtagatttgcttagccctgctcacacttttacaaagcaaaatataatattgactaatgatctacttatcactattttttttatataaactgtgtggctgtgtgctatcttcttggtggcatgtgttgcacggtgtagtaatgatctggtggaaaatgttttagaccggggtgatggtggatctgtgtgaacctaggaggtaagccatctgtgtgcgtgcttaccgatgacctgtgtggtcgattgagctgtgtgctccatttttgttgtgtgcttgaggtccttagtttagacaagtcgcccaggtcagttaaggactttacttcatgcgccattgatctgagccttaccgtgcaaccacatgtccttatgggaaggacctagctgagtacactgcttagctcttgcactggcggcccaggtggctagatgataggtttttggattgtaccatgggacctttcacctgtgtggtgaaaggaggaccgcccatgggggaagccggtgttagggcgaggtagaggaaacgctttgttactctttggtgtttagcggcactgaactgtatcttgtgggtaaagttgtacaacctctgcagagtgtcaatctattcgaatagtcgcgtcctcggttatggacatgctcggtgatttcacatgaggggtagatttgtgaaagttttacttttgggaaagagctgtgtgcaggataaattaatgaatatagctgtgtggtcctgtgtggacgcaatatcctttttgggttggttggttggttaaaaataccgtgattgcaaatgttgtttaaatgaaatttatatctatttattgtatttaaattcacaaatgcctttacgcaaatgaaccctagctttcctttgaagccttgtatcatatattacatattcccgtacacttgtgagtactttatgtactcacccttgttgtctcacaaaatttcagagaatgccagttgtttctaaagttctgttgctaaggatgtcgaataggttgcgtgccccagttgattgcctatggtgtgtcgttggtgcctctcgcttcttgtcccactgtttatctctgtttggccctgcgtggcaaagaaattgtaaaatctggtcataagaccaatgtaaaaattatatttgtttcctatttattaatataatcgtgatgtggttgtgatattatcttttgttactgtgtgtgctagcgttgatctgggactagcacattatacacagagggatcctagttggggtcccgacatgccgaatccacttcgattccaatgttgaacttggttcatggtttaccaaatttggtcattaacagaggtgtaccagtttacctaccagacacatctctctcacacgttaccatgtgctacatgccaccacgtcatttggacggaagtcataacaaacccatcgcttaagaccgccctaggtcaataagacaatctatgccctcgtgcatcttaaacccgtctaggacttcatttgcgccctggctaggaccttatatgtcccaatccgtgtcttatttgtttataattgtggtaaacgatgtattaagccttacccattagacatgtggttgtacggagtatactttgcaacagagtcctaaagactggtccttatgattgccaatgtgcaactaacaaaaccaaacacctcgagctaagttgaaaacaagtttgagaatattgaggtagagtccatcaggtccaggctaacaagcctctaatccatcattaatcaagattatagtgtcaatcctaaagtctatatcattacaaattaattactccttcgtttcatattataagtcattttgactttttaaagttaaacttttgaaagtttcaccaagtttacagaaaaataaagtaacatttatagcaccaatttagtttcgttacatctaacattgaacatatttttgttagtttctttgttctgtgttaaaaatattactatatttttttatagacttgatcaaatctaaagaaaattaacttagaaaaaagtcaaagtgacttataatatgaaatagaggaagtaaatgtttctaatagagcattgctgagtataatgtaagcaccccatacagagttcttactagttgtttttttacttaggattgtcaaacgtaattagataatatcaattaaatcagatcataacaaggaaatataggaaaggctaagtaaaatagttataacgtggtatatttaataaagcgaatacaataatttaaattaaaatatttttcacaaattagcattcaatatgattaaggagagcctgacttaccttgctcaacgaacggacttaggagactcatgcaatggactggacttgcacttcaggaacctccgaacgacagcaactgcatgaacgacaaaacaaggctatagctctgagaaaaaatggtaacagcacatcaaagcaacatacatgtattctttaagttacaacaaaattaagcaatttaaacaaggctatagctctgagatatggctatctgaagtttatatacagtttaattggatatttccgaattgtttaattattattataccattaaattatgtgtaatgcattagccctcgaggagagaaacgatcaaacgactggcatgtgagacccacaggtcaaacggtagttcaccatggaccggtttaccaagacggtccacgggaaagcagagtgagacccacgtataagttttggagaagagaccgacgagtggatcccacgggacaccatctaagcagccacatgtgtgaacacccagctacacaagggagggatgcgacaaccggcaccggcggcccagcagtgcaccgtatggcgaggaccataggagtgagggatcggagagcagaacctcaccacggacacaacgacagttgacgcagcgaggaggtgacaggcggcgaggtcatgaccacggcgagcgcgagcaacaatgacggcgatgttcagcttgacggaaaatccctgtacgggactttttctaataatttagaattcaaaattaataaatatgaagtcggatctatatatctaagactctcaccttcgtattccatcaacataattaaaaaattatattaataattataaagcttccataattccatatataactaacatatttataagagtactgctacacgtactaaaatttttttacaaaacttttactaacaaatttctcaaccgtttaatttaactagatggaagttgcaagaaatctagatttactcacagcttgacacatcagagtttgtaaacattttgtaagaaaaaattagtacgtatagacttttcctatttagaatataatcataattttaatatttattgtatctggtaataatagcacgtaataatagctctcaccttcgtattccatcatcataattaaaaaattgtattaataattataaagcttccataattccatatataactaacatatttagaatataatcataattttaatatttattgtatctggtaataatagcacgtgcaacgcacaggttagtgactagttttattaattctataagcctactctcactctttaaaattataacaaaatttggtaaggctttaaaccaaacacgtctaccaaaatttcataaggccaaaatttagtaaaatttagcattggtagggttgaaagtagctgcaaagtaaacaagcccgtatagtaaaaattctgatatttgacattgcccaacatatgtagtaactatatacatatataaatctgtacagtattataatacaagattatgatcactcacaactgcatgcagggggcaccacaaataagagaagacggagcagtgcctttcttcttcgaacatgtacaggaaattcactaggaacatcagtgatcacagttaaaacaccattcctctaataatcatcacatcagcattcgcagttagacgagctgctcccgaagcagctgttcttgggcgtcatcttcctgacgctgtcctgcaggaactggagcgtgctgggcgagatgtaggaggtcctgtccatggtgttcaccttcggcgcctcgagtatggttcttggaggagacaatgcatactgcattgcccagattgcaaggggccgcatgtatatcagcgacctgtagtggccgtcgatcgtccatgcttcaggggtttggaaccagtacctggttatgtcgaaaattcgtggttagcagaagcggagtaaataattgcatctttttttaaaaaaaaagtagagtggggattagagggatatattaaaggttatggctcgttttcttttacatatgccaccagtatatcattttcatggaaatagaaatcgataaatttacgatgga

SEQ ID NO: 41182 - DNA, 1870 bp, Oryza sativa
ccttttaccctcatcacattatagtcaaatattttctgaagggtgcattttatcctaccctcatcaaacagaggcggcaaacctgacgatgcagtataccattgtccagccagttgatccgcatggatggagcgactgttgtaacttgttccgctgtcataattaaaatatgaaccattccataactttgcttcaaatacgggcttagcttttgcaaacttcaacatgcacctctcagcataatcatggtgtccaagggtgcgggccagcgctgctgcagtttgaagggcagcaagccaaaggcaaccacagtaggcacttactccacgaactgtccaagcatcatatgtttgatcaggaaagccatcattctcaatcataccatcatcgtcatggtcaaactgttccatgtactccatagcagtacaaaccgcaggccagacatccttgccaaatgacatgtcacctgttgccgcgaaatctctgtaaacctgtagcacgaacttgggattgagatctttccatctacttgtgtcatgtatgttgtacgcattcaattcatgccaaggatcatgggccccaaggtcatgggcaacagcaccgattactttgcgagtgccccaagtaccatcagcaagaaacctgactctacttttatcttcgcgcagaacagctgtagcaaaatcacgttgaatgctcagctcaatcttaggaaacagttccagaagagcaaaagaggcatagaagtgtacatcataagtgcaccacatgaagtactctattccttccaggtataaaaacttccctacattttccctgtcatcaattatatgtgggctaaaaccaatgagtggaactgcagaattgcgactgctatgatgaagtggcaaatcattgtcctcagatagccttgagttcatcatttcatcagcatcagccatcaaagatgcactatctgtgagtaaaaagatacatatgccaaaaaactaacatcattacataagtaattaagatgctatataacgtacgcatacagaaaactattctaagtaccatcaccttcccaagtgaagatataatgggacaaaaagaaattcatgtgctagacaaagaactgtattaacgttttccccaactgagcaagcttttagaaacgatttccttcttgttccagagtaacttgcatgaagcaactatcttgctacataaaacaatgagagctagttcatgaggaactatgcaatgtctttgtttgttccaaaacagctgcacattgcaatagtactatatttgtatggaccaataaatagaaataatcgtgttgtacttcattgcaaattttgtatgaatatagatccacacattgacaattgaactttttatcctttatactattctctctccagatgggaaaattgaaaattgaaagcagggagaaacaaaaaaacaaaatgttaggatggtttgctgttgacactcgcagttgggatgcagataaggacatttccgtaagaaaccattgacataaacaacttgctttctatctccaaaaaaaaaatgaaaaactgaatagtaattctattccattggtttttatgttcaaatccctcgagtttactatgtggcttgcaaaaataatttgcctaagagaagggaaaatgaaaacagtactagtaggaagcctatgcaagacatacatacctatccaaacagttcctccagcaactaggaagtacagctcattgaagagagtaaccttgtacctgcaagaatttaagcaccagaaagcacaaggatattatcttttgtgtagactaaagaaaactagaacttaacacaaagctctataacttaacacaaggataatact

SEQ ID NO: 41183 - DNA, 18667 bp, Oryza sativa
  unsure (1)..(18667): unsure at all n locations
ctcaatatttgcaaagatgtgtatataatgtataatagaagtttatggaaaacatactcatcaaagaatcttgcaccaagtttatagctgaccttggagaagttccataaaattttgtatacctcctgccagcagggaatgaaatagaattttatttaactagtggaccttgtaaaaaaacagatattttcgatatagaaatataaatgcacatcatttggaccagcttagaagaccaaaaaaaaaaaaaagataacatatggaatattctgtaaaattaaataaattcagggagcaattcaagaagaatgccgtgtggcttggtgggtgatgcgcagatctcctgcatgttcaagataaaatgcatatagatatacaaaatagttaaggccatgcaatagtatacatggagggttgtgcaatatgagttcaatgttttatatgcattcattaataaatcaaacactgttacttatattcgtagccatccttgtttgaattaacatgattatcaccataaataagaaattaagattgcataagttacctgtagtatgcatttcccttcttaaatttgaccttaggggatgaccaagccagggaaaatacgactgtacatcttccatgtggttcaacccaggtggatgcacaaactgctgcacaaactgtatcacccagcgaagaaggcatgctagggccggcactgaaattatctcggtcgaagcaaccatcctttaaacatttagatggtatgatagacagtctcagtcattgtttcattgatatgacagtgtcagtcgtcaataagagaaactagtgtaacaaaagatttgccctattcagagtagaaatgtgaaataaaatatatcaaggggataatcacctggctcaatgtgccccacatttccctagctgtaacagaactttctccagaaagcccaaaagcaggcaacacagtgacatttacattttggttctcacatgctgcaacagcaaaagttacaggaggattattgttggcagtcctgcaatggtaggaatacctaatcaggaatagaaatgatattgctcatcttattagatcgcatacaaaaacatagtgcatatctacacataatttcttgcttccagtacaaacatagcacagacattatggtattgtttcaaattgtatcagagtgaaccagtagaggaatagtattgcaaacaatgacaaactactagctcttaatctctgtggcacttatcagtgccaaaggagatctgacaaacaaccatagcaagaagagtgatcagcagacaatgacttgcttgtgatgcagaagcacgccagaaactccattttctcctctgcatgttaacagcacattaataatttcactttattgcagacaagatattgattaagttttaatgctttagttaagttctacaaagtactaacataaatggctcatttacatgaccgccggaatgatgggaaagccctccaatagaattctggggtagattcaagaatggaatgtaattagatgcaactaacagaaaacccaaattaaatttgcacattaaagtaaaaaagtagttactaccgcccaggtcattacgaggctgacttttgccctttctttaccagtgttcactatctgcaatttcatatgaataaaaaaataatatcaatgaaggaactggcgatagtggcattttgtttgtcagtagtctgcacgtgatttgtgtgtatctttgtaatttaattatatcactcacaattgtgggttatgataattctctatggtttattgagcaaatgaaaaatgtcaatgcaactatccattttagttttctgggtttagaacttgcgatacatgaatgtagctttgtttattctgaccagttgcaatgtatgtgctctaaactagtgcgagcaaaatattaaatacttaatcagctaaacagaataaagtgtcaaacatactagcaatgaacactaaaaaagcaactttcaggtttaacatactcagtatcctgttcttgaaagcacattcctataagcaatgaatacttacagtgtaaacaaaaacagaggtaggaagactgctctcttgatagttatggggaataaaaggagatatttgccggcaagatactttcaattcaggatcaggttcacctttaaacaaaccgaagaagttgtcagtaatatcctcatgcttgcgatattatggacaatgtgcctaattttttttttacggaaatgtgcctaattattatacagaaaagcagttagcttgttaaaaaaggctccactgctatgtacacttatccatgggtaattagtacttaatagcacttgaagtcataaagctaactaaagcaatgtttgtaattatcaagttcatcttataacgtagggttatttctataacaaggaatgagtaggtaccatcatagacagtccatgctcgaggaaacaacgcatggtatgtagaacgatcacctcttagtttccaatcccaggatgatataccatcatcattagatttcctggaccaagaaacataaaaataaccggacaattgtttcatatggactatgattgctatatattttacataaaagcatagatgagaatattcaggtagatccatttagacaacgtccagatgaagtttcatactaaatatactatattgaggatcagggagagagtcatactttaaactatcatgctgaccaggagctaaaacagaggagtattttttgtttcctcctcgagttataaagatctgcagtaattaaagatatggtgaaaaaattgtgaatgttctcttcagttaatctttgtatttcacagcaacatcatgtttgatacactatcaagagaatatcagaatagtcaatactgaatgattgaatataattccagtgatatgttaagtggcttacaacataagggagctgctgaatatgataaataagtatttgatgaatggcaacacataacgcaacatccaaagttctgaagaactgctacctagctctcaattgaaaatattttttttattaattataatataagtgtgtattttaattcaaaaatggtgggtgcctctctaatatgtcatgaaatgtttgttcagttgttcctaattgattttcatagaacaaactcaccatttacttgacaggtaacattaaatgtgtgcataaaacgtaaaagaagtaaaatgctgatagtgtatcataacaaaaatatttaatagttcaatcaaacaataaagtgtcctgatacggatttccctcgtttcatattgaacacattgctttaagattcgttaagttttctaaagtagtacactgaagcatagccatcaaactagaagtatgctgccaagaatatgtcaagttcagcggagtgaaattgtctcacgagttaccgaaaattggtttgccatgactggtgacatttcacatgaacctgggattatctgccaatgtttaaattctcctctgaaccctcttgaaatgctaccgctcctgctcaaatggtccaaattaaatgatcttgacaatagaaaaaatcgaaggattgacagcaaagcaatcatcacttagtacacaccccatcccaccaagaggtacaccttgcgaggctgaaggtttgtcgctctccctcgtgaatggatcaattggtgctttctgacaattattaagtttcaagttagaagtgccataaaaaagaagtacaaagtaaaggcgcaggatttaacttatacagtatagttggtggtatgacacagaatcaacatattacccttccatgagaagcttcttcccgaatatatgaccagaggcgcagaccaagtttcatctaatagccacgaggagacacaactcaatcatgttgacatacataaccagataatcttaagatttcagcagaatgaagagcaatcacagccagaatttccatgaactgggaatgctgataattgcatttcctgtaccatcttaattgcttctctaaaggtaacattgaactccttcaatctattggcatgactacttagttttcttctccaagcatattctggtggtgagccatcatcaaagtccagctgcagtattccaaaaggaaatcacaaaatgaagtcagtcatgaaagaagccaaacaaaacaatatgatcttacaaatccatgtcatattgtgttattcttggcatacattttaccagaactagtcagttttccactgtaaaagagtaaagatataactgatgaatagagtgcaactttgggtactacaatcgtcagccaaataagcacttcacatgcatcgaaaattgaaaatgaaaagggacagagaccctatatcataatcagcaaggtaacagacttgacacagcaataaaacaggtaaactaactatacaatttacacttgttagcgaaacctctctaagttagagaatgcagtaacaagtaacaacataatatcacaatcttgttactttcacaatatgaactaaacaatctttatagccgattttcatattacaaggaaagaaaaacatcactgctaatgagagcatttgagggggaaaaaaaggaaggggtaaagccctcaccaattgcagggtgctcctgctcacgagatcaccggcacgccatgagcgcttcctccggtagaacatgttgctgctcaccattgctctcccgtcgccaaaagcccaagattatcgcagagaaggaaagaaaaaaacaatttttcacaaaatctcaaactgccccagttggataaagtcctgagagaaccgaacagtcctgaaataacggaagtcgcaggaatgaaacccacaaatacacgacatggggacgaattttgaacgggacgcaaccaagaattcgagcagattaaagcgatagtagctgaacttctaccaaagtaccagccaaaaaaagaacctttaaaatcgctcacaaatgtacccagcagaagaaaatccaggaaaattcaaatcaaattatggacctgagctcgaatcaaattaggcaagaacaagttactccctctcttcataaaaattaaattagggaaaggagcggattcagggaatctcctactggaagaaatcgggaagaacccacgagctgtacccacgggaatggacggttggttcgaggggaagctacgagaaagctcgaatctattttcccctcgcggcgaggaagaagggggaacaagtaagaaatctttgacggctttattaatcctgccgtcgctttcgctgttcctcatcttctcatcttctctcctcatggcgcggctttattagcagttaagctagtgagcgaggcgtataattaaatgcaagtaattaattaactgcaggattagtgaggcaggcagcagtgccgccacatcagccgggcaggtgtcccggcgaccaaatcaacaaagcgaaagccatcatattttgctgagctccccggagggtgtgcactgtgcaggcatttggaggtggctgggcaagttaaaaggggagttttttttcacctcgccggcggcgacgtggcggtgagaggcgccaccggtatctcgcgcgaggatgtcaggatggtaaggtagcagcagcagcatcaccctgcgtggtctaacggcagattattttatcgcggaagaaagataaattctgtgagtaaacttgcagcccatttggttagacggagtttttggtagggattgggagtttagagggatgaggctattgagtgttttgtttggttaggagacataggaattttggtgggatggggatgggaattgagaaaggaactccctccttttcaatgggcctgttcggctgccattcttgctgcagcgctgagcgcttggttgcgcggctgcagcggtgcttcttgtgttagtgatatgccctagaggcaattatagagatgattgtatcacacactatgtttacatatttatccgactttgttcattgaaatagataaactcattattggttaatgaatatgtgattctttcacgagactctttatgttgtgtgttgctatttctaaaggatccctgatcaaatattatatgtggaacaaatatatttagatgatcagcacatgtattaatcgatgatcatgtctcatggatcatggtatagagataccaaattaataatgtggacatatgttgatgaacatgttgttggatagaccgaacatgagacactgcaagagccatatgtgttgtgtcatcagtgatctcatttagtgttggtgttgaatccttagacctgagattatcatagttcccaacatatgtagtagcttacttagggactgctaaacgctactccgtaattgggtagttataaaagtagttttcgggtatgctatgacacatgtagtgggatatgaataatcaagatgggattttgcccctcctatgaagagatatctctgggcccctcgatgttgtagattaaggaagtgcattgtcacgtcctgaagtttccccctttttcttgctttaaaaaaattggttaaataaattgcccgaagaaattgtttttttaacctagagctaatcctcaattaataaatgcatttaataatcaaattcggcgtggtggattttttcttgagttccccatgcttcaatacattaacaatatttttagtggaattttcagagccttggaaataattttaaccaattaaaaatgagcaagtgcaatattttaaatcccatgaaaatctatttccttttttccctcctttttctttgttgggccgtcggcccatctctctcccgcgcccctccctcttgctgggccggcccaacacccccctctctctgggacgccgacaggtgggccccacctgtcaggatgtccctaacctccggccagccgcgcccaagccggcaaccgccgctgccgccccacctcctccgctcctcccacgcccacgccgcgccgctcccgcgtcctccccacatcgccgccctctcccccgcgtctcccgccccgcccgcgcgcacgaaatgggccggattcattttgaatcccaccccactctctgtctctccacccccacgtcgccgacgaaatcgggggctatcccggccacgtccgcccctcccgtgcctataaaatccctcccccgagtcccctctccctttttccgcgctcgccgctagcgcccgtgccgctcgccgctagcgccgccgcctaccgccgcctccggcagcacgccgtcgccgcgccaagccaccgccgccgccgccgctagcttcaccgtcgcgtgggtcatctcggccaccgcctcgcgtcgccagaaccccaccggaaccccatttccctcgcaagctggtgagctatccattcctctccgcccccagccgtcaatggtggccgccgtggtcgtcctctccacccctaatccctctcctcctttcctataggtgtcgccgccgcccgcccacccctcctcgtcgccgggtcaccgccgcctttcattctccgctccggtcgccgtgctcgccggtgaggctcccctctcctccctttttctctcctctcccgcgtgcgccgccgctacatcgctatggccggccggccggttttgtgccgagccgagccgtgcctagccgccaccttcgccgtccgatcggcctcgggccgatctagaccgtcggtcccgtgggccggcgatggaccactcgtgtggtcccggtccacggtagaccggccgcctcgtgccgctgacatgcggggcccgcttgccggcgccgccacctcccttgatgacgtcggccctggtgatattgcgaaataaatcgaataaggacttttctttattagtaaaaacacagattatcttctaaaattcataagtaattcattcgagctccgtttaagtccattcaagtctcagtaaattcataaaaatccctagaatccattaaaaatggttttgcttcctgtttcagtagtcttatagcatgttttgcttatgtgctttgtttgtcgcgtagatttcagccgttttgtcgatccgcggtttctcgaagacgttgttgaggtctcatcagtgcgagagcaaggcaagtgtggacccccgtttttataacaggaatcaatcgtgtaaacagtaccatttacctggatcaagtagtctggtacacacgaattcatagctgaaataccaagtgcacatacacgagtatctaatacgaattattacatcataagcccgcagacatagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccatcacagcaatgatgcacatgacagaggaattcaaaggatggctatggttctttcgcgcaaagcaagttttgtaattcttttcacaagcctaagacctagcatagactgatcaagtttttaataccagtgttcatattaaacaatgacggttctgtccaccatccattgtgatcccagggatagcttcccgtcattgagtcgttatggttttctgaggacgtccacattcccgcctctcaggaagtggctccatcagcataaaaatcatcatgcaatatctcatcccacacaagttaaagaatttagagtctagccaagtgtaatacatgtcccggtgctcaataactgcgagcacggctattcgaatagatttggtttactcacactgcagtggatgtacactttacccgcactccgcgactgcccaacacatgagcctcgtcgcaacacatgagacgcgtcacggcaaagcttttcgataacctcgcattggcagtacccgctccatgaacttaaatcctcatgcactctagacgtccatgtttctagcagtgagaggagttctggcgctcccgggaaagagaggtctcacacacattaaattatggttcaagttaagttctctctctcacacactcatggcagtcctaccaatggcgacaccgatgtagggcacgcttctcggccctacctcaacggctgtcccatcgtagcgcaactgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatgaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcgggctctatagttacgtgcaaaaattgatttgaattcggttagaattcaaataaaaatccaaataaatccaaatgaaagtcgaatgcgaaagtcgattcctttttattaattttactatctgcgaactacggcaaacccaatttcgatttaaactattttgcgggtataattatttcgttgtcataagtttttaatttactctccccgagcattgtatataataggttagaaatttctattacgagctaaatatcggacgaaatcctagaaatattatacaatttaatttagcctatggctaaacgattaaatataatacacggctaagattcctagtaattaaatccgaatttcaaccgtgaaccgatgacttatagagattaccaaaaataatctataataatctataagaattcatctaattgtttagctactaattatatctaaattacttacaattttactctaatctgctcaagatacacatttttataattaactcggaatttcgaccgaaatactattacgctcgaggaatttccaaaaataacctatgatcaaccccgaccatttttatttcctaaatcctcctaatttctcccccaatttcccttctattttctccttttcttcttttctatattccctctttttctctcctctttttttttctttttctctcttttctctccctctctttctttttctctcctttttctctcctttttctcttctctgccggcctctcttttctttttctttttcttttttttccttctctccctctctttctttttctttttttttcttctttctctccctctcggtttctctcctccttccttctcctttccctccctcggtttctctctctctcggctctttgcttccccgggcggcgacggcggtgggcgcgaggtgaaggggggagacggcttaccggcgacggcggtggcggcgacgacggcgacggcggcgcaaggtggcgacgcacggcgcggcggccccggggcgacggcgcggcggcttcgaaggtggcggtgcggcggcacgacaacggcggcgcggcggcgcgacgacggcggcgtgtggagaaggggaagagggagaagaggagggaatggagtggggtggagaagggggattgggccggggtctttataggggagaggggaagaaataaggggaagaggggagaggggagacgcgacggcggcgcggggcgcgaggtgcatggcgacgcgacagcgacggcgacgcgcgtgcgatggcgacggcgcgcggcgatgcgacggcgatggcaacgacgcgcggcgcggcaggcggcagcggcgcggcacggggcgcgaggcgcgggctcgcggcgcgaggcgacgagacagcgcgcggcgcggcagcggcgatgggatgcgcgcggcgatgggacgtcgatggcgacggcgacagcggtggcgcgcggctcggggcgggatgcgatgggcggcgacacgacggcacggtgtgacctcaacgatgggacggcgcggcgcgggctcgcggcgtggcagcggcagcggcacggctcgaggcggcgatggaacgcgcacgcggcgacgggatggcgatggcgacggcgcggcagtggtggcacgcggcgcgaggcggtgatgggatgcacgtgcggcgcggggcgggacgcgacggcgacggcgcggccgcggcgatgagatggcgatggcgacggtggcgcggcgccaggcgacgagggcgacggcgcgcggcggctggcgacgagagagaggggaaagaggaggagctgggttaggggaccgcgtcgaacaccttaggtgcaatgaacagtgccgttttctaattaacccgattttagtgtattttccatataaatttgattccacaattcctaattttgcatatatgcattttactcaatatttgtgttatcttaactaatgaattcacccctagattaatattactcatattttatttttatataatttgtttgagttttaattagggttaattcttattccatcgtatttaaatttaattgatccaaatatggtcgcgataatattttatttatttctgtccccacctaatctttattttaatttgtatgtattttaccaattttgtttttacggtttattcctaattaactattctttacttacgattaataattttcgagatcaaatccagataaaatagacgaataagatcggcatgatgcaattaatttaaaaagtttttgaaaatccgtatttttagagttttgattttgtcggtcgaattttcagggtgttacagcaagtcatgcattacaattggtcatattgtacccaatttacaaatatcccgcatttctattaaatgttgcattcttttacaatgttatgtgggatgggtcctattactcagccatttattgtttaccttgtgccattgataatttgggtttcaaaatgactagatgttggtttaggaaaatgcttagccatgcctagttcaactagtacacaaatggggatcacattattacatagactttgactattagcatagctttggattggtgccaccgcaatggtgttagtttattaaaatacactgaatggtgggctatgggtgcatggttttgctagtcgcacccatggcaattaaggaccggttcacgggaaaccctgggagacttaccgtgcttaccacaagcgggagtgggtaactgcttgatctgaagtatagcttgaccctttccaaggcaccggtggcgagggtgggcgtgatggagttgggtcgtgtaacgacccgcctctcccaggccgggcccacttacatctggcagctttcataggtcatagactgccctcacagaccaacacatgtcttttctgcacactttgtcctcactcgtgtgcacccgggaagaatttcccggtcggtcacccatcccaaattgctccaggccaagcacacttaacactagagttctttggagattggcatccggaaaagaagttgcaacttgttgatatgagtattctattaatcttattaagccgtaggccgggatgttacatcgtttgtcacgtcccaaaacgaccttaaaatatatcctttaaattatgcctagaataattaaaatccgtgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaatttaaaatgattttataaaaagaaaaaccttaaaattcccccctccccctcttgggccggctcggtccatctccctccccctctctctcctcaccccgcggcccacttggtccctccccgcgcgcgcgccgctgacaggtgggcccgccctccaccctcgctgacgggtggggcccacccgtcatccccgacctcccgccgctccgcccgcaccaagcgccgccgccgccgccgaatccgccgcatcccgtcgtccccgcgtgcaatcaataggggggaattattccccgtgattccctctccctttccccccaattttccctccctctctcccttggattcgtttagaaaccctcccctaatcccgccggcgccattgatggagcctgagaacgccgcgccggtttccttcccctccggccgccctctcccccttccaaccctatttaaaccctccccgcacctcctccgtccgtttccgcctctcgctgcccttcctcctcgccggattcgagctcgcgacgtcgctctctctctccgccgtcgccgccgagctccggtccgccgccgttgtcgccccggaccacctcccacctcggtgccgcctccttcggcttcgccgcatcctcgccgacctcgtccacctctccatttcggtcgccaaccgccggaacgccgccgaccccgtcgacccgagccgcgctgccgccttcctccgctccagccgcctcctccgtcgccgccgtcgcctcggggtgagccgtggaccgccgcttcgtttccccctctccctcccctctctcgtccgccgctccgccgtacctatggtcgccgccggcgaccataggggcgcaggcgccgcctcccgccggccgtgccggcctggtcgccctcgggcgcgccgagtggctgccgcgtggggcccggccgtcagccgcccgcgccctcgggtgcggctgacgtgtggggcccatggcgccggctggtgcgagcccgggtgcacctggtccaccgtggaccgtgaggctgccgcatgggccccactcccatggacccggtccgcgcgcccctccccctcggctgacgcaataaacccttttaaaattagaatttaaatgaagaaattcacaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgccgcagcttcggaagatccgctcttcgtggaggttgaagccgacgtttgggaaagcgagcaaggcaagtcacatcatccttgaacatattgaatcccattttataaaattgttttgatttaaattattgcattatcgctttatttaaattcccgcgttatcactgttttatttagccatgcctatttacctttgttatgaccttattagtattgctattgttattattaccttgttcaccctagaataaacaaaaccccaactagtggaccctctactcatggtaccactagtatgaatttaggtagatgcttcgctggttaattaggcaacattaggtggttttacaactctagactttgggaatattctcatcacctggacactatggaatggttggattattgtggaattggattcacacctccccctctattcaaaatcttcaaaatggttttaggctgggctcagggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgtgctgcggcccggtagtcgagatgtcatggcacagggctggtgtcctgctgctaggggctcagtcctacttacctgtcccggaggttccggccgtaggtggggttgggtcggtactcttgtctatggctaggatgggttggaaactatgtcacgtcttccgcccgtataccgtggtggtgtgtggcacgtggttacacgtgagaaagatgtgtcttttgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccatggtcgggttgccagttcggtctgaatcatcgtaggccttgggttaaggcaggttcgtttgggttcacggccttgattaaaaatattgtatagctctaggattgtatttacaatatagctttgagcaactaagtgtcttttaatgctgtttactgcaaaccctaacccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctatttcccgtttgtctttgtgtgtgctgggccttcgctgcccatgtaataaattaattatttatgcttccgcttgataaactctaaaatgtatcaacttttggtgtaccttgcctcctggaacaaggaataatacacgcacgtaaggaatgcccgttgggttatttccggtcgtgacaggtcggccggggtgtccggttgtccagctgccgcattcaccgcggcgcaagaggggaccgcccactgcccgttgggggtgggggtgaaaccttagcgtggtgtggatggttaggggagggttatgcggatgatcttgtcacgatttccccctttgcagtatcatggtgatacttcggggcatggcgacatgtgtggaatcgtgtcttgtgggtacagttgtacacctctggccagaataaaactatttgaatagccgtgcccacggttatgggcgatcaaccagattcaccgtgattagtctcaccctagtttagcttaatgaactggtgtagttcaggtggttggttgggcctgttgcaacgtggtgtagcgttggacagtgattggttaatattgattaatctactacaattgttttactgctttcaactactgcttctaaatgcctgctttatgcaaatgaacccttagcctcctttggatatatcctgcatcatacctcctcttccggtatgacttgttgagtacagtgggtagtactcagtcttgctctcttttcccccacaccagagttgaagttcttcccagttggagctaccttagaaaggttggtttcatcgctgccgtcaaggatgcctgtggagtggagtcgccccgctgctgaagtcaagcttccaagtttagttcgttttatctttttccgctgcatttgtaatcttttatatttttttgtaagacgtggatatgtatgtcaacaattgtcgtttgtgtaccctggctggtcctagacaggggtttaatgcacattcagcttagaaattctggttcgtgaatttctgggcgtgacaagttggtatcagagccaaccttgaccgtaggacaagccaactggaaccctaagagccttctgaaccccttttcatctgcatatgcctttttcacttggatttgtttcgggaaaatttggggttttgcctctttggtttgcgggaaaaatcttggtcgttcattcggattggatctttaaaattagctcagtctagggttttagtaaaattttatttggagtttattcgacagttagtcaggaatttatcgggtgatatgcattaggtcgtgtctatgtttgatggggcaattttatgcgcatcattttccatgcatctattttatgcattaagttattgtttagtcagttgcattagtgtctttatctgggttcatgaaaaatgttctatgcataaaaatcaccatgctcggttatttatttgagtcatttgttgctttgtttatttggatttgagcatgcattggttcctatcccttgtccatctttagttgtcagacctgttcctcgatcgcaagcgccgctccgagcttcagagtagccgcccttagctttatcgtcttcttagtctgtttgcttgctagtttccgtgttttaggtttgttgcttgtgggttagtcggcagtcgatatcatgtgtcagtggtatgactgccttaattaggagttatttgcttccttttcagtgttttattcaagattgagataattgcacttaaatttataagaaagattagtttctgagccccctgtttttcttccttttctcatatttctacctatcccccttcagatggtgaagacaaggaatggttcccgtgaatccaacaacgccagtggcagcgaagagcagatcaatggaccatgtgccagcgttctgacaacagtccgtctccaccgcccgagaacccaacgattgctcaggtgttagacaatcagattcagatgatgacaatgatgatgcaacagatgcagcaacagtaccatcaggtgttgcaggaggtgcagcagcaagcacaacagcagcagcagcagaacctgcagtttggtctttcacctccacaatccaaactattagagtttctccgtgtcaagccaccgactttctcaagcaccaccaacccaatcgaggccaacgattggctccatgcgattgagaagaagttgaatcttttgcaatgcaacgaccaggagaaggttgcttttgctacacaccagctgcaaggtcccgcttctgtttggtgggacaactacatggtgacccgtccagctgggacagaagctacttggtcagagttttgtcaaagttttaataaggcacaggttccctagggaattgtggaacaaaagaagagggagttccgttctttgcaacaaggaaccagaatagttatagagtatttgcatgagtttaaccgccttctgcgctacgttcctaaggacgtgcgcactaatgccgagaggcaagaaaagtttctgtctagtcttgatgatgaattgaccaaccaactgatctccaaggactatgaggactttgagaagctagtggacaaggctatctgtcaagaggagcagtgcaacaaaatgaaccgtaagaggaaggcagctcagcttaggacttcccaggggatcagtcagaagcctcgctacacgatgggacatcaaggtggaccttccaccatgattatccggcagcaccgtccttaccaccgggnnnnnnnnnnnnnnnnnnnnnnnnnnnnnnnnnnnnnnnnn

SEQ ID NO: 41184 - DNA, 721 bp, Oryza sativa
ggctcaaataattcgtctcgtggtttccaatcgagttatgaaattatttttccattcgtgtccgaaaaccccttccaacatccggttaaacgtccaatgtgacatcaaaaaattttcatttcaccaactaaacaggccataaggaaacacggaaagagtgattatgagtcattgttacgaagaatctagcattgccagtgattacgagtccttgtaattcttttccctcaggacatttaatccaattgtgtttattaattgagtgagatttggggtattcagtcgactggcaactcttcaacctcaaaatcatattcggtggaaaaaaaatatccaaccaaaccagaaatcccatttccaaaaccctcgtcgacgtcgcctcggggagcgccaacgccgacgccgtcgccgcggccgcgccaagagccaccgccccaactccggcgaagatggatgcgaaggtggacgagatgagcaaggcgtaccaggagctcgtcgcggcagcgcaggccatcctggaggcgcggcggcagccgggcggagagaacacggcggccatggacgcagcgcgcgaggcgttcgagcagcgccggaagctcttcgccgtcgcctgcgacgacgccgacgcgctcgtccagtcggctcgccagagtatcgtctccgaccccgggcgcttcgtcgacgtggtgaccacccccgacgaggattcggtgcgctctcc

SEQ ID NO: 41185 - DNA, 1477 bp, Oryza sativa
gccatgctgctttggttttcaatgataaaatagaaatgattggaatgtcgctgcaaatgttcagttgctggtgattgatatgggtatgttgtggtcgtagtagattcatgtcaatgagacttccaacgaaccatgccaaatgatcaattgaaattccgacaaaaaatattgtaattgtagtcaaagtgtctgctacattttccaattttcttttctttccccctttctccacacatcacatctggaggtgattagatctaaaagatattgctcttatatgaataaaagcttttaatgagaatgatcattttcatttccctatattttcctgacttccttttatctgtgtcctttcgtaatattcttaaaatcaatttcttacatgcttttcatttcaggatggagaagttccttgctcatctggctgcgtttgttacgagccccaggcctggaaaaagaataatatcagcttgaattttctccagaaagttgaaatcaacaatttgagtggagcagagcgtcaaatatattttgtcaaacgactgttgagatggacgatgccagagctcaagacgattactctaagttttgatcctttggttactgtcagcgagaaggtgtctaggaagctacttagcttctctaccccagggatttgcatggaaatttacttgcaccgcaatggaactagggtaaagtatagtgcagcgaactagacctagaggtgattaactgacgatgaaatggagcacagtaatcactgaaaccaggcaaattcgggccttcctttcagatcaactagggttaaggatgtccgtctgtcatgatacaggattgtcgtatacttggttatggttgattgcacgactcacaacttgcgccttaatgtgtgtttacatgctctgaggaaagttttcatcctgctggtgaaaattgtctgatcgaaagtttgttccatttaaatgtgaatgctgcctgaccgaaaggttcaaatatctagtttccaatctctaattttctctcatagcaaggtaagtattgcttgtgctgtatctgtgttttctttgcagaagcatatgacttgttcattctgctccaggcactagctagttcactgttcaatactgctgtcggaggattatatcagttatcatagtgtgaagagctcgtccacctgggttttgaacacagtcgatgtctgattgttccaactccatatatgcatacaccatcaatatagcatactgtcatatcgatgtgtttgtgtttgttatcagataacttccatgtactcatcatctatatgacactattatgtgtttcagtttgaagatagacgtgaatgatgtgatgacaagggccatcatctttgttttcacatcatgccgttgtcggcttgtggtttcagcctggtgacccgccttcaattctcctatacgctgaatttattgttaacttgttacagagttccttcttg

SEQ ID NO: 41186 - DNA, 1909 bp, Oryza sativa
aataaggtgtccgcgcatatgcgcgggcttcctttctagttatatactaaaagttcattaaacttcctataaacgctcctaaaccaccaagtggcaccctataaacactctcaagtaccaagtggcaccttaataaatgagagaaatctgaccatctatttttacttaaattggtggacctattattctggatggttagatctattttgtaaataaaaaaaaaaaggaaccaacaggcggaacaaacgggggagccctaatgggcgatcagtcgcgctccatgcgccccgcgcgatcagttctgacccctctagtctcttctctctactactagtgcggcgggacagcgtgtcgcttggagcgcccgcgttttccttttttttcggtttgtcttgaagcgtccgcgttttccgtttcttttttgtctttttcagtttcttttttttatggttttttctgtgtttttcttccgtaccttccgttctgtttttttctttccatatctttttctgtttttaatacttatgtatgcaaactttatatacgtacaaaatataaattttatatacatgtatttttaggtttttatatgtacgtataccaattttgtatacatgtatataaagtttgtatacacacatataaagtttgtatatgtgtattattttaggtttttatacctacgtataccaattttgtatacgcgtatataaagtttatatacacatttacaaaatttatatacatgtatttttttatatttttatacgtaggtacaaatacaaactttgtatacgcgtatacaaaccttgcatcccgtacgtacacatatataaactttgtatacatgtatgcaaagtttgtatacgtgtatacaaagtttgcatacgcttatacaaactttgtatatgtacatattaaaaaccgagagaaaaaacacaaataaaaatgaaaatacaaaacttattatacgtacgaaatataaactgtgcatgcgtacactttaatagaaccgaataaaagaagagaaaggaaaagaaaaaaaatccaaacagaaagataaccggaaaaaaaaagaaaagaaaccgaacaaaaccgaaaaaaaccaaaagagaacgaaaaaagggaagagaaacggaaaaaaaaaaatcccgcgtgggtgccgtccgctgccccctccgcgcgcgacacgtgtccagtcgcgcgggggagggcgcgcgtgactggtcgcccattagctttttcggaacaaacatacgagcgtacgtatgtactgtgtctgtacgtacttcctttatgttgttactttgctattttctatttgatgagaaactaaaattaaaattacttttacaggaaaaaaaatcacaaaagacatactattagatctagcagttctccctcctaggtctagcagttctccctccgtcgctttaaagattctacgaaggcttctaaatcactacatgatgctattaaattagtgaaagtactaaaaatcttaaaaaatataaagaaattgatcattggtttgtacttaaattaatggattagattttttaatagaaaaatcccaaacctctctccctccttgattttttttaaaaaagactattatatattaaaagttcattaaacatcctacacatactactaagccgctaagtggcaccatacaaacgctcctaggtttctaagtggcactctaatccgaccatcgaattttatttaaatcggtggatccattattttattttagaaggttagatttttttttaaaaaaaagcacacatccgaaacctccccatcacgtacgtatcaacgagctatattcatgaggaattaaaatcaaaattatttttacattaaaaaaccatcattaaaaaatacctccacctattaggtctag

SEQ ID NO: 41187 - DNA, 8502 bp, Oryza sativa
catatatatatatatatacgtatatacatatatatatatatatatattttaacgatctatttaacaacacatatattttaagagaacaatatgcaataataaatagttttaattagaaaatagatatttaataagtacattactttgggtcactactattatgtttgtaaatatatagataacttaagttggtgaaaccattggatttatcagcttcaacgccacctccagaaatcgacctgagcgatcgatcattcaagaaatagattagacacaataatccttatattagtagttccaaatttgatttttggggttgggtagtgacagctcacgtcgatcagctgtgtcacgtcagaatttcagatatatgtgtagtggaatgtttctgtttaattattagtatttgtttttactgtgatgcgattttgtatctccaaattattttcacaggccacggcgatcacaatccgcttcgcctgccttactatctggctgcctcccttcggtgtcttcgcgaagctatctgtgctgtgcttgacgacagccaatgtgatcttggtgacatcgtctcttcggaaaactggagaaaaaaaaatcactatagcaacgcgttacaaaacttccctaggagtagctaaacatccagggaaagcgactacatatgcagccctctgatgacaaaactcccctagaagcaatcttcgaaatgtcatcttccacttaatgaaatgaagcacatgtctctttgcgttttcgaaaaaaaaatagttttgaatagaatcatgcatgaggaaaaaaagtaatgttatatgtaagtttagaaatgaggtgtgtgccaaacaaaatagcgactaaaatacaacaagtagcttttaatttcactaattcagaagcattacaacaataacaagtactccctccgtttcataatgtaagtcattttagtatttttcatattcatattgatgactatctacattcattaacatcaatatgaatatggaaaatgttagaatgacttacattgtgaaacggaggaagtatatctaaactcataacaaatgagtggaatgcatgagaaccaggagccaacttgcctagctcctcttacaaaaagctcatttttaaatcacagacatatttatacataaagaaaacatacatatgcaagcaaaatatgataagagctatttgatcttacctcctaatagaaaaatcagtagactagtactacatagcacgttttgaagactcacatttgactcgatcaaaagcgtggatataaattttcatcgtaaacatgcatacgcgcacgtgaggctttcatcggacggcttccgcaggtgtcgcgccataagacaaaatcaaaatcgctctcaacttagattttccgttaagaaaaagacatgtatcatataccaaggaaatcttatacacaaatcttatacacggaatagagtgatctccggactccggttagaactgcctcacggtaccagtacactatttagtaatattttttttaattggattcatgccattataaatttgtatgtttggaaaaatactattactatttacaaaattggaatcataccattacaatttaacatctcttcgagatgtgccattgcttacccattcaccatactttctaaatttttctgaccaaattatcctttaaggcccctttgaatcacaggaatgaaaaaacggaggaatagaaaaaatataggattgtaaaaacagaggattgcaaaacacaggaaaaacatgggaatgaccgtttgattgagccgcaggaaaaacacaagaatttgaggagagggaaagactcaaagaattcttatcatgaggtagaacctcatgttaaatttcctctaaaatttacatgggaaaacgcatttcataggaatttcataagattccataggattcattcctttgattcaaagggctatataaaaaaaattcctatagaaataaaatcctttaaaattcctatgaatttctttggaatcaaagggccttatcttcttcctccttcccgtttctctcttttctctcttcctccatcccgccgccgcgcacgatgcaaccgaagcaagcagctgtgcgtgcgccgaagctgctcgtcatccccggccaccgcgtgcgcggaatctatgcagctacgcgcctcctgccagagccgctcgtcgtccccggccgccgcgtgcgcctactatggtccttgcgtgtagttctcttctcgttccttttttcgtgcagcctgccctacacgcttaaaaggtggcacatgattataggctctgtgaaagaacacgaattactagtagtggtttgcaatcatgtttggtagtgcgcatttttgaatctgcctaattcagctctttagttttttttagataactaagtgaactaatttcttggagaaactgaaaagttggaagaaagaaggttgatccatggctcgtcgtccctggctgccgaagccgtgtagctgctcgtcttccccggccgccgcgtgcgccgaagccgtgcagctacccggctcctgccggagccactggtcctccctagcagccgaagccgtgcaatcgctcgtcgtcccctgccgctgcgtgcaccgaagctgtacgtgcagctgcgcgcctcccaccggtgctgctcatcgtccctggccgaaagatgaagagagaaaagggaacaaagaagggaataaaggaagaagatgagggcaatttggtcagaaaaatttagaaatatcagtgaaagggtaagcagtggtacatctcgaagacatgttaaattgtaaggaaaacgcttcgtatcgagtgtccgggagcgaataaaatattggacgaaaaacgtttggtgggacccgccattgactcaacccattcttcgtcacccacgtcaatcttatcctctcacagacattccctcatctctcccctctatctctatatgctctctctctcccctctctttcactacagcggagatggcgcgatgagctccatctcgtcgtcaacagcgacgagctccatctcgacggcgcgacgagttccagctcgtccttgacggcggcgacgagctccatctcatcctcgacggcgcgaagtgctccatcccgaagacgcgacgagctctatcttggttcctcgaggacatggccctcgacatagtcacatagatgctgaagaagaggttcctgccctggcgagccttgaccacctcgccgaggtggtcgccgttccaagcatgcggaggcgacgcgatagcgatggcaatggcgacggcgctagacatggccaccgtcgaggacctgatgcgaatgcaactggtcttagccaagtttgtccatctcgtgccgttgctcgtctaggggtggttggagttgaagaagaagacagatgtgggtttagcttatgttgcactttgttgtattaaggtgtttcattttattttgattcgaattcaatgttacatatgttgattcttcatgttgcaatcgatatgtttcgattgcatttggttgaaacactttcgtcaaagcgatgaaacatttttcttctcatttgatgaaacatctaaaaatgcgtgaaatttttttagtaatgtttgagctttttttttattttttgttgcactttattatattaaggtgtttcattccattttaatttgatgttgcttaaattgatttcatggtgtggcaatccgtattgttgaatatttcatttggttgaaacaattttgctcaagtgctgaaacatttttctctagcagcgaaacatctggaacattttcattgaaacaatttttactgagggatgaaacatgtgaaacatttctcaatagtacggtgcaacaccgtccgatgatttgcatcagatcggatgtccgatccttagcagcctctaaattgtaatgacatgtgtcagggttacggataaggtataccctctatccttggatgtacgttgactcggagattaactgacccgcggtatataagggacccctgggcaggacctaagacatcgaatatcaccgctaacacatccaccatagcctacggagtcggagcctgcaggagtcaagtcgccgggagatctagtcggaccaactcgactacggtctcgtcggtatcatcgagttttgctatacactttgtaatctgtggttttcatcatataatcctataccaactggattagagctattacataccaaggagcctgaactagtacaatgcttgtcttttgcttgcttaatgtcgtattacgtagatcctcgtaccaacggatcctaataccctctatatccggtctacgggtatccaccgtcgacaacatgcttccaattttataaataataatgacatttttctaaacatgtaaatttataatggcatgatccaatgaacatttttttttccgaattaaacagagagaggatggggaaaaaagacaattagggagtcacaccaaattggaaaaccgcattcctaaaaccctacccgacgaaattgcaatggcggacggcggcggcggggccggcgacctcctgagcgcgctccccgacgacgtcctccacctcatcctcctccgcctccgctccgccgccgccgcggcgcgcaccagcgtcctcgcccgccgctggcgcagcctctggaccaccctcccggagctacggttccccgccgtcaccgacctcgcccgcgtcaccgccgcgctcctctcccacgacgccccgctcctccaccgtctcgagctctgcagccacgaccccgccccgcacgaggtcgccgccgtcctccacttggccgcgcgcagcttagcaggcaagctcctcctcgacatcgtgatgaggaagaagagaaatccggtggcggcggcggcggccgggattggggccgcgtttcacatcccctgcttccggaaggccacggagatcagcatccgcttcgcctaccttaccatccggctgcctcccttcggtgtcttcgcgaagctgtccgtgctgcgcttgacccgcttccggcttgacgacagccagtgtgatcatctcggcgacatcgtctcctccgagcggtgcccgtcgctgcaagcgctcactctctgcaattctcaaggcttgtcaaatcagccatccgctccaagactctcctcaccgttggcctctttgagctggaagaactgcagcagctcacgatttctgctcccatgcttagaacactgcatctggtccattgcttagacaagagggcggtaagagccgctgacatctctgctgcggcgttggagaaacttgggtggattggtctgtgcgattggaactcggtccacttcaatgtgatacaacacctcaagagactcgacaccttgaacctttcggtgtatggaccgccgaatcttgtcgattcttgatacccgggctctatgtcactcctccagcatttcaaagcagtctcaaatgtcgacctctatctcatttatccatctgtgagtacaccttctctcttgttgctgaactacattatcgaaacgttgaacgaaatgtcgtaatactctctttgtagttccccagcagccactgctagtatgccggcataggcacacaacattttaaaagaggattttgaaattgttgatataacccatggtccagatatcatttgtccgagtccgtgttttagtatatgtttcacattagcatctaaataagtgtcctaatcaaacgtgaatatataagttgggaggacatgtatgcactctggtatgtgtatttgcacatgattggttagataatggagaaattgagggcattcctggatcaatttccctttaaaagtgttcccattggatttctcaagccatacatatggaactttctggatgttctttatctgaagctgtatatacctcgtacatttctcaatctcctcacctccttagtcctgtgcaatgtcaaaatacacatattaattaagggatggaatggtgtacttactacaataactatattaatgaatctacaacttctgaccattgatcaagatcttcagtttccatttggtcctgttttacacattgttatgtaagacattgtatgaatctctgttaatttgcagagcatggttgactgtgagttcttgatggaggacatgaatactctccctgccattgagatcttatctctgaggtcaataacagcaggccatgcctttggaccttgtgtattccaattgcttaggacgtctactggtgtaagagagttgcacctggacttggatcatcaccttaaggtaatgcatacttattcaatgtgattaaatactttggttgctgtcaaaagtgatagaagtatttcttcttttacgcactcagcttgttcctctaactgtacacagtggtacttgatgtgtcggtctcgatactgatatgcccctccatggtgtatctattacaactaatggtctttccatattcagagtttcagactatagtgcctttgattttcctgtcagatcaactccttgcatccgattgttacatatggcacatgggatgtgaaaaattgcaatggtgatgagtgcatctctctctcatccttgtacccaccaaagagagtagtgctgctttggatttctgtgatatatgattgaaatatagctgccgatgttacttacttactggtgattgatatggatttgttagccatatattcaggttggtgacttagaagcaaaccacgccatacgataaattgaaatcttaacagtaaatattgtaattgtggtcggtgtatctgtgtaatgttttttacttcttttttgtatttctccctttctctacatgtcacagtcacttctctggaggggatagatttaaatcatatgccactcaatattatgaaaccaatgttttcagggagaagtttcttgctcatctggctgcatctgttacaagccgtcggactgggagagtatggatatctgcttgaattttctccagaaagttgaaatcaacaatttgagtggagcagagtatgaaatatgttttgtgaagcgactgttgacatgggcgccagtgctcaagatgattacagtaatgtttggtccttcagtaactgtcagcgaggaggtgtgccaggagctgcttagcttctctaggaggtgtagtccagggatttgcatggaaatttacttgcacggcaacagagccaaggttatgtatagagcagtgaacctgaagagacctagagatgattaactgacaatgaaatggcgacctggagcctagtatattcagtcaaaggagcactgtaattgggcaattttcaagcccgcctctgagatcaatctgttgtaaggatgtttgtctctcgtgatatagggattaattatgtatttgagcatggttcaatgcactctcaacttgtttccgaaatcatttttgtgtgcaggttttcaatctgctgtgaaaaatgtccgaccgaaatttgtctgactgaaaggttctatattatatattacagttttcgatctctacttatctgccgtagaatggtaagtacagcttatgtggtaataatatctgtgtttcgtttcagaagcaagcatatggatttgttcattctgttcctccatgtacccacgtgtgacaggtctgtaggacggttggcgattgttcaatattgctgtcgcaattgggtcatcgtttgtgaacaccgttgacatcttgttgtcccaactccatctatgtactcatcaccgttgacatcaccatttgccgtaaccatttgctttatttcccactgggacgtgcttatgtgtttttttccttattatagcttctaatactccctccgtttcatattataagattttctagcatagattcattaacatctatataaatatgggcaatgctagaaagtcttataatatgaaatggagaaagttagttataatcatgtgttttttcttattatagcttccaatagttataatcttgtaatttttttctactattttaatatacaagctagcactgtcttatgtgttcgcttaaagaaaaatataggtgatatgccaatgaatgagaggtgcattttgcatgagttgagccaaactcggagtggcaacatgccgccaaccgaacaagccgttgccggttgatgacttgattctaatggtcttggttaactggctggatgttgacgtggccatatgagtttttttaaaaaaaatgtttgaatagttgcatcgtttgaggatacaaaaggaattaattaaatattataaagttaaaaattgatttaaaataattttcttataaattcatatatagacttttttttgcaaaaaaccagccgtaccgtttagagtaagaaagcatgcgcatttcttcgaacatcccatcataaaataacacaacctatgtgtgaatacgcaactctggaatataaatcacatcatatcttcct

SEQ ID NO: 41188 - DNA, 5169 bp, Oryza sativa
agcgtgctgctaggtacgcagccccttcgtctttcttcttccctgcgacccgccttttttcctttcagcatcgggtcagcaacgtacccccccccccacgccgcccctctcctccgaccttccccatgcgtcggcagccgcctgccctcgcctccgccagtcctgttgttgccgctccactcccctcctcatggtcggacgggttcgttccgtgtggcggtcgccggcgggggccatgatttggtggagttgagtcgattcggtggatttggggagtagtgtttcttcctcggtttagtctcttctttccctcacaagttgtggctgtttctttgggtttcttctcctatgggtttccttccgctgtgtttgctgactggaggaggagctgaggatgctcggcgggatctgcgcagcggtggtcggggatggcgaggaggagaagcagctctgtcctatctgcctcgacggcatggaggccgggcacgccgtgcggcgtgcgcgtcctccccggatgtagctgcgccttccatcacgactgcgtccaccggtggcacaccatctcgccgcgctgcctcgtctgcaacgggtgggttatgccgccgttgccaccgcccgcaagcctgctctggattcttgagatggcagcgttgccgccctaccgatcatggctcagttcttggttcttgacgagttcttgatgaattctcggcgattgtcatcgtcggtttctaggctctggacagcggttcttgccaatttcttgttggctatcttgttctcttaagtatgctgccttttagaacttgtgctttctggtcatggacttctataagatgattgatttgtatggacaggtgagttgttctataaatctgacatagtttcagtggatttggccaccgctgacgatagccaccgacagctcgggttctctctgctatcaatgcttcttatttggtatgaattctgaaagctcatttggcgtgttatctgcatgagagtttatgatgacatgtttttttgttcagaccagtgcttctgtttacagatttgttggtctacatattagtaaattcagatgagctgatgaatcagggaattcaggtaagatcatgacttccagcaatttggtactatacaacaaagttttgtcctattgtcctctttaatatgtatttcaataatgctgagtttattttctaatttgtcaaccatagcgagagatatcagtaaactgatttcgcaattgtttttgtcgaactgctgctgttaataagagttctggagtaatatatatttataggtacacaggatggttaagtaaatgtacttatttagattgctatgcctaacatccttagtttatttgatgatgctacatccttcttcaactttaaggtctgctatgcatctttgtattttgaaatcatgggccattgaaaatgtagcactagcaattactttgtctcttgtccagtaccttttctagatttctattctgtacttatttgggatgatttttttgttacttggaccaactagactctagagcgctgtgtgtgtcttttgatcaatgctgaacagtgcttataaaataagtgttgtaaacacagtgctgctttgatcatgtatttgagcctaacaatctctagatgcaccatgcaaaagtagttttttgttttgcccttatagctgttagacataagaatttccttactgttcgactaaaaagttctctttctacttcgataaaagaaaaacttgatgtgaccaggcaaacatgtcatcagtgcttcatataatagttgattctatgaatttttttttagtttcaggtataaaaacgacttggacttctatttcatggagtcatggttaggaataaggaatattctatgaatattccttattcccaaatttgaggactctagcatggacatcctaggagttcctacactggtgggtcgttctcaagaattcttcaagccgagttgtttctttctcttttttttcatctgatctttatctcacatggaaccatttatttccaggatattaactacgtcattcagatcccacagtaagctaattacgcccaacgatctaacacaattcctttctcagctaattatgcactcttttgtcaggaagagctgcattcctggttctgctgtaactgagggttgatctgcctgatgttgatgtgctgttcagctgttgctgttatgaagtgggaatctctattaccaaatgatacctttcttattgttgcctcctctgatggcgcatttgagaaaatgactatgcaggatgtctgtgatctgatgttgtacgtgaaacttggtgttaagcaagaattaggatcctttgcagtaacacaacagaatttggcggattatgtagttgacctttttttatagatagggacaacggacaatgtagcagctgtgattgttccattgggatctcattatagctctaaagttacactaaaagattggtacatatgcttgaagaaaatttcaggacatatatttcaccattacaaaccattccaaaggacatctatttcaccattacaaaccattccaaacaacggaagtcaggtaggtttaatgtacaaaaactcaaaaagttcttttttatcgcaatcaattggcaagttggcaatttgtagtcatgaccacttgggcaatttttacattatgttttgtttataagattgagcttttcattagttctgagaaataataaattactccaataatttgctattgtattacactatctatttatttcaatacatttttaaaattgaagcttattttgtttacatagtcatccgctacgtgtttagagtttgttttgattaagctgttaagcatacttgcgtgcgcagctgtgcgcggcgtggcgcccccttatacttctagtctaaatcaaaagttgaattgtttggggagcttaactctcccacacacacgaccatagttgtgagtggctcaattggatattctttcctagcgcgtccgtaagtccgttgatctcctcctaaatgcaaatgtgataaaaaaaataatttggcattgggaagtccaaacgtcaaatatccacaggccacaggggtgcatccttctaggcttccattccattccattctttaattccccccaattttatcccccacacactccactccactccactccactcttttcgctcgcgtcgcttcccaaaccctctctctcctcaaaaccctagcgtcgcccgcttcgcctgagctccggcgatggacggcggcgaccgcctcagcgcgctccccaacgacgtcctccacctcatcctcctccgcctccgctccgccgaggccgccgcgcgcaccagcgtcctggcccgccgctggcgccacgtctgggccaccctcccggagctccggttcaggatggacgtcagcctcgccgcccacgcggccccggccctccgccgcctcgaggtctccaccgacgcggacgacccggcggcgtcgacggccgcgctccggctcgccgcgccgcgcgtcgccggcgaactcagcttctgcatctggccgcggtgggacgacgcgccggaggaggatgacgggccggcgccggtgaggcgccccggcgtcgtcaagctcccctgcttcgagaaggccaccgagctctggctaatcctcggcctcctcggcgtctcgctgcccaaatccggcgtgttcgcgcagctcaccgcgctcgccttccgcgacgtccgcttcaccggccgctgcgatctcggcgccgtcgtctcctcgaagaggtgccccgtcctgcaaaagctccaagtccacgactcccaggatctgtataacctgaccatcttctcggagtccctcctccacatcgagctgagcgacctccatggcgggatggggcggctcatgatcgtggcgccgctgcttcgggttcttgatgtgcgccattgcttctactggaggacgtacaggtcccattcccttgttcgggatcaaccatatgccgcggtcttcacgcccgcgctggaggatctcatctgggttgatgcgtatgatcctaccacggtccaatttggcggcgttaaacgcctccggaagctggttacccaattacagtgtatggactctctcgctgcactgatcacatgaattcagtaatgctcttgcggcgatttgagacggtatccattcttcagctagaacttgactatccagaggtaactgcacattttccctaaatctggcatgaatgtcattgaataaaacatagagattgaaatatttgtttggtagactctagtcatagtgtgcatggacttcattcagatatataccttcataagtattgacacagctgccctggtgaaatgtgttagatatttatcttttatgtattgaaacaattgcccttggtgatgtgaaaaatagcattttggaggtcctggatctgctatcgcactggtactgaacatatgagatactgaggaacggtattgatcaaccagatttagccaaagaagactagaatttgagtagtctgtcccacaaacaggaagtgggctcagttttggttctatgcatgaatggtggaatatagagtaagacactgcagatatttgatgctgttctgcctatgtaaaactcccatttgtcttgctgtgctcaagtcttgtagctgtcagcttcttgaggctcttctctaaattatcatcattgggactcgcatgtttattaaccatgtttcaattgttagcttgaaaaatccagttttctatcagttgcatttacgaagtattatagtttgtacatttcactatgcatggtaaaaattaaaattaaaattatagtttgacgcccataatctgatattaccttttagtagataatccctccagtcttgaatatttgacattccaaacatacatttggccaaacttttgaaagtttcaccttttgtcttttcccgtgtttacaagaccatgttgattatccaaatgacaagatatgcagtaggcttgtatgaagaccctgatagaagatcttaactaattaaaagattagtatttttccaatcgtcaccaaaattagtattagtatttttcgtccgtatgtgcaattttttgggctgcaggaat

SEQ ID NO: 41189 - DNA, 7771 bp, Oryza sativa
acaaatccaacaacaataaagcaaaaccatcccaaaaataaatcaccggggccaaaaaaaaaggaaaaaactgcaaaaaaaaaaaaaatcaagcattggccggctcggcgaggcaatggggaggaggagacgaccatcggcggctcggacgcagcccagtgcgcacggtccaccccctcaccacgcacctccaaatccatggacccgcgtgagcgtgtgggcgaagagatgacggatccatgcgggaagggaagaggtcgctggatccacccctcccatcgccgccaacggcggatccgcgcgagaggagggtggagagatgacgggatctgtgcgggaggggaagaggtcgccggatccgcccctcctgtcgccgccgacggctgatccgcgcgagagggagacgaagagacgacgggatccaggcgtcggtggtggatccgcacgagcagcatcaacggcttggaaccgttgcatgaggaggccttgccgttgcccccagtcagccactgcgcttcttcatcttctcgctgtcgcgcttctccatcttttgccgcatcaaggagaggaggcgccgctggccgctgctgcagccggtaggcggaaggaggcgccgctactacagggaggaggcacaagggctgagtatgggaggatgtgagggcgcacgctggtggaggcgctggatgcctggatgacggcgtgcgatgtgaatggggaacgaccgaacgagtgagaagggagagagacacagagactgggatagaggagcctagagctctttgagcagaagacctcttggagctggcaacctcctcggtaatgaggtacgagcttcagttttttcattaaaaaaaaactacgaccggtcaaagttcctttctttattgtgctattgattttcgctgaaaaaaagtttttttagatacacgtaagagtacttcacaactaatgatgatttttctttattacttatattgttgacatcaaaatcacttgaagtttcagtaaatacaaaatatttgtttgagacaaaaaaatatcgattgaaaaaaaaagtttccacgagataagccaaattagagtattcgcgctatcatccacatgtcacatgacctgtctccacgtgagtccacgtataattttgagttgacagatcgagaaagcatgcatgaccactagagactatgagtaaatatgcaaaactattttcgatccgcgacactgctacatgatatattttcttggacgccacccacttttgtttacatgcggtccgtaagtagaaccgcatggaaaaatagggggacaggcgccgggctgtcgcccgtgggcgacttaagccaaccgcacccgaattttcacctgcacgggcccaccgcttttaaccgcgcccgcacacatctccccctccgcccgctcctctcctcccacctccctctcccactccactcctctcctctcctcccactctcctcttttcccctctcccggccggccggcggtgcgacagcatgcggcggcgcgcggcccctccctcaactgcgggtgggaagaagggcagcgagagcatgcggcagcgggcgaccacggcggcccctcccctctctccccttgcggatccggcggagggggcggcggatccggcggcacgcaccccctcccctcctcccccttgcagatccggcggaggggggcggcggatccggcagcgcgcaacccctcccctccctccccttgcagatctggcggaggggaggcatgggtgcccagcggagcggcggcatgcgtcagcggccggtgtggaggtgaggcgatggcgtcggcgaccggcggatctatctctccccctcctctctttgttatttgtgattctttgttatttgtgagatgcgttcttggagttcatttgttgctgtgagatgtgttcttgtgatgtgagagttcatttgttgatgtgagatgtgttcttgtgatgtgaaatcattgtgtgtcgatgtgcgactacagatccggcgccggcgaccagaagggaggttgtcctctgcatcggctacgacgatgatgacctcgccctcgtcgacgtcacctaccccaagcgtgacgtggacaacatgcagtggttccgggaaatcacactgctataccgtggccaccgccactccgcaccctttgtcctcggcctcatcgtgctctgtggccatgcgccgcccaacaactggtgcccatgggggcgagaagggcgtgcgcggccatcctcgggaccccggcaccctgatccgctacgtcgcgatctacatcggcggctcccatgccttgtgtaccagcccgactgcaaccagtccaagtacaccgtcagcgtgcttcctttccatgaggacggcggaaggatggcgcggcttgcagtggctcgcaacaaactaggcttggcttggctcagctcagttagggaaacaagctaaaacttgagctcgcctcggctcgttttctggctcgagccagctcgagctgtcttgcaagccttcctgttgaaacacctcttcatatatattttgtaattattaaaaaatcaagaataaatcatttaacatgtaaaatttaaataagtttatatattcaattcttcaaaatcttaatgataaatttcaatttgacaaataataacgccacaaaagtaaaataatcgatataaacacatgatggcctaggctcgcaagccaaagcaagcggctcgcgagctagctcggctcatttcagcaatgagctgaaaaggaggcttgggcttggcttatttggcttacgtgctgagccaagccaaccaagctcgagccaagcccgagttgagctcacgagcctgagctttttttccacccctgcactaacaaatatccaacttttacatcccaaaaagttactcgtgtagtgtcccacagctaattaaaaccgtgaagtcacgatgtcctgtagcaaaatttgcctatttggttttgttacacagaggatgagttaatttctccatatcttcacaattttcagctcatgttttatgaagggggcaatatatttcaactccacacattttcttcacatatcaacgcacgggtatattcctatagttctctcatttttttaaggcttatctgcttagaaatatatatcccgcaaatataaagaagattaattgtcaagaacaacgcgactttgatcaaacttcaaccacccactatcatctgttatccgtgcaacgcacgggcattaagctatagtaataaatttgtcaactgtaacaaaacaacttatttttaattcaaggtggtactgtttttcatattgtttattgtggctccttatttgtgaatgtgcagatgggccgcagtcagtatttgatggaagccataaccatgctgccagcaattgaggtcatgtccctggagttgtcaaaaagagggcacgcttttgggcagtgtgttttccatttgctcaggatgtccactggtataagaaagctgaagcttgcattacgtggaggcctcaaggtaagtacatactttttaatattgtactttggttgtggggaattgatggaagtattttaacttttgcatgatggcttgatcttctaatggtcaggactctgaggagaggatcagtgttttgtctacctggttccagggacaccaggtaaaattttcaatctacactattagctgataactagtattgctctgtcatatgtattgctaatacatgtatagcacgcccagtaattcctgtacttgaatagccactgctaatggtgatatgagttttgactatttgaggtgatactttgctatgtaatttatgtagaagaggtaaatgctaaaggatccaaacatatttttgctcaatttgatgtgtatttccaaaattgtgaagtgttgtagttctttttgggtgcctggtaactgttaatgttagactttactgactgaacattgttcaggaactattaacgaatgatcttcatgttgatgaagatggtgcttagttagcgatctggataaatataactttaggcatgaatgtgatgtagtatgatgaggggaatgctcaaagaatcatgaatacagtctatctctctttgtttaagacaaacgaattgattgtcaagtgcatcccttttgcagtttttggatttgtttgatttcatttataaactgtacagggtactgttattttctatgaatggaagtcttgtcgcctcaattgttttgcctcaaaccacgtctctcattctattgttcttgtacaatagctgtaccatactttcggctggtttgactgtctaattactattctttcacctatactccaggcagatgctcgttgttctgcaagttgcatctgtaatcggccacaagcctggaaaacagaggacctcttcttggattctctccaggaagtggaaatcagtggattcagaggatcagagcatgaattggccttcttgaagcgacgttttggatgggcagcaattctgaagacattcaccatgcatcttcatcttgatcttactgtcagcgatgatttatgcaaggagcttcttagcctcgctacccctgagaccgatgtgaagatctacttctatcgtgatgatgatgttcacgctaggccagcttgggtgttgtatacaccagaagagtaaggcaccaatcggttgaagcctggtactaagtacttaattatgcagggtatgctatgaattaccatgaaactggatcttatattttgatgacactggatgttctgttatgatcgggattaattcccatactttgccctgcaaggttggcatgaagagatgctggtttacctcttctcatgttgtgatttgctgctttgcgctctaattgccatttgcaagatgatgtctgagatgactttgtagcatggatatgaactaggtacctgaatgctaaacttgtttaccgactagagaaattgcaacatatatacatcgaattttggatgctctacacggtgaactatgagctgggtactagtaccacacaagtaatatgattttgcaacaaaatgcagatgctccataaaagtaaatacgtttatgtacctttttacgacaaaagtacacattgaaaacttcccgagtagaaatttgaatctttcagttcaatgacttccacatttaaattgaagagactatcaatcaatcgcccggactattttcacatgcaacttgaaaagtttcaagtgtacgtatagttagttactagcttcaaataatatatagccaatttaacaatttattcatataatagttaccaataaatatataataaacaacgaatagctgatctcgcatctcataacacataaaattttgaagttcatgctggctataaatctgtagccttattttctcctctcttctctcgtctcatgtgtttattactaccttataaacaccgctttcctcgtctcttctcccatctcctgtgtttataactaccttataaacacttttttctttactgtaatcaggagtcaggacatagacacttgaattaaatttgaaaatatattattcatttgttttttctcatcaatattcggtacgcaaatatttttggtagaattatagcgtcgatctcatacaattgcgcgaaaataacatggtctcgagcggggacggtgcaagacaggtctaccagcgagcgaaaccgaacatgctggtcgattcaaattaattaattaccaggattagcgagtgattaattatttattaacagctaactagggtaattaatcactaattattactaattaatctctaattatataattaatcactaattattaactaatcgctaattagggtaattaataattaaataagtggcaccgttggacaagacgttaggttttgctgttccattctgcgtgaccgcgcaagaccgaggtgctaacggtcgtgctgttccattctgcgagaccatgcaagaccgaggtacaacggttgtgcgagatcgaatgcatatttataaaaaaattacatcttaaatatttctaagaaaaaagcaaataaacaatatattttcaaatttaattccacgatggcaaaaatgataattagcgatcaactacacgctcaactcagattttctgttgaactaatacgccattaaattggtctaaagtttattcgtacgtaaaatttgtaggtacaaagtttttatacgtacagattatttatctataatgtttcacgtattattttttatatataaagtctacgtataaattctgtttttgccttgactaaaatactactcataatttattaggcctaagattaaacctagagaagtgctaagagctgagggtcagacgctcggcggtgtatgggctggggtgggatgcgatcgtgcggctcctaacgatagatcgatcgcttattagcaatctcccactatggggcaatttggcaataaaaaatacggggtgtagtgaaagtggacatgcggtagtgtggcgggaatcatgccgattgactgcactgtgcattatcgttgcctactccctgagcaacactaactcagtgtcgctgaacctccatgcgagagcggcttgcctcttgacaactctgtaagagagggactagctacatgaagagattcgaacgggttgcaagagtggttgttcgttgggtgacattagcccatggagccatgggacaccagcacgctcttgccttatgtctttggcaatgtccttagccacggagttctcgttgcctcttcctgcggcaccaactcagtgtgaacatccctcgaggcggcaccgccggcatacactcgtgtcgccttcgctactagcgaaatcgagtatatcttcacgatttcttttcgaagatgacatatgtttgcacgatgtcatggaggtcgctcacctcgccgccgctggggtctccgtcctcgagctcgcccgcgtggcgatgccctcccctagtccccttctcctgcgtcgccgccgacgtcgacgccctccttcttctctcgtctctaggcctctccaaccccgagctcgcacgtgcggaacgccctcccttctcccacgtcatcgtcgtcgtcgccgctgccctcctcctctcccgcctcgcccaccctgtcggccagcctacaggaagagaagagtgagagagaggaggaaccgaggaagggaaagaagaggggaagagagggtgatgacatgtcaccaaacatgtcatggaccccacgctgactcagctgccacgttggatgaaaccggggtcaaaatcacctgaggacccaaaatgacccggttttgtaaattgagggatgacatatatcttgttttacggttggggatgattttgtaattcgatgataaggtgagggacctgtgatgtacttttggctactactctaaataagctggcccaaataggaaaagatcgcgtcggccggtggagaagcgaagcccaaacgaacgcgaggcgcctccgatgtacacgtggcgcctcctccgcccctacaggtggcaagctcaaagcccgaacccgaccactccactgctctgatgctctctctctctctctcttcacgcttcccacgcgcgacacgaggttggagacgcgtcccgtgacgtcatcgtcgtccccgactccggcgagccccgcacccatggcggcggcggccgcgaggggcgccgccgcggcccgctccccgctgtcctccaccgccacccc

SEQ ID NO: 41190 - DNA, 1913 bp, Oryza sativa
  unsure (1)..(1913): unsure at all n locations
cattcctcacaaaaataagtagttatgaacaatcttgggatagctagatcacagatgcattgaatattaagtttgtttgttcttcgcaaaacatcccatgtctttgatttcgttcaaatgcagatagagctggcgaattgcctaagttggttgaggaccttctacagacatcaattagcacagggccacgaggtgcttttaggtttgcccaagggatccaagctgtccttggggttggtgggagtggctaaatgacttctcaaaggttatttcttgtttgtgttattcatctattttgtctaaaaacttgatcttagaatttctgagaactgaaacaatggaagcagctgtagactgaactactaatgaactactgatgtgttgagttggctgaggttgtatgggagaatattggggatttagggctagtctagatgtggatttttcatctatgtagaaaagaggaggttaaatttttgttggtgcacaatgaccaggtttatctaagatattttttttattgataactttggtttcagaagcgtaatatcctgctgttaatatgatgcagacagccaacacatcagcaggaataccagctcagatgcagctgggtttgctttctcctctttatcttagaaggctttttgagcgcatgggtgcaacttatatcaagctaggtcaggtaaggacatgttcatactttgcggtttatgctatcatcaactacaaaatgtgtccatctcaaaagaaaaaataaactacatgtgtatgtgttccttaattaatagattgtcttgaatttcttaatcttctgtaccttttgaaagaaatgccagaattcttcattttactttgtatatgtagcaaacagaaacaaagaccactaatatatctttcagcaacccagacaatagtcagttgcttacttgtcactagacaggtagagtaacctatctttagagtggtcctttgggatgggcaaagggagaggagttaaaatagttattcagtttaatagtcatatattttatgattatttcaacctggatagtcaactgactgtggtggtgcagttcgtagcttctgcaccaactttgtttcctgcagagtatgtcgaggaattccagaactgttttgaccgtgcaccacctgttccatatagtgagattgagtcaatattgcgtgaggagttgcaacagccgttggatagtgtatatgaatacattgatccagttccaatagcttctgcgtcaatagcacaggtttctgttgagaccatcagaagttctggactatttgttgtctggagctaaagcactgatataactttattcttatccaggttcatggggcaaggttgaagagctctcagaaggatgtggttatcaaggtcctcaagcctggtattgaagacactttggtggctgacctgaattttatctatgttgttgcacgtattttggaatttctaaaccctgaactacagaggacatcactggtgagttatcgcctaatgagtctttcactggacaggatttttttcattcatnnnnnnnnnnnnnnnnnnnnnnnttctcggagcgcaggaaaccaaaatttactgctttctttagtataatcagaagccagaaggtcaaaatatatttttgtttgattcctgtatgcagcaagcaatgcatgccatgaaattgctcccatgaccatgaggatatgtttttcttttggtagttgaggcaagatcattgaacttttcacagttgatttacatgtatttttcaattctagccactgtgctagagttggcacaattaggtgcagaaacttttaatatctatatccttaaaatttattagttggattgaaggcaccacaatattcctaagatcagaaaaaatatgagtttaaaagat

SEQ ID NO: 41191 - DNA, 6561 bp, Oryza sativa
cacacgttggggcccaagttgttagtgcgtgcagtcaacaatacccaagtatacgacaatcctctatcatgacagacgaacatctttgactctagttgatctgaaaggaaggcctgaaattgcctggtttcggtgattactgtgctccatttcatcgtgagttaatcatctctaggtctagtttgctgcactatacttcaccctagctccatcgcggtgcaagtaaatttccatgcaaatctctggggtagagaagctaagtagctccttagacagctcctcgctaactgttactgaaggatcaaaacttagagtaatcgtcttgagcactggcgtccatctcaacagtcgtttgacaaaatatatttgacactctgctccactcaagttgttgatttcaactttctggagaaacaccaagctcaaattcatggtttcccagtcacggggcttgtaacaaatgcagccagatgagcaaggaacttttctaccctgaaatgaagagcatgtaagaaatcgatattaagaatactacggaaggatacagataaaagggaagtcaggaacaacataggaaaatggatatgatcattctcatgcaaaccttttattcgtataagagcaatatgtctttcagatctaatcacttccagatgtaatttgtatagaaagggagaaagaaaaagaaaaattggaaaatgtagttcagatactttgactacgattacgacattttttgtcggaatttcatttgatcatttggtgtggtttgttggaagtctcatcgacatgaatcttactacatccacaatatacccataacaatcaccagcaactgaacaacatttgcagctacattccaatcatttctattttatcatagaaaaccaaagcagcattggtaacagttgaatcaaacttgtagattgtaggctgtagcctgaagaagggaaacacttgtagtgttaatagataaaccatggagggaaatatcggtactgggactgacacatcaagtactacaactcatagtaaaaggatcaagctgaggtgtattagattgcaaatacttataccacttccccagaaaccaaggtatttaattacattgaaaagctatatattacctcagtgtgatcttctaactgcagcttcagctcccttgtactgggagacatcctaagcaaatggaatactcaaggtccaaaagtatgtccttctgttaataaccgcagaaataggatttcaatggcagggagctcatctttcactgcttccaccaagagcttatcgttactgctgatctgaaaattaacagaaattcacataatataattacttaatatgtgtattttgactttgcacaaggattaaggaagtgatgatattgaaaaatgtatcagagaaaaatataatgctacagaggaagaacctccataggcctccaactttatggcttgagcaaaacaatgtaaacacttcaaggccttgttcagttaatccctcctccaaagggattgaaggggaattggaagggattaattccacacctattgagatgtgaaattaatcccctacaatgccttccacatggggattaacctaacaagccctaaggaattaaaattgggctaatactgtcatttatctccaaatctacatgccatatggactcattagatctctccaagttgcatactcctatttcgcatctgattaggagtcccacaaatgatatcttactcttatcttttaaatcggcatgtgcctatgctaagatactagtaaatggttatgaactagaaaaatattatcagtacattagcttcatcacaatgtaatgcaacaacagggagaaggtgcactcacagagctgtagacgagagagagacgaacatcgcgggcttccgtaaaatactgcaggagtggcagagagtgtgaaacgtatccatacaccatgacaaagacagcaagtgtatggacgtttggcattgctctgaatcggactgaactcgaacggaaaaaatcaacccaacgaagtgtccccagcgctggagcaaagatgtcaaccattggcatcccccacaataagcaagcgtacaaatctagttctgtaagcgcaggagcagaaatggggagctgacgaatcccttccagtcgagacagctgaacaaggcggagagactccgagcggatggctagattggacaccacatcggcatcgcggatacggagctctcgtagcgacgggcacccctccgacgagacggcgcctccgagatcgcgctggctctggtcgtccaacctgcagtggctcaagctcagcgcggtgagcctcgcgaagacgccggatggtggtggcagccggatgccgatgccgcgtagtaagcggatggtgacctccgtggccttctcgaagcacgggatccgaatcgcggccccgatccccgccgcccccgccgccgaattttggttccccggcgtgatgatgtcgaagtggagcttgccttggaggcggggcgcgaccaggtcgaggacggcggcgatcttctccggggcggggtcgctgctctcgatgcgcaggaggaggaccggggcggagtggtggcggaggacggcggcgacgcgggcgaggtcggtgacgtccgcgaaccgcagctgcgggaggttggtccagaggctgcgccagcggcgggagaggacgctggtccgcgcggcctcggcggtggaggggaggcgggcgaggaggaggcggaggacgtcgtcggggagcgcggtgaggaggtcgtagccgccgccgtccgccattgccgcttcgagctcgtcgccgaggagggttttggtttgaaatggggtttctggtttggtttggaggggagcggcgatttttaccggatttgcttctgaggcaggacacgaaccgactttacaatttctttatttacagtaatatacttgtagtaatattactttttttttttgttagaactttttttttttttgagaatttgcttagaactagaagtcgggcgcttctaattaggaaaatcctcagcgccgggtgcccgatgcgcgccaaaaaaatatcggggcgcccccacaccacgcctcccgtgcgcgcgccgcccccaccacatgtccctatcacgcgccgacgcgtgccccgttgcaacagccgttcggatataacggaaacgccatattagaaatatcagttttattatttgttctaccaacaatgtttcagctagtgtattcacgatgtttgactatgtatgaatcaaatgttactgtgaattttgatattgtttaataatttcatcttagtggacacgtgggttgtagtgttgcaatagtttcaaatcgttttttcatacgttaaaccagattatttcatctagttatctgaccgtgtttcactttttttaataattgaaacattcttttgctatttgctgaaatatttttttaggtaaattttgcgacaggacatcgtaattatatggttttagctcagggacacgatgaaagtgtagttttgggggaagacatcccataatcgtggatatttgtcgatggacaccatgccgtctaaaggatacttgtcgtgctaatggcggatgggaggccttttttgacacagtcagacgtaaatacccctacgccttgccgtgttgatgaaggagggagtagtgggtcccacgttaaagcggttgtgttggttaagaggaggattaaatagaaatttaccacagtggggcccagttgccgttgaggcattggaagggatgaggagagataataaggttatgtggggcccacttgacagtgtcccactcctcttatttttcttctctcttgatttcttctcctctcgatctctcctcatctctctccctctcgtttccctttctccccacgcgcatgcgtgccgccgtgccctgagcgggatgcggcaggtgcgcgacgacgcgggccgaggcgacggcggcggcctgaaggcggcccgggaacatcgagtggatggggagaaaaggctggcacagcgaggaggtgtcggggcagcgccgagcataggaggcggaggtggaggcgctgtgcggggtggcttggccgcgcgcgggggtggcgctcgcagcgtggtggtggccccgagcaagacgaagacggcgggtggtggcgtagcggcagtggtgcgcaggtggtgctcgcgcgcggcagcagcggccgagcggggtaacggcttggtgcggcggcggagaggggaaagaggtagctggctgtggtggggagtggcctgacgggaggcctatttttgctgacgtggtgcaggggtatttgcatccgaccgtgtcaaaaaatggtctcctgtccgccacgtcagcacgacaagtatcctttacacggcgcgttgtccatcggcaaatatccatgattatgtgatatattctctctaaaacttcactttcgcagtgtctctgagctaaaaccacacaattgcgattttctgtaacaaaatttgtcgtgtttttatatagggtgaaacaacatctggttatttagaaaccgttgtttcatacgttgttgtaaaatgttttatgaggtgatttggttgtgtttcagctttttaaaatactgaaacattttcgatctatttggtgaaacatgtttgaaatacttggtgaaacagcacccgattttttttaaaaaaatcgggcgcccgatttgttggcacctcgttttaattggcacatagaaatggcgggcgccaactggcgctagctctccccacattttctttttttattgctatttgtttcatcgttttcattattttctctttttgtggtttttccccaattttttttaatctattgttttcaaaaatatttgagtagaaagttttcaaatcattacttgaaagtttttcaatttcagaaagtttcaaacctgagttgaaagttttcaaatcattacttgaaagtttttcaatttgaagaaagttttaaatctgagttgaaagttttcaaaatttgtcttataaatttaaatttagagttgaaagtttttgtttcctttcgtccttcactcgagacgagcaaaggttcaatcttagggggttttgttgatggtcgttagcggtcagtttcgaccgtcaatattaccaaaagagaggagaactggttatgctttcaatgcatatacatattagaataataatattccactagtatttggttcactaaccttttgcagagaataagtataaagtgaaggagaatcgacatcaaatcaaacgataaatcaacatgtgtgaatgggccaagaactcagaattgacacgacgaattgggccaaagttcacaagtcaccctcctcagcgccatccgatccagggcttcacctggacggtgtggattagcccccaatgacggttggagggtatttccgaccattccaaccatcacaaccgtcattgggaggctataaaagaagttggcattctcacttcactcatacacctcaagcaagagctctctcatattctctcaagttagtttagtattcttaagctattggaatagaaatagagtagaaatcagagtccggaagccttcggaagagttcggatatggctctagtagctcttctcttctcttttgtaagctttgtactttatttagaatactcttctttatacatttatggtattgaaatactttctgagtatacgaaagctaactctatattatgttcatgttatactgattatactgctagcttatctgggagatgctttggtacgggtatagtgtttgtttatgcaattactctatgtcatgacgatgatattagagtagtatctggtagtttaggcgtggtgtctagactacgggatatcattatttggggttatatgttgtggatgagaggtgggccgttgatgatgatagctcagtatgggtattcctccgcgcgtgtatatagtcctaagttaatttcctgggagcgtattccttcgtatttagccccggttgtatggccatgacggactgtcgtaaggaactcggcagtcaggggtggcttctcgaagtatcaggagggcatcggatagagggtattagctagtatatcatataactaggatgtatgtatactatatatactagaagtataggaatagattctctttctcttttctttccacttagcttagatattttaatgtgagaatgagtagcttcctgcttgtttgtcactctacccttgaattatcttaacccctgtttagactatgattattacaagtaatatataaattattagtcaagttctctcaaccatgatcttcccacgggattaaataaatacgataccgttggaatattctcgggtgaaatgctacaatggtatatccgtgcggttgcggatgaactctgtaaccataatataccaggagtatttctgcgccatagctgggaattatatttctagtaatgtcgttaagaaataccagcacttaccaccacacactaggtcccactaaaaattcacaatgtt

SEQ ID NO: 41192 - DNA, 3439 bp, Oryza sativa
tcgtacagtcgctagggatctcaatccactttccatacactctgtgtagcccattgaattgtgtctaagtattgcattgcgtagccgcatcactggaatgattctaaagttagcttatgacacggctttaaagatggactgatagaacttctacaactttagctactatttaatacattaaaaaacctgttcaattgaatttgtgtagatttgatcattaaatttttcatgacgagtacttccttaacataatattgtactaggttacaagtaatattttcttaaaaggttttgctaagcagcatatttccctataaacaccaaatggtatcgcggataactttaggtaccttgcaagaaaaagtcccaaacgttggatattatttgtaacaaaagggtgtaatgcaaaataggatttgctaaaattttgattaatcccaaagtagccacatcgttataattcaaaagttagcaaacggcgtgattttaaagatgattgaccaaaccaacttctaaaactttagcgaatatttaatgtattaaaaaattatttggattcaatctttgtagattcgatcattgagttttcatatgagtactcccttaacatatatatcaatgtactagattttcaataatattttcatgaaaagttttgattaaataagatattctcttgagaccaaatggtgtagcggaagacttcaggtgcaatgccaaaatgtcctggacgtttgttgtttatgaaacacaaggggtgtaatgcaaaactggatttgcaatatgtgtgattaatgtgtgtatatatttcatttaaaactattaatgcatatttcatttggaactattaatgcatgtatatttcattagaaactattaatgcatctatagttattgcccttgctccaaaccgaacctgtttagacattaacaacttgctacatatacggcctctccctcgttgtattcttccacaattcacatcatactaccatggatgtgaacgtcgtggtattgccgacggtagtcagccgtagttgccgcctgaccgtcgtggtcgagccctttgacaaggttgttgagatcaagcagaaggtggagagttgctatggcatcccggtgaccatgcaacgccttttattctagaatagggagctcgctgatgaccacgacattgagtattatcccatctttgatggctcgcatgtcctgcttctcccccattggcaggtggcggcgaggttctgctggatccacgggctggccaagtggagcggcggtgataggatgcatgacacggtccatgtcaccgcctacctccctccggctagttggggacggaaggtcacagtgttcgcccgtcgacaggagagtgaggatgccctaacactccgcatccacggtgcgcaaaaagtggacatgcccctgccagagtgcatgtggaacgaattcgtgtgtggcagcctcatggtgatgatggatcactggcctctaggtgcgtacgtcgagttcgactccggcgtggtggaggtgacaattgttgattgcaagaagatggtggagacaggaagcagcagtggcagcaaccgcaataccaacgtggatgccaacaacaataagattgtgatcgggctactgatggagggctcacactcccagcacatggatttcttgttggaggcgtcgccagcggacatggtcgccaccctgtaggagcagctgaatgacaacttcgagggcgacccagagacgccgctgctggccgaaggggactaccactttgagctcaacggggtggccatgaacgaggagctgtcgctggaggtgcacggggtcgttgagtctggtgaaaccatcatgataatttccgggaggctgcctatgcctgggtgtgaataaagttcagactaaggtttgtgagggttttacaagtgtatggtcttgtggtttgtgtattggcgtatgccatccacctatatggtttttagaaacaaacacggtggaatgctgaaaaacttgagtttttttaaggagataaaagttttgttttagcttggtggatgtccagaccatctcctccattgaatgtgtactccgtatcattaaaattagtatgcgcaaataaatataaatggagagatagtagtgcatatgaggcatgcaacccaacattaacaccgtagcggactcatagaaaactaagtgtgatgcagtcaactaagaaatctgcatatgcttatgggtttaaagttggaaaccgccgcttttaatgtgttatggttggtgacagttgtgagcttgcaatttggtaatatttgcgtgtaacttaggtgaatctttgaaaacaattaaaaatttcaaaaccacatttatacattgtagtatatagtgctatttagcttcaagaattatggtggtacatcactataaagaggcgactattgttttgtattttacaaaattaatctgttttcacccacatctacaagtgagaacaattttctaaacaaattcactgaactgatgaagtgatgtacctgcctagtatagatgttattttggtcacccgaaatctctatcattttcttttgtgaaataacggtgaaggaggtatgtatctttctctatttgaagttcttttcacggttgatgaggtaatattttggcccacctaaacattgtatttcttgaaaattggacgagtaaacatatggcttaattgtgaagagctgatcttatatatttacacggcgccccattgttatagcttccaaccttctacttgtgcaaaaatgagttggagggagaagttggtgcaagatagcttacacaaacaagtcaaagtgtaatgtaggtgtgttgtagaacttgtatcaagcttaaatgcaaatgtagctcgaacattgttaatagcataagcacaaacttggtagaatctaaatgaaatggtatatttccatagacccagttgctgtgcagtcctagcaaatacgagtgtataattgaaacttcaatgccacatagacaaaactagagaaataactttctcaatacatagtatatataagtgggccaacaataaatattctcttattctttttattttctcttacttctcactattggacatatttttttggaaaatgtgttgaagacattttttctcctccaatgcatggaagacactttctgttctctttccatatcatctaaaatcctgtgtgtcaagggtattaatatccatagtaacaattatagctatcaattgggagtgcccttagatatgtacaatatgaatccaagtgtcaagagaagtgggatgtaatttacataggatagaaatatcgatttgagcaccatgtttaatagatggatggatgacatcacatatggtcaccaacttgccgtccttaatgactgcaggtgatatcaatatgct

SEQ ID NO: 41193 - DNA, 1386 bp, Oryza sativa
tggagcggtccagaccttggtctatttctggtgaccatgcagcgtctttctttcagaacaggagcttgtcgatggccaaggcattgagtactacccgatcctccatgtctcgcacatcttgctcctcgtgcgttggctggtgatagaggcatggcactgatggtccatgtcactgccttcctcgtgctagccagccagggacagaaggtcaggttttccccaacaaaattttgatgacttcattaatagcacattgatgtttatttcgataccaactaaatatcaattctactctattaaatttgatagtgccaaaaaggttgtaccgttacaaaacagtgtaaaaattggatctagatgtgattaaaaattgaaggagtaggaagaaaatgtgtcttctccaaatattaggggtacacacatatgctactagacatcaccaaacttgacacacaatcaaagcgcgttgaggccaattaatcacggcatggcgtgcaggccgtgagaggagagcccaggttcatgatttcacggtcggttcaacgttacgggtttaatcgggccgaaagtggagtggccgtggtggaaaccatgcacgttacttggtggaataagttcgcttcaggattcaggtaccgtaatatcagatataacatgtctcttaacttgtaaaaccggtacaaatatagtcctaaagcattatggtaagcggttttagctgacatggtgcggacgtggcatcaaataaaaataaaaaacatgtgggccccacatgaaaaccacacaactgcttattctcctttccccatctcccctcccttcccccatctctttctaggataaatttttgttgatatgattgattactaataatttactacctttgtcctaaaatatagttatttctagcacaataccttgtcccaaagtgaagttatttctccacctacctcttctcaaccaatcacaacgttttctccttcacttactttctcttttcaatcaatcacacactttcttcaatcattctcacatattttcttaataccgtgctaacctaaaaaatgtatacattttgggacggaggaagttctactgttgtggtgaaaacaacaagaaaactactccctccgtttcaagttataagacgttttgattttggtcaaagtcaaactgctttaagtttgaccaagtttgtagaaaaaagtagtaacattttcaacccaatacaaatttattatgaaaatatattcaattattgatttgatgaaactaatttagtattataaatattagcaaatctattctacaccccccttagaataactattctacccccctctccctcccatgggcaaacccacctcccccacccttcctagggcc

SEQ ID NO: 41194 - DNA, 3724 bp, Oryza sativa
ttcctgcagcccgataagtcttggttttgtcactttaattttaaaatttctctccaatgtgagataaaaaaaattagagggagagaggccgtcgggcgagagaaaaaaaatcagagaagagagagggcgtgccagtgagagaaaaaagagagagggagagggcgccgggagagaaaaaaaagagagggagagagatcgatcagagggagagggtgccgagaggtccgaggggagactcgatcgagagaaaaaaaagggggcgcagggagagagagaggggagggcgcgcggaaaaaggacgagggaggggcgggacgagagagggaggatgagggcgggatcgggtgggccgggtggagttgttgggtaggataggaggggttgtagaatagctattttaagggggaggtgtagaatagagttgtcctataaatcttaactaatataaatattcgtatttttccatttgttacaagacggacgaaggctctttcgtccgtcggcgggacgccttcgcagcccccgaatcccaatagctctcagaatcggatataggaaacatatcccaaaatcggcacaaccaaaactcaaccactctttgccccaaaagatcattcacaatcatcaccaaatcacaaaatacatcacaaaacttcacaaaaatatacatcaaaaagaagaagccgcaggatccgccctcggccatcgccaccacggccctcggccgttgccaccgccaccctcaaccttcgccaccgccgccggattcatccgcggccgttgccgacgctacaaccaccgccgaagggagaagagaggccgcggagggagccgccgttgccggatccgccagcggccgccgccactgccggcggatctgctgcgggaggaaggcgaacgggggcggagggagccgccgccgatctgccgcgggaaggaggctagagggagccgccgccgatctgccgcgggaaggaggctagagggagccgccgccaccaccctcggatccgtccgcggccgccgccaacccgccacaaccgtcgtcatatccaacgagggagaggaggaggggacgagggaggcgagacagggcggggggagcggccgccggcaaggaaggggagatggtgttaacaatgaaatttggtaagcccggagtagtcgtcggctcagagtcagcatcggcttcgaagtcctgagattagccgatgagacttgtcaagtcgttagttgtcggattcttgctatattcggttaaggaaattgatctactaaaggaagcttatccagaagagaccgagttcaaagagaatgcggcatggcaagttatctattaattaggaatagtttgttaatttccttttatctttaggaaagtgtgtttagtgtcctataaggactttatcttttccttttatctttaggaaagtttctttcttgtccaacaaggacttgtatcaacccatgggtataaatatgtacacccggggtctatgtaatctatcgctatgatcaatacaattcggcgcatcgccaccctttttacttctacttttgtttttacgttccggcggaacttggcacctgacgcggggctgcatcgtcttcgatctccggcgaagggataagtccaatgtcccgtcggtccaggcaattgtaccatctacgtcggcgtcgttcaaggctgcatcagtacattcgacctcttggattactctggtttggatgatatatttgcctggctatttatcatatgtctatgttaatctagtcctagcatctcaatttagctctatcggctgtctctcgctttagggtttatgccggtatcggctaaatcgccttgctagattagattagcctagacatctaccaccctgaaaaattagtcaatggcttgattgtctagatattgtgtttcttttcatacttagtgctgcatcagttaattttgatctaataagtcatgcttagaaccataatctctagcctgctttttgactgccaataagggtttcatcggggtttcagccgatgagttatctaggcattgcatcggctcataaggattgaatacatattggatttagccgatcgcaacatagatttcactgtttatctaatcttgtggatttcatgacatcggacctccagccgatgtgtgctttaactttcggatcgatgcttatttatcatatcattatttgccgattggtttatactggattatattgttattttattacatcatcatcagccgattgcctttatatcattatctacattggacatatagccgattgcttaaaccctatcgctatcggctggtatcggcatcggctattatcggctatcggctggaactactccatcggcttgtcagccgatcggctgttttgatctactatttgcatatcttgttagttgcaggatcaaactgactggtacgcccgcatctcatcaagatttggacctgcacaagagctaagcagatctcccaggccggtgtgttcgattttttcgtcaacagatggcgcggagggagtcgccgccgccgtcgcttttcgattcgaaagagaaaggtgatcggggcgagttgggggagggaaatgaaatctagggttagggttagggtttggctgcagatatttatgtaggttaggatcaatctggaccatccattcgattggacggctccggcttctcccgctcgggccgccggactattgggcctccaaataggcatgcaagtttgcgcaatcagaggaggagttggagctggtaaattagactttatttacgggctgagacaatataaggactgaaaatggcccatagagaaattgggggttttatttacatttttatttaaataaatgctgaaatgatgtttgtattatcaaaattagcaattaagctccgaaaattccaaaaaaaattcaaggagcattattaatcatggttaatttaataaaaattaaatgcaaccatatcatattatttcacagcatgcgatggggaaatgcacagctgatgtcgcttacggtgagagagaaggggaattatttatgtccagaactatctcttataactcccatggaactataaaataactataatcattatcataacattagtttttttcctgttgcaacgcactattgaataataatttattatgagctactatatttctctctatcatttgagacttcggttaaaaacaaatatttttagttttaatacactgtagcgaagcacggtcattttgatagtattactgtatttgtctataaacttagttaaacttgaaatagattgactttgaccaaaatcaaaagggagtagtacctaattaatactccagttgcagttattagttcacagtggaaagcacattgtacagaattagtatttcattagatcttaagaagaaacaacaggggaaatacgagtctataaaagagcaccatcttttcttaaggcaaacagatcccctggcaaaaaaaaattataccctgtcacatcgaatgtttagacacatgcagggagtattaaatatagatgaaaaaataactaattacacagattgcgtgtaaattacgagacgaatcttttaagcctaactgcgccatgatttgacaatgtggtgctacagtaaacatttgctaatgacggattaattaggcttaataaattcgtctcgcggtttacagacgga

SEQ ID NO: 41195 - DNA, 10759 bp, Oryza sativa
cagttacacgacaggtgaaaacttcagctcatgagcatgaccattatggcattattgcatccaatggtacaataaacaagactgataagtacaacagcagtagcctgacaatgcaagcccaacggccggccattatgcagtcaaatggcactagaacaaatcgaattcggaacaagctaacttaaggggaaaaaagatgaaacgggcccagataagcagggcccgaaactaacctgcctgtcaaactccagggtcaactacactaacacttctcataggatgtgcctagcttagcagaacttccagtgattgttgcagttcacgcaggtcacgaacgtcgtcatcggctcgtcggcgctccgagtctggagctggtagtaggtagtcttgcgctggccgcacctgccacacttgaactgatcagtggtggccttcggtgctcctccacgctcgcactcgaacagagccttctcctcgatcttcttgttctcaagcttcctggtgtcgctagccatttctgtcggggttaggtcagcaattctctcaggctgcacttgtcctagaagaacccttctccggaagtctgtgttgtgatcatccttcagattgaacatcaatgatctgtacctttgcttattaggtccattaaaattccccagcttctgaaacaaggcacactctaccatcacagcaatcctgaatgggtcacatgcttttacttcttctatgatgttcctcacttcctccctgtcatcctttctagtctcttcagaaactctggagaaggcatcaccaagtatcgcccgaattctgtctcgactagcatcaccacatttaacaacggatgtcagtcttggaggaccaccttggacaggagacggcttctcaacagaagatactttgtgaactaccttttgtactttctcaaccttgatagattgggttctcagctcagcattagaaaacttctcaacctttccacctttgtggttcacaactctggtatccatattattattattgacagtagcccttggtgatgccttttcaactttcataggctccaccttctcaacctttaccacagtagaactcgattttccattctgcagtgccccatttttcttgtcttcttcaatgacaacctttttccagtgtcctaacaggtctgaagctgttgcttttatgcttgagtgaggatgcttggtgagatagcgaatacgtctgccgatctatatcagaacaaaagataaaattggagtaagtatggaagagtcaatctcctaatggacgagctgcaaacaatcgaatgaaagataagcttacaaaaggaaaataaaagcctagacacccagttttcagaacatggaaagcaacagctcagcactaagagttgggattaaaaattcaattcgcttttgaaattctataaaaaccttaaattactgaaggtatttcagttcatgaaaaatggtactccataagtgtatcttatggaatgattttacagatcagcaaacaagagtattgtgtaagtattagtaacttagtatatgacataaagagagttgtattacccaaacaccacatgcatatgtacaagttttttagctttccacattaataactagatatcaaacgcaaggtccctctgggaagatatgatgctgtcatgaagaaaaacaccgtaccattatgaaggaaaacatttgcatgctagccatgctgagcaaaacaggaaggaaaataggtggaattacatatcttacataactggacatggtaataaatagagcaatataagctaaacactgggtgcttgctaaaaatggtaagcaagattatgtgtgagcaagcaataatgcagcgtagtcaaccggtaacactaagcaactgctgtcctgcaaggacgtcatctaccgctagagcaccagtgcttcagaatcaacttttgtttactggttatgaagacatggaaataatcctaaagattatgtgtcagcaagcaggaacgcaggatagtcaacaagtaaatgctcagcaactgctgtcatctactgttagagtaacatagcttcaaatttgttgaacttttgtttgctggtgatgaagcgatggaaagaatccaaaatttcatctcatcttttagtggacaataagaaagttattttatgacaaaatcaggagacaacccacatctttctacgaactatccaatggtatcctttcgccatcgatactttttatattttacttttcaatagaaaagaatgacttggacatgagatacccccagggccaaaccccccaaaaaagaggcatttgtgttacgaggtacgtctgcacgtgtaagggcatacccagaaatgggccaaggcccaggccgccctattgtaatttgagcaatgttctagaaaaaggtatactaggccgcatacaaggagcgggttccccaatcttgtacctcttaagtcgtataagcaccgattatactgcataagcgtcccattatgccatatacgtactacaaggtggggccacctcttagaacaaaccttggatatgggccaagtttatgccaagacggagaaaattctgtcccggggcccaagccaagggcctgggtccaaccttgttcgcgtgtcgcacactaccacacaattctcacgttcaacaatagttcccgcgcaaacaactcctagaacattgagcaatatcaccatacttcaattttctcctaagcagaacaataggtccacaagcaacccataccacatgggacaccaccacctcaggcaaaatcagtacctacgaatagtttgcgcctgcgcagcataccagtatagtagacccatgcttgatgtttagacatcacggaaatcccaattatcattatagtataccagtatagcattgctgcaaccccttatccaaatctaacccaaccaacacccctcaatgaagcgtccgtacaatagctaccaaatcaaccaatctgaatattctaaatattccttagatttgcaagcagggtaaaacaagcatcctaatgttcataatccccaacctttccacatctaacaacccccaccccgcacgcatatacagcaataaaactatcacgcgaaaatcctatccatgcgaatacgaacaatttgaatctgaagccacaaaaacaaccctaaaatcgcttcccaggaacccacattccccttcctcggcaagacacctcgccgagagatctcccaaaccgtcggaacaacaaccagagcagattccctacaatccccagtctacttacggcccccgcgctcggtgttttaacaacaaacaggggggcggcgcggcgtggctcacctgagtggagacgagggcggcggtggtgacgcgagccccgcgcagcctccgcagcgcgtcgacgcagcgcgcggcctccggcgactccccttccccggccccggccgccgccgccgcctccccgaccgcgtccgccgccttcctcgccgcctcgaacgcctccaggagctccctctccatcgcccccgccgcgcccatcaacccacaccaagccgcctgcctccggattttctctctctctctcctctgcggcggtggcgcgtgtcgtggcgtggcgctccaatggcggtggcagctcgagcctcgaggaggaggaagaggtggggtggaggaggggggggcgggatatttataggagggggttgggtgaatccgatacgcacacgtgggcggataaggcgggatccgacggctgggatcgtcccgagggcgtttcggtatccaggtggtgtgggcccgggccgccagccctctgcttccaggttttttttttcttcttctctttcgtaaaaagagaaagatttctctccttttcttttctttttggtattttgttagtcacacttcgtttctttttggctgctttgccatgtgtcactgcatctttttttttccttctctgtgttagcaatgcttgtgtttcattgttcagttgggttgcttgttgtctctatttgagcaaagttgcagggtatcttaagatttggtgacaaaaggggaaattcgaggtatgtcttttgttactgtagcagtgttttgtaagtaaggaacatgaatgaaatttcaagaggaagtttctttgtagttttggattacaattaaaaaaaaaaggcaatgctcttggctcatttcctggtaaggctcatacggggaagggcaagagtgcaagactatggtcggcactgttccatgcaaatttattggagctcatgatagaaaataggaaagatgtttagaaaaatgaggtgtgacttttgtaagtataactcttataagcaacatttggtatgtaaagaacataaatgaaatgttgttgtaattttgtatgcaacacataacacacaatgcataagaaatactcctatatcagataatgataacgtgatttcctcattcattaatttcaatgttttctagttctccatgagcaagttttcgttgaatgaataaaatgttttcgctaagatattgcacctgtaaaattgaagaaaattcactgcatgttttcgatacagaagaaaaataagaaagaatcatatttatagatcaaatgattctaaaaagatcagaaacaaaactgtggtcttctttcggacaacgaccttgtcctatttctttctggtgctataaactatatcctctctctatctgtgcatacgagcgtacacacgccttcgttttctcgtgtaaaaataacattttcatatctgaaagctcaagtggattaagagagagaagagaacatcttctgaatatgtagataatcaaacacggagaagcccattttggagcatattattagtttaatttgagtgcagcaggcggccggcagagtcagttaaatcattccattagattgctgttatacttcctcaacctgtaaaccaaagttacagaaattgtcattccatactaacaggtttatgactcaagaggaaataatggagcacggttgctaaaagcaagtagcagtccagaatctggctgctagtgtaattgttgattttttttaataaaaaacatgcaagatcaatttccatccagattaattgtaggctgctggatcaaccattagtatgatggagataaataattgaaaatgtgtttttacacttacttacaaagtgtaatcacaaatgcaaatacctattctacaaaagccaaaaggtgttaatttcttttgtattatgaaaatgttatcgatgggatataactattaaaggaccttgagcaaaacttgaagacattgcaagagatacgcttcacatggtttatacaacatgcatgcttgacatttactttgtaactgatgaccaaatgttaattaccagccagcgaaatcaaagagggatctgaaagagatcttaactatattaaacgtgaagtcatttctatgttatattaaaatgcaagtattttgatggctatgtttgcaggataaagtagtttatcatgaagaacagaatcaaacatgaagttaaatgtatgacctgtggaagattcattaactccataacagccttctttggggttagttcattgtcaattatccgtgcaactgctgtcaagactggcatttttacatggtacttctgagccaatgcgatgacagccccagcagttgatacaccttcagcaacctatacagtgagatgaatatattaaaactatgtatggtggcaacattcatccaaaagttgattcaatagcaggaatgctccagacctgattcatagaattcatgatttcgtcaagtttttcaccagaaccaagacgcagtcccacatttctatttcgtgaaagattgacaaaacatgtaagcatgatgtcacctgagccagataaaccagaaagggttgttggctttgctcccatcttcggattgtttggaaaaaaaaagaaggaatcagtgaacttcataagttgatccttcaaagattacattctgatgataaaagtatctcacacctttgttgctaaccagcgtatttctgaacagccttgagcaacaagggccgccatacagttatttccaagatgcatgccttctactatacctgctgctattgcaagaacattcttaagtgcgccagcaatttctacacctgtaacatcactgaagcatcacaagtcacattcaagtattctttctcatgaatgcatagttaaattcaatgtacattatttttactaaactaagtgatagcccatgttgcttgtctgaattcctaaatccttacagaagagaagaaacagttcttggtctatacataaaagaattctcggttacatagtgatcagcatttatatatggccaatggttagtaatatttactttgatgtgcttatcctcaaattcggtgaggccaacagctgctgaacagcagctgccaactttttgtccttggatgccaccaccatagctgccatgtaaagtttaataactatgaggttccttccttcattgcaaataaaaacattccatgttctttatagaaagtaccagagctgggcatcctcacaattattaaacacaagcaaaacagaaaaaaaaaacatgaagtggtgccaattgacattgcatcctaaacaagctagagggagtatgacatagagaagattaaacttgtcaagaaatgatcttactaaacctgttggcaatttgttcatcagttcgattgcaaaagaaggtcctgacagaacaataaacggttggcggggattccccagcgcttgagggatgatttgagacattgtccgaagggtgttaagttcaagccctttgctaagcgatatgaacggcaacttcggatcaacatgtgttgaaataccctcgagaaatgatgaactgaactgccacaaaaagaaacctcaagagtcacaagagggaagggaacccccattgcactgaacaatgatttgtaatgaactgttctgaatacctgaactgggacagcatggaagcagaaatctgctcctgctaaagcatcactagcactagttgttgcagtgatattttctggtaacctgtggtctcgtaaatatttactgagacaaattgaagaagctgaaagttagattcagcaagaaatctaatcaccagaattagaatgatatgatattatttctcaaatgaatcaagaaatggggggcaatgagagattggagctgtacccaccagttgatgtggctgtggttgatggatcggcagacgaggtcgtcccggagcagcatggagacctcgaggtcggccttcttggccgccacctgcgccgccatggccgtcccgaacgagccccctccgagcaccaccaccttgcgcgtcgtctcgaccacgtcgctccggttgcgccgccgccaggaccgggaccaccggacgagcttctcccacgctttccgcaccacgcggcgccgctccttccctcctcctcctccgccgccccgcggggccgacaccgccgccgccgcctcctcaccggcgtcggccttctcctccgccgccgccaccgacagggcgccgtcgggagggccggagaacacgagggagagacggcggcgggtcggtgagtggacagcgacggcgaggcggcggcgcggggtgggcgtgtgggggaggaaggtggcggcggcggcggcggccatggatcggcgtcggagaagaagttttcgcggctcgggagatttgctatcttatccgttcccgcctttccctctcgctagatttcatcgagattcgtgctaaggggaagatactccctccgtactcgcgaagggagtagttttggacagcagagacattattcaaaacacaacttttacttcttatttctataaaaatatttattaaaaaataatatgtgtatacttttatgaaagtacttttcaagataaatctagtcatatagtttttacatttttaaacacaacaacttgaaagtaatttataatttatatttgtaaggtttgacttaaatattgtcctaaacaactttctttacaagtacgaagggagtatttcacatattcagattcgctcgattttttttgccgaaaattcggatgtccacaaaccgttcgatttgtgacaattttcaaataaatttcaaaattgatgtcattgcggttcgcatttaagccagaaacaattcagatctccacgcaaaccgtttggtttgtgtcaaaattcaaatgaatttcgagattacttcaatggggctggcagctcgcatttgagctcaaaaaggaaaaactgtaagccctagacgatcgaaatccaaagacaatttgataaattagtcgcatggtgtatcaaattgtcttcggagaaataaaatcgtctttgcaaacgtacttgtttccatgaaaatcgtaagattctctcatctcagcgtgatcacgcagtcctgcttagttgtccaaacatggtacacctatgcacagttggtgaaaatttccttgctgtaatatcaaataccatgcagacctcaccgaacaataaaaccaaactgaaaataaggggcaaacagatcctcagctcatgatgatttcagataaataaacagctgatccagcacagtaaacataaagttcagaggtccaaattgctcatatccccttggctcacaccacaaaaattttcttatctcctagcaagccacagaaccaagcaaaatataaaggaaagtacacaatgtcaagcacaagttctggatatcgggaacgctatatctagtgggacttgacatagtcctggactatgttgaggccctctgactcttcaccgaagtcctggtaaatgagaaagaacaagccaacattaccaaatgccgaagatggcaaaaagatatttgaagtagtatggtgggtaatcaattatctaccttgacaacgacgcaggagcagcctacgaccttcctcgccttgccctcagaatcaatcttgcaaagctgcaaacaacgtttgttgtgatattgttaaatcagaagatatgcagaaaggagagatgcagaacgatatcaacaacaaaatgaaattaaaatttagataaaggattacaaaattaaatagcacattttacactgagctggtaaaactgtagtcattagcagaaggctaaatcaaaaaatcttatccggcagcctagacatcagattaacacagtataacaattgacaaggtatagctaatagaagagtaatgtatctcacccctgcccactcgccaagagttttagcactaggcacggtaacgaggtgaacattgtgctcagcgcagagtgccttgaccaacttgacataatcaggctggtcacagtcctcagcaagcacgcaaagctgagcggcatgcttctcaatggccttggccgcctcacggagccccttcacgagcccatcatgagcgcttgacttcttcatcacaagctgcagagcagtcatcaggtccatcggctctccaagaaccggggcaggtggggcctcaactggagtctcttccctgcatggatgcttaatcttagtaaacaaggtagcaacacgttttccttttagttttgttctactggaaatgctctttagataattgagttccaagtaatttgacaatatatggtgctgcattctcaaaatagttagtaaacataagcaaaagtcaatttcccactgtattagcaatgacgtgcacaaagctaggtttttccgaattcaagcaaaacaaaacaattcgaggacaaatgtagaaaggagaactaataatatgcccccactcagccagaacaactcgcttaacgaacaaaaactaattcagcaagcattaagccttctttctatctggccgtatgttctatctgcttaatattaccatgtacaccctccgtcccaaaaatacaacttctggaaatgaatacggagaagcacatgtctagattcgtccccagaagtttggtctttttctgagtatgaaccagaaatctgcttgcaaaactatattacaggcataactaaagaattcctaaagcataaatttcaatcccatccatggcagctcacgctttcgctaaaatacgagccacatgagcatgacagctttccaatcgcacaacattacagacaagctgaagactcgccgggttcttgaatcaattcgtcaaaacaagccgcgaccctcacaattccaaaacaaaaaaacagaacacgaacagcaagggcatgatcccgcaaaaccgctaggagcacaacccatttctcaggcgccatccatcagcagccagaccaacagaaaaaaatatatcaactatgaagcgagtgggggcgccgagatttcggtgcggggggaaacttacgccatgtctcctgcgctagaaagacccgaggggccgacagcgacgacgacgggagggatctgcggaaacgaaagagaaatacaattagaagcaaaacgggagggaagcagatgcaaggaagaagaacaagggggaagggcagcgccgccaccttgggagagcggcggcggcggaggaggaggagggttagggttttcgcgaggagggcaggtggggaagaggcgggtgggagaatggtggggtttatatggctctctcgtgtcgggcctagatgggccttgatctcccgcttctgggcttcactacgaataagtttacttttactcccttaactagtgaccggat

SEQ ID NO: 41196 - DNA, 5917 bp, Oryza sativa
  unsure (1)..(5917): unsure at all n locations
cgatatcttaacccccaactattaaaacaggtgtaatttaactccctcgaggtcttggagggtgtttttgctgacgtgacccctatgtggcagtgttgacatggtcttcgtttcacgtggtgttaatgtgacgcttatgtggcattggaattaaaaaaaatatatgtgaacccatttatcatgaacacaaaaatattaagcgccatagtatggacgtgtctcgaccccgcgtcgcccatgcgcgggccgctggggggaaagcctagcgccgccgcctcccctctctcctcctctccctcccctcgccaccgctggagaaccgagcggccagccgggatgacggcgcgtgaggccaaatctcggtggcacccccgtctctgcacgtggaaggcgggctggcgcacagagcagaggttgacgacgcagcgtggaggcgtcgtatccgacgccaccgcggccagatccggtccccccgtgggtggatctggtacctctgcgcgcggatctgaccggtgcaagccgctcaagcagcgacgacgggaggcggaggcagcgacttttggcggtggacgacggccggtaaaggaggccgacgagcgtagaagccgcggtggctcgtgcgcaaggctcagccgatgacggcagatgactgcacgacacaaggtggagcggccgggggcggtggtggtgcctgatagcggtggtgacgctcccgatggtcggcggcggtcggcgaggtgatggctgcggtgaggaggacggaggctgccgtggtgagaggacgaggcgacgggcagcttggtcgaggcggcggcgatggttgcgctatgagggggtgttgaaacctgtggcgagcttccttccaggcgtatgtcctcttgcggcggcggcttgccgccataagatggctacgctggacaggctagtgcagggagaagggatccattcttctctatcatcctcttcctctccaacccaaccacgtggatggatttgaagcgcgacgagggttgagattcttctttgatggtcggcctgcgacgcggtggttgcacgtcgaaggagattagctggtggttttgctgaatctagcatgcactctttagcgtgggtgagtagaacaatgggcaaaggcctagcctttgggtcagcaatggcgacacctgcgggtgccgttttccgttttccccttggggcttgctgcgttttctatcatttcccaataggttcctcgagctacctctcttcgcggccggtggggttgaggggactctcgctggccacctcacactgccaactaccaagcataagatgagaaagagagaagaaagagagggagagaagagtaattaacacatgggtcccatatactgactcagtaagttaaaactaagtcaacgagccatgtcaggaaaaaagaacaattgaaggatagtcaagcctataatttttttcatttttaaatttttattttttaatatttatagaaatattgtaccggcgaaaatatttacagaagtagaccctgccgccctcggcagggtaacgtgagggacggataaaatgaaaaaaaaactagaaaaatgcatttttggcggggtgaaaattgcatttgcccccttgcagcccttgcagagagtggcaagggacctcagtgcaaaatgcgcacaccttgccctcctccaattgggcggaaggggccatttctataaatattttggatagtccgtaaatattaaaaaataaaaatttaaaaatgaaaaaaaattcgtcaggcctatatttctggcccgagtgactggactctccccgcctcggcccatcaatgttctcccgtacgccgtgcccagcccaaccgcggctcaggacgacgctagctcctcgccggcggcgactcagttcgctcgaccgggacgggacgacggctcccctctcccgcgaagctcgccgacggcgacggcgaccgccacatctcgtccatgcgcagctccggtcggaggtacccttctccccgacctctaacaacgagcctcctcctgccactggaatccgtctgtcttggatacgccggtgtttttttacgtcttcttcttctgcagattcctgcctttcagcttcagtcactccatgaagcacacaggtttgctgtttcgtccttttcaaatccccttttccatgctaaatcatcctatgtccttgttcatttatcttaatcctgtttttttcctactatgtaaaattcaatcagattggagatccaccagccctgctgtgtgatgtttgtctcccccactcatcagtttttgatgcgtgtgctcatccgtcaacgactcaacggtatgcacctaaatactttcaattttttttagagcaaagcatgatttctgttttgttctacaatgcttatcagaatagtactagtttttatgatagtgaaatcaagtagcacattagcactgtgtattttctatgttgcaaaactgctctgttcctgatgggaaatcaatttcctagttattcaatttcaatatattttcaatacttttagcacagttagtttgtcatttttaactgccattcttaactagatatcccccagcaacatgcggggttgcatccagtataagttaaaaagccaaagccctaacaaatagaatatgctcattggagatattaaaaatacacaagccactcttgtattaatatgcttcttggagatattgcaaatatttttggcatttctaagatgtacaaatatctctcgaatatcataaaaactctatgtattggtagtcacttggcccttttcttttggatcaaggatatcccactttcactggaagcaaatattgcatcattcaaacaaaaagaaggaaacaagaacaggatgtggtcccaccagctgtatatcaaaagcacaaatcacaccccaaaacaatataagtttgtgcagttttgcgagcaaacgaaaattgtgacttgtattttctccatctcctccttaccagatcctattctccagctgcattgcagggtctgtcccagtaggcttgccacatgtacatcttgattttcattgttatcttagctcctccagaatctctccttctccctgcttctcatgcgcataaaaacatgtgccaccctcttttgaaatggatgatttttttataggatttgaactaaatcctccaaaaatcatgtaaaattcttgcgttcgaaaagagcccttagcccttttccgaagagcccattttgcatctgtcctcaacaggatttggccaacaattttcaatcagatcaaatagctgatagttctctccagcttaacagatcaaggaggttgaaaacgctaatccttgatccaagaaatgagaccttctgaagccaaatctcccaaacaccaaagctgcaacagttcttttctctattaagaatttattgcatatgtcaaaaatgtaacggtgcctatgtttgagaggcacgcccctaaccatgtgtcatgccagaacagaacataatcatttcgtcttacactaatttgtttgatttgaggaacagaataggctggtctatcaccaatgacatttgcttaccctctgcacacaaacgagagagacatatgtatattccagaacaaggcgtcaggagtgcatcaagtttttataatcatgaaaggcaatgtcaatcaatggaagtatagcaaatctgaagcgggtaagaaaaatggttagtaaaacaatcaaatcaaaacccaatacatgctgaaagcatgtatgggaaggaatgacgtagatttgatgcagatcaatcttgtcttaatattcctttaactactgtatacacgtgacgagataagtcagcatacacagaaacaaaatcaagggatggatgattgtgatgatcattagctgccttcctgatagcggcttcagcttcctgaatctcctctcctgaggtttcaaatctatccaagtccacaaaaatattccggagagaagggaggttcaccagtccaaaatcaatttcaccgtagacatcaatagtctcccacaccgaaaactgaaggcaaatcctttgaagctcttgcatagcccttggttcaaaagagaggcacattctatgacagtaaaagtgaaattcttgtagacaacggaatgcacatgtgcctctgtgaacaatgagccttctcttcttacgttcaacatctatcacttccactacattagatgcaaatatcctgagaaactgtagagagggaagctctgcgagagtcacaaggtactcctgctccatataattgttcagattgatggataagatggtgaggcaggagagtgaggaattaacccatcgagggaatcccctatagaatgggccactgctcataaacctttggagacagcaaggaacttgttgcatgaaatctaggccgtaaaggcctggggatctagtgtgaggttctgcaaacttttgtgcctacttaggctgtcggcaaagcatccctgaagatctcacaatcctcttctgaagaaagcataagattcagaatcctaaggcctgttagatcacacacctcttgcagtaagttttcagtgagaccggcgcatgtcagctcttgtagagatgtcatattccctagggtcaaaccatctgccagactaactttgtgagcaatcagccggactaactgtcgtaatctgacaaaagaaggtggtaactgaatcactgagcgagtatctcttatgtccaaagtctgtagaacctgcagattcccaatacactcggggagtttactgatattccctagccgcaggaaccttaggtgatgcaactttgcgagatcattgagatgattgtcctctagattcgaacaatcatccagtcgtaacacacgaagaacacgaaagatcattagaggtggtatggatttgacactgttgaagacagtaaaagacctcactctggacaagctctctctagcttctgctgtggcatatgtattggtggtatagtatgttccatgaagaaaggaatcgttgtctctgtaattgtaagatagtcggcgaactttcttttgaacagacggtaccagtataccttctttttcactatctaatggcattgctgcaacaaatccttcttcagcagataactgatttgtgaactcaagcaccatgtcatgtacttgacaagcatgcacctgaccatcgttttcacaaatgcggccaatatctactggttggataaggcttttattcaggagctcattgaagtaattttctccaatctcctgtaagcttctcccatgttctccctcgttggtaataaaaccctctgctatccaactccaaatcaaaatatccttcgcgataatcgcatcctcgggatatttgcttagatacaataagcaagtcttcagatgtggaggtaggtcatagtaactaagactcagtattttcctcatgttgtccacatcaaggtatttccaagtccaaagcctatagaattatttaccttctcccattcctgaatttgcatcggtttactggctaataaacttgctatagtaattatagctaatggtaaaccaccacatttatttaaaatacttctggtgacttcactcaattccggagcgaacctgtcttcagtgtcaaatactctcttgctgagcaacttgtaggagtcgtcataagaaagaggttttagttcataaacagcaccaccgacacgttctgcaacagccatttttcgggtggttgtgattattttgcttccatgatcaccatctagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgcaggaa

SEQ ID NO: 41197 - DNA, 7530 bp, Oryza sativa
  unsure (1)..(7530): unsure at all n locations
tggaccaaccaagtcttggaaaccatagagctctgaagtagtctagaaaaccagcacaatcaacaaaatcttccagaaaggcttcaaataattccatgccaccatttcctctgcagatattgcagattaactccccaagtcgtttagccatcatcggacgcttctcaatatctgggcacttcttcattaaatttttatgccaagcatgccttatgcgccatgggctaatcagcacagggcactggaatacttccctgttcagcatgctattacactcaggaactgcaaccccagaaagcgtatagtaatgcactagattaaaatagaaaagcatcatttaccttatcgtgcgcacatctgcaaagggatcatcaataataaagccacccaactgccatgttggatcttttgtacgaactcgatcataaagggcacccatccatctatatgcttcaccatgtgaaaaattcggagttatgatccaagcaacaggaattgcatttttctgcttgtcgaaaacaaggaggctatgtacaggatactgcaaaatggtaaatagaaatgctaccatgaaatcaagcaaaccttaaagcactactggaacaaaaatgaaacaactgtcattgacaaacctttaatttgtttgttccaaactttgaatcagaagccaataaactacggttgccatactgaatcatctgctggagctgccaatctgtctggatgcccacgataaaggtgtccttatctgaaaagtcctcatacaaaaatatatggttttggtgattttcaacccatatgttaatgcttatagcatcatcgtcatcaagttcgtaaacagaacgacgaattttcctttccaacctcctaacatatctgtgagtaagaagaccatctcggtttgatggtcctccttgcttttcgatcatttctgtatgtctctgcattatggtctccactggaataccaacacagagcaaagacataatctgaagacgaagttcatctgatatgtaaggcgcaaacatggccttcgtcccaatagccatattgtccatgggaccatggcagggcttccctatcttatctacatgcttatcatggttatatatcacaagagcgacagatggttcagcaatcaaacgcttcacaataaaatggcaaatacagcccctctttgtatgaggacgaccagcaggtgttttcctctttgttgaagagttcctgctagggcggacagagccaccctttctataatcatctggaccaaaagaacaccaatacctgaaattaatggtatcatgaggttcaaaagcttaatgtaaattataacctatttaacagagcatatctaatgttaagagacataaatagaaggagcattatcagccatttaaaagataagatcgatttaacaaatagcaataataaatttgttctagtttacaagatgaataagaagcccaggttcacattccagtttaaaaattagtcggacagaaatgcataatgcttacatttacttacagaatatactcgagtatcccatcaacttttggtttgcagttcattgttggtggacgccttcgccgtgcttctacatgaaatcttgttgggcactctttgttgtttgattctcctctaacaaaatcattcacccttgaaaatggaataagcgcaagcctgtccattgagtccttccatccctccaccctggaccacatgatatctgatgccgaaaactctggcgtgggtggattctgaactggaagagtcaaaatttcatcccacctagccatctgcatttgcataggaatcatcacaaataatcaacgaaatcaaagccaaagtagcatatatttttttaagaaaaaaaaaagctatggtctgtgcaaagaggacagcatagacaaacaaaaaaaagagcatatatttgtaagacagttacacctaaaccaagtgtcatgttatgccttcgaaaatttaaacattagtgttgttcacatcacatgattaaaaacaaatacttgcagttgaatcgaaaagagcatatccacaatctcagtaggtgattcaagcaccccaagacaaggggaagttcgcattagattttgtggtatgctaagactgttagacatgaatcagcggtatcctttccacgttcatccttttctaagaacccataagtaaaccttcttttttctcaagccgggcattcgataacttgcattctggttgcaagagtgctgtaacagcattactacctctgaatgaatcaactcgctagcaaaccagacatttctaagcaatcccctcacccaagaacctgcaccgttggctacacttgttcaagtcctaaccctcctcaaactcccccatattggcctacgcacgccttaacccttctccaaaactcaccaatcgcgcaagtcaatggtgacgacgcacgcaagccaactaaaacctagtatatgctctacgatattgcagcggaaatattccaattccactggaatggattctttttgggaagctgacacagaagcccccagatctacaagagaagctagttctatgggtagagggaggggatagtgtggaggtaggtatgggtgctcaccggtggcggcggcggcggcggcggcggtggcgctgctcccttcgctggatggaggcggtggagacgggaaggccgtggggacggggagatcgactggctagggcgcacgcacgctgaggctcgaggcccaatcacatgtgtatgggcttttcctgtttccaagggaggctaaatagacttattcattgctgatggaccatgggaccaggctgaaaaatagactgccggtccttagagttagagcgtggtgtcacttagttccatggtcttgtaaaatcgacgttaagacccatgaacttgtttaagtgaatcattgcggttcaaagcagtctgaccagaatttccgtcttgcgtggttctccatcgtggccgcatatttgcaattaggtccctccacgcccgttccacccctcctccccaaatcttaagggctggcgccaccgcctgcagcagcctacgattgccgacgcccaattgccgtgttggagagctggccaccgctagctcaagtgcttgtagacgagatagccatatggctaccaagctcatccccaaccatcgtcaacgagctagccctgcccgcgggccgctgggtatgaggtcgacgaggtggccgtcgggagctcgatagtgaatcaggagtcgtgtccacggcgtggcatcagacgagccggccaagagccagaacggtgagggaggcagcagcgaccgacgacttagaggtggagaagcggaatccccagcgcgaactcgccgctcgtggccatggctcgccatcattgaggccaccacctggcagatgacagcgacggacggatcaggcgagggagagggatgcagatgagatgtgcagtgcggaggccctccccttccccttgtgccatctcccatctcatccgccaaattggctagctcagctccaggccccagctgtcgtcgtcgaggccctccgctttacaccatctcctccaccactccggctagctccaccccagccatcatcgtcgaggccctctattttccatctcctctgccgctccggctagctcctccctagcagccttcgtcgacctccttcactttcccccatctcactgttgttcctgctagcttcgtcgttgtcgtcttcatcggcgagccaaggtcgtgaagcgagcacctcgtgcggtagcaattagcagacacaatgagaagaagaaaggaaaataaaaaggggaagacttgggggaggagggatggattggccgcagaggggcttaaatgcaaatatagggccacactagacagccacgtaggacgatcaacccggtcaaacgtgttttggatgtaatgattcacttaaacaacccgatcagacaaggtttacgtcaattttacaagatcgttgacctaagtgacaccatgtttcaactttaaggatcggcggtgtattttactaagaaaacaagtaacggtaagttggtaaacggacttgcccaaaatagtctaatgggaaattcactttatcgaaggctttacttctggtccattcactttatcccatttggacatgtcatcgcaggccagatattaaatttgtattctctagaagatgcctctaaaatgtaacatattggaagaaccgactgagcagatattctctcactcctgaagcatgatatatacaacggatgctcgtgagatcccccatcttttgcagtcacaatttttagcattaatgtcaaacaatgtacttagaattcatatgttctacctaaaaatagtacctttttctagctagcaaagcataacatgtgttcaccatatctgtattcttcaacaccttcttcctcatcttggggcatataggctattgctattgctttgccatttctttatgcttattgtattacctactcatcagttgacctttgattctttctagcattttgaggattggtaagtctctagcctctgagatgtacttgctgaatgcttcacaattattgttcagtaagatgtcacacatagggaactcaccgaaacacactctgaccttgcggaggcgaaatcgaagtattcataaatctcccatggcacaccacaagtccacaacctcctgagcgctcaccgctgactcttagccatataggatactttctccaagagtaacaaacacagtcgattatttgcttactataaactctcaagtgctcaaatggatggagtgtatctctcttgttctcaatccaactctttcctcttctcaaatccttctcatagaaagctactccaaggtaaggggatgaggaaatactatttagttttggatataactcacttttgcaaacccccccccccaaccagtagaaaagaaaggatgagggatttaaacaacatatccagatttttgccattgggataaaaagattacaacatcataaattctgatgtggacatcagaacttccggtcatttcaaaaagaaaaacctaacagtaacaacacacatgctttgacctaggattttacacataagaaattctgatgcacaaattaaaacttccgataatttgaagccatccaaactgagagcaagaactttggagatatcaaacattttaatactcaaaaatctagatattcacattgaaaaatctattcataaaccttgaacacaacccaaaagcttaactttgaagaaaaaagggacattccattaaactgccacataagagcttctagtattactcaaaccataatgacttgctttgaagtctgtttttaatgatcgtgaactttatagaaagctcactcagagggttacccggccaaactaaaacacaaggtctaaaatcacttgaacgatacggcaatacttgagtttctctcaacaagcacttcgatagatcattttgagtaccaagacatatacaaacacatcaatgattgcacccctcttaataggtattcatatattcaaatgtaaatagaaaaaaaaaatataccaatagaaatacattaatgtttatttgtcaataccaaaaccatttcttctttcatacttaaaatgattgatgtggagtactcatagattcaaaatttcaaatggctttatacggtccatcatgacaaaatcatcccttgcccttcaagatcgtttggtccatcgcagctgagtattgcattccctttacctgtctcgccatagatattcactttgttcttcgcatttccaatattttcactttgtaattttgttcatcaatttgaattttccatttcactttgtttttgttgattgatagtttgaaatccatcttctagatcttcatctattctcttgacagcaagcttgatcatgaattgagaaaattttatctttcacaccattttcttcttgatcatgcttctcttctcatgaagtaacttgaaaaccaatggctgatgtctaccttgaagttcttcgtagagcatcttaattgtcatcaacttcacatatggtatttgttggcagttgttaaacaccattttgaccccaagcttcggcaatagaatgggtgaaacaatgttcaattcatccatttactttagattaatgaatcaccatgagctttattgttcgttacttcgttagttattttgtaggtactatccaaataaagatgaaatgtggaatttcaaatgtttgaccaaatcttgtcctaaatgacgtatgtttagtgacaattttgttcgttggggtcactcttcaacagtgagatcttattaaccttgcctttaagactttggtccagcttttaatttttttttgatacaaagtataatataaattattaatattggtttgaataaagtatattgtatagctaagtgataatttcacggaaacataaccctagcatctaagtgcaataaatacaatcaattaaattcagttgtaacatgttacaaccttaacaatcgaaccgcctctaacaccacgatataatcggtccaatcgtaagattcaataacaacattactaataaaaaaaagttaacgcgtgtagttacaatacaaatagatagcaaaaaaatccatgcagtaaagaagtaaacatcaatcgtcactaacaccacaaaaccacaatacaaccagttcgatcatagaattaaataacgacatcactacttttaaaaagaatataagaagtaatatgtttaaatagataccactaaaaattatagtatgtaaataaagagctaagcaccaaaattaacagctattgttgcctccaatccattaaccacttgccatctatagatggctgtctccagccacaccagtgaccagccaagcaaaacacagcttttgcttgattacttccttccagaaacggcagcccaggcttcgttcaaactcactcacagctaagcctttccttaaccccgtttgaatttccgagcttgcgtcgaatattccggatgcccatccccaccaccaagggcaccctcgtcatttccccatcccccaccccgaccgaatatgccccgcgcggcggtcgccccgccacgtggacgcgcccccacccgacgaacgagattcctcgcgggtgcccccggccgcgtaattaccaaactacccattctactattccgcttttataatatagctgcctcttcgtcttcttcttccccaatttccccttctcctctccttctcttcccgctttgcttcccaatttctccacgccaccgagcaattcgtgagagggagaagggatcggaaaccctaaccctagcggtgggagccgccatggatgcgcggatgcggtgagcgggggtggttttcttggtgggtgaggcgaggtggttgggggtatgggtggggggaggaggaggaggagcgcggngatggcgatggagggggaggtggagggtggtgggagga

SEQ ID NO: 41198 - DNA, 1097 bp, Oryza sativa
  unsure (1)..(1097): unsure at all n locations
cctgcttccgcctccgcggcccgggcgccgccctcaacctcccctcccgccgntgcgtcgctcccgctccgcctccaccgcctcctccgccgccgccgacggccgaggagaagaagctgctgctgttcccgccgccgctgcctccgaggaagaaggcgatgctattcccgctgccgctgccgccgaggaagaagccgctgctgtacccgccgccgctgccgccgaagaagaagccgctaccaccaccatcaccaccgccacagccgccgctgccggagaaggagaacaccccgctcccgccgctgctgctgcctccaaagaagaagccgcttccgccgccgtcaccgacagcggcagcgaaggaggagcccatcgagctcgagcatgcggcgccgccgccgcctttcgtgccccggccggtgtggcccctcctggccagcggcggcggcgggaagcggaagaagcagtcgggctgcggcggccgcatccccgccctcaacaccgccgccgccgccgtcgaggagaccggccgcgcctgatcctcctccccggcgacatggatgccaccaaaaaaaaactaaaaaaaataaaaaaaaacaaataacaccaaccatcctaatgtgaaaagcttagtggatcattccttttgatgtgattcgatgatgctgttaatctaaatctgatctgatgcgattatcttctttttttattttttgtacatacatatgctttgcttctcctgcattaggatcttgggagaaactcaaaaactgatctgtaatattttctgtaatatcatctcgtctcatgtagttgtgacattgtggtgttgacattgtaacgaatcggtcgattcgaagagaacttgtggaaaaagaatcgagtcaagattgattcaaagcctggtttcgtttcgtttcttggatgttgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41199 - DNA, 3318 bp, Oryza sativa
  unsure (1)..(3318): unsure at all n locations
tgagaaaatcgagtgagagataagaaaaaatctttcgagtgagatatagcaaaatcgaatttgtatctatgtcaaagcattattactcatgtagtctgactgaaaagcaacaattaattcgaataattcttgcatcatgcaacagaagttatttcatacaatagaggtttaaaaaagtatcttgcttcattccgaaacagcactgttgtattgcttcataagttgttggacgacatctgggagtgtagccgcattagtcttcattgccattatatccatcacatgcctgctctgatattgtcaatggatacctaagattcataaaataagtaattttgttagtagaataacaagttggcgcgagaaggtaaaattgtacttgaaaccaaattgaaagagcccaacatgtaatatgtaattaaaaataattaccggattaagtcctcccacacaccagaattcattcgagttcttcgtatacatcagagttgtgtatatatccgttaggcaccaaaaaaacgtaaaggtatattctaagtaaattcaattcaagtgtgtattaatttatacccgggtataaattaatacacacttgaattgaatttatttagaatatacatcggaggaacatttttgcaattgttcacttgtcaaaattaaacaattttgctcttgggtaccagctggcgattcaacatgggtttggttagtaaaatactgtggaaaaaaaagggaaaatcatatacatacgcacgggagtactgcatgtcaacttaaactatacgaacgataaattctgggatctagacttttcacatacctacggttagtgccaaacctcacggatgacgggcagcgatggggaggaggcacgccgcacgcggacgtcctgcgctgtaacgaaggttgcggaggtctgtctgccaacaagaacctcatggacgaacgccgtccgtgtaacgaaactcatggacaaccagcggcagcgacgaagaagcttgtggccgtccggcttcgttacggcgtggtgacgagaatgtcnnnnnnnnnnnnnnnnnnnnnnnnnnnccagcagcaacgacgaaagagctcgcggacaatggtgtaccagtgtggccaagaaaaccgtgaacatgaaaaatggaatactatcactgggcatatgtatctgcatagaaaatggaaggataataatagcaattagcgggcatgaattaatattgcaaacaaaatcatgagtatatgcatgtgaatcatgagtcttattgggttaaacccgctaatagattataataccgtgttttgagtatgcacggatcttaaagcaagcgaacggtggatggcattggagtatgggcaccatggagcccctaacaaatttactacatacatatacatacatatatatatatatatatatacatatatatatacatatatatatatatacatatatatatatatatacgtatatacatatatatatatatatatacatacatacatacatacatatatacatatatacatatatatacatacatacatatatatatatacatatatatatatatggtaagactattctacacgaatagcggccaaacctatctcccacattagtcaaagcgcttccacgtcggttaaatctcgggtcaaacccacctgtggcttcttccatcacccaccctttctcagctctcgtctcacagatacggtgcagtaatgtgacggtcattgtgtagtaacgccgcagtttacgtgtgaaagtgcattaatccccctagtgggttttggtgattaatgacaaatgtggttaagggactaatgagttcattgaatgactttcaggtgcattagtccaaggtgtggaagatggatgcttggagaccccccaaaagtacaaaatcaaagcggaccggaactcgagaagtgcataggatagtttattttttgaaatcgagtttttaggaaaaaccgtactattaagaggggttccaggtgatgctctgagatatgtcaagtgctcttagtgtgaaccaagtgtcaagtttccctaggagtcatttttgcaaatactccatctgtccaaaagtgcaagtccagaacttcctgtcttccaggtccaaaagttccggtcttgtgaaaaagtttttcctaagtgtagtccggaagttcctgtcttccaggtccggaacttcctgtctagtttccagttcaaaattgtgagtaacggctagatgacgtcacctagccgttatacatatacagctcgtttccagctcattctttggctattccacttttacttttcgaacctagagttgttgctagcctctcccaagtgttttttttttgccttctccactcaatctagagcctaattcttgtgagaaagagagattgagagggagagaagaagatttggagatgtgtgaagactaggatcttgggtgagcacttggaatatctcgtgggctgcatctcggttcttattactcttggagatgatctcctagacagttaggtgtcgcccgtgagaatccgttgcatattgtggatgtcccgggtaagtttgtgaaggatctcctctcctccgaaagggaacgagttaagttaatgaagttcttgtgctaagattctagaggttttccaagtagagtaacctatacttgtggcagatttctagaagtaggttgagttggatcttggtggtcactcaattctagaaatttgcctaggagtgtttagggttgaaggctatggatttcctctagggtttttgcacaaatgaggcaaggggttaatcgagacccagctctttggagctcctcaacagagagtaggatcgcaagatccgaatttcgggaaaaaatcgcccttgtctatttctgtgatgtttctgtggatgattctgtgatctatcctctacttagaatacctgtgctctttcttgtgaagattggcttagtctcctgtttcgaaatttgaatttcatctctgttctgttacccggaagttcctgtcctagaacattggaagttccgggcctggaaggccggaagttccggagttccttaccaggaagttccgggtctgtttaaattttaccgctgcgatttgtttttaagttttcagggacagcctattcaccccccctctaggctcatcagcgcgttcaacgtgcagtaacaacactaaaatatagttcaaatatagtcacgacggatctacttttgacaagtactttttttctagcatcatagtgcaaatgatttcaaaaaataatgcatattttgcgagatattgctcttcaaa

SEQ ID NO: 41200 - DNA, 36943 bp, Oryza sativa
agtaggtatggcacatttgagatattttttcacttttttgggtgaacagtacatatgtacgtgtaactcgtaacaattaggtgggaccgtggtagggctaatctttttttttcaatcgtaattacatatttttcctttttttaagtgagtagcaaagtacggaagtacgtatatatacgtacaactattcacgcggttttttttattcgagcaggttagatgtattttaaataaatctaatctaataatttaaaaatagtaggtccaccaataaaaatgattgcatgtttttttctcacaattcataaggttttctctaatttattagagcaccacgtggtggatagaaccgatcgtaggagcgccacatagctagatttttagtctctaaagttacctattgtatgtcgatccgatgtatcatgatgtatttaagaccacaacattacttttatataccgatatttatataatttaacgaatacaatggatcataaattgggcatataattaaaaataatttaaaacataatgcgtagagaccgttgatttgatatttgatatttatattatagatatagtttacaagcctatacttccatatattatgtaatattatattttatattatacaaagtcctacattagatcttcgttttttccaagggtactaactacacatttttttggctttattattttttatcgtacatagatgtttatttctttttcttccgcctaacagcaggaagctttatttttttttttcaattatacttgcgtagggacaccagttgcattttttttttaggaaaaactatcacctttttaataatagatctaatctaatggtctaaattaacgggtctatcaatttaagtgaaaatcaacggtgagattagatagtgccacgtggcggcctaggagtgtttgtaggagcgctatgtggcagcttatgagcgtttgtaggaagtttaatggatttttagtatataatagatttactttctatgtaggcatgctagctaggtgtggtatattgaggttacttatctatttagtacaaattaaattattttgagaagaatgaggtacgcatatatagctccctcttctagggttacgtacaatggttgtgtcccctttccaagagagtacaggataactttgaataaattgccttttcctatggacacatcacacttgtgcctcttgaaaagacagaaatcaccttttaatttgccagatgaactgacatgaaaaagagatgtttaaagcacctgttggctgttagctagtctggaactgatttaagcacaacgtactgctcaaggtgcttagactgcatgattcaaactttcttttctttggtatcagagaattattcttctggttgtagatcacacgtgaataattggcattaggggaaaaaccgtcactatatatccaaattagggctagctcgtgttcctataccggcctatgtgcaaaccaacaaatcacgaaatggtgcatatatactatagtgcgtagaactgcatgctaattttgtgtgcatgatggtttgccacaggctcaaattatgagctagctgttagtttcaccagatttatctgttacagaaagtacagatactctcatgttgcagtgcatttggaaattagaacaacaaagaaaacgacaactgactaacccctagcttatagtgctcaagttcaaccatctagggcatgatttccatggctgacatctaatatgctccctgcatatgtgttcttatgagatgttacagtagctatcagcttacaattaagctagattgaaactgcagattgtgttgctaagcagcaggattctaaacttatcacaacacgtgctgactactccctttgaagagctatagcaagttaattagcaacacgcggttattattactggacgtgagagcattgaatcaggatgagtagttaattatattacctcagtcggtcagttccatgctccctgtgtattgtacttggggaacgggactcgccttgcctcaatcagcttgatatcgtccacgaggatctcgaagtggaggcgcacctcgtcggctgtcttggtgccccccatggcgcgggacaccttgtgccagagatcaggcgcgccctcgccgtagtaggcaatggcctgctcgaacagcttgttctcctctttgctccactctgacgccatgttgctgttgcgggacgagctacgtgacccagcagaagacatcctgcagcttggatttgattaaactagctagctactgtcttctttggaagttgaacgctaagtaacttgctaactagtgtgcagctagactgaagttttttttggacttcagaagagatctatcgatctctgctgtgttttgatatgatatctgttgtgctccggtggcggctatttatagggcatcggctgtactcgtgttcataagtgtgtggttgtgtgagctctactgtacacacttgttattggcttggaagattgagaggtgagtgagattctgatgctctctgttgaggacccacaagaagggaagggtgtatatcgtatctcggtcgattccaagatggcaagatataagtgctttctttcaaatgtagattctgatgttgcataatgtcaatatctcaaatacatgcccatcgaataaaaatgtcaaattcatcatgatgcatcgatctacaggtataattgtggcaatggagatgcttctgtctgcaccctctccctgcataggagggagacatttgttggacctgcacgcatgtgcccactaggcatcatgaaatgccatgcgtgcaattatatatcatccgggctcagcatgcatatataatgctcctcattctgagttactggggatatgcttcacaaggaccgaggttcatgcacctatatcagcagtgtgttactattggtggtgatagagtaatagagttactacctccgtcccatacttgtctttttaagtttttgtttatagttttttgatcattcgtcttattcaaaaaattttgaaattattatttattttgtttgtcaattgctttattatcaaaagtactttacatatgacttatctttttttatatttacactaatttttcaaataaaacgaatggtcaaacgttgaaagtacaaagtcaaaaacgtccactgtactgggacggagggagtacaaaatactatttttttctgcgattactgcacttgtaattaataagttactcattttagatttcttgttactgacttgtatatgtttcctaaaagacttaaacaagcagctgctggggcagtcttcttactaaatgaatggtttataattatgtatatataagttcttactatacgatttccggtatttactgttatatggagtatttgtttagacgcgtgcattcaattcgtatgctgctgcgccggatctctgagaaaatgaaattcttttagccgtatcggctgaatacaagctgacagattgtattaagatgggaagaaaatgccgtttgcaactttatatttaattaaggctagattaatttagcattggcaacttttttcatagatgcaggtggatagcaactaaatatgctggagcagatgacatgaaatcttttagaacaataagcagatggcctacttgcaaaactaaacactgatataaatgcaatcttaaaccaatcttagctagtcttgaaatatgtagtagcaggttgggtaacctacaggaactcttctgtgctctcaagttcaatccatctgggctgcaccacacgacacgagattagtagaatatgtaccaaagcatgggttgaacaaggtttggagccctttctggaccaaagaaatgaaagaataagtatatctccggttggctgccaggacctcggaagatggaattggattttgttctttggtccttaccgcacaatagtaatcatttttaaatctttaatctgcattttatagtctccctaaattgtatttgtatttctagattaactctcatcggaatattaaattatctctccaattttaaacccaaaattaagtgtttttggcaccttgtatttacacgacactcttctttaactctttttaattaaaatcccgatttttaaataaatattataaatggtatttctccacggacaattttttttctaaataatactctccaaagagctatctcttctaataataattacccaaaatttaaaatatttggatataaggcttcaagggggcctctctctctctcaaaaaaaaaaaaaaaaaaaatggttaatttaagcccaagtttaaaaaaatttcaaattggactcctacatgaattcttttctccataaaaaattatttttaatgtaaacactagctacttctaaattgtatttctacgtggactctttctcttaatattacttgtttttatccaagctttagattttttcctaaattgtatttttctatatgtagtcttatcacaatattaattatttcttatttttaatacatttcagtattttctaaattgtattgtacatgtactctatttttttatttcaattaatgtacgaatttctaagacgtaagagcaaacgtggtatactttcttatatttttttattaagttaatagattatattcttcttggaaggtaggctggtttaaatgattaggactattgaatgtcggatgcactctgcctaccaactttcaagccatttttttgtgctccaatattcaccaattttaaaaggaatgcatatgtacaattttaataggtaagtgtataaactcctaccggttataaatactttgatcataaattttatatgaaaataaatttataaaatataataggtttacaaaattatgtagcatttttataagatgtatatgtgtataacaatttcagtataaaagttttaaaattttaaccaactatctcaagttctcaatgtcaaatacttacgacaggagtagtagttattccaagtataactccaaaatgtaaccttcaccttttttcttaaggacggccaaaagctttaatgtcacttttatattgatagagaaggaggaaaaaaaccgtcaacacgaaggcccctctttgattcaaaggaaattcataggaattttaaagaattttatttctataggaatttttcctaaatagccctttgaatcaaaggaatgaatcctatgtaatcccatgaaatttctatggaatgcctcttcccagcaagttttggaggaaatttaacatgaggttcctcatgttaagaatttgagtcttttatctctcctcaaattcctatgtttttcttccggctcaataaaacggtcattcctatgtttttcctgtattttgcaatcctctgttttacatttgtattcctgtcaagattatatgtttttccaattcctccgttttttcattcctgtgattctaaggggcccgaaatatttactaggtctatgttaaaacaacacaaacccacaaaaagaacaatggggactactctccggaggggataatctctgtgagctttgtagccccctcctcgatcaaagtttatgcctcgttgatcttggtgatgatggtggttggcatggttgctatatgccacacaaatcctgacgtttctttcacaccagagctcccaggccaccaggataatgatcaattttagggccttcctcagggtgtgaggtactgaggttactatgagattttgtaccaccaatcctccatatatagatgagcaagcttcccacaatcccactcctgtaactagaggtccacagttgtctatctctatctctgcccagatccttttgggcagcccacgctttgccagcaggtgtaatgctgattcggtcgaggcgtggcatggagggcaaagctgctggttcatccatcccctcttttgaagtttgcttgttttggattgttagccatagctaggaagatagaccgcgcatatgcgcggacacatatttaatattgcttgaatttttttatgaatgtttatatgtagatgatatttttaaaatagatcttgactctattttaaatatgttttcgttaatatctggtttggatatattacttggaaccgtataaccttaaatttaattaagaacatgtgtcacgataatggaacaataatggaatgctggagttgtttctatttgtactatacatgatttttttaaccaagataaagggttattttgaaaaaactaccgcaataatctctaaagcatcacattgttggttatattttgagaaatatctataattttgcgtttgattttttgcaacacctattattcataatcacatgagacacttttactaattaatttagataatgaatctattttcccaaacttatttacaataactaatttattgaagtatactttatagttacttcaatagggtgtataacatacgtccatcaaattgatacttgatgtgttggaattcctcaactataagaaaatatatcatgagtagtttattacacatattatttgattgttcatttgttgccaaaactatttgacaaagagaaaaacatagatatatgaccataaatctcatggtggattaaatggttgtattatagcaagatcattggtatgaaatatttttttcacaattttttttacatctatgcaacatttatgttgcccacttattacatactgataaatagttgtaaagattccgaaaaaaaattgagaatcttaatcccaaacaaattaaattaaatcaaatacttaaaaatacacaactaaattgtgttattttcatttatttttcgtatatagatttaaattagcattgtatagtcgtcaagtgatatttgacacctgaaatatgatgtgaaattatttaaaataggaaaaaaaagtactaattaccccctaaacccaaaaaccaaacatctttcaccctcaactattaataccggacgaattacccctaactcaacctggagtggtcttgttcctacatgacagtccaattagcactttttaaaaaataaattaggtgggggcctacctgtcacactctctaccctctctatctctctccctctcttcctcaatcccattcctcagcctctctctctcttctccttctccttgctacaggggccaaccagcaggcacgccactaccccgtcgctcttttcctttctccttcatccattcccctgcacttgctctcttaattgatctaccttgtcgttctttgattgattggtgctttctgtctcgtcaggagagaggcattggtggtggggatcgattaagaactatggtgggatggcatgcagttgtagacagagctacggggcgcagccgaacctggccatggaggaccaacgcaggtgctcgcctctggcagccatcacgtgacgatgagatgtgatagaaaggatggagaaaacaatctccatcggagtgcagatgtggcgcccgagatagtcgaggaggagccgcctctgctgctcaccgcccttagtcgcctccaccgctgttgtcctcttcacgggccagtggatgttgaggagaagccacacggccatcaaggaggtgcgcgtcggcggagactgaggaggacctgctcactgcctctagccttgcctattgatagatatggagggagaagaaagagggaggggatgggtgagggagagatacgataggtgggtcccatcaatttctttttaagaaaatactgactggactgccaccactccaagctgtgtcagcgaggtatttcatccgatattaatagttgagtgtgaaaaatgtctagcttttaggtttatgggggtaattcggtcgaccataacagtttaagggtaattcgtcatttttccttaaaaatattatcataatattatttattatatgtcagcctcatgtgttatgatgtatttaggaagatagacatcaatagtttatttaattaaaggaatccgactggatcacaaattagatatataattttaaaataatttaaagataggatatttttttatattatagaagatctagtttaactatgtatatttgcgtaagtttatagagtattatatttttatttttaaatagtagaaaatcgtatattatggaccatcgattttttttatggcactacgtactaactatgttacgtaattgttttttactttattgattttatcgtcagttcgtacgtaggttttcttttaattaagcttcgttgatgttacgtaattgttttttactttattgattttatcgtcagttcgtacttaggttttttttaagcttagttgattcttttccagcacgtaagtccgtacacgaagtatacgaagtatacttatgtttggtttcttttctcggccccattatgagaggaaattattaccttctcaaaataatatatctaatataacggtctagaatattaggtccactaatttaaatggaaattaacggtaagattaaatagtgccatgtggcggtctaattgtatttgtaagaacgtcacgtggcggcttaagagcgtttctagaaagtttaatggacttttagtatataattgataagaacttgcacttaggcgaggcctaacattttgagatagtctagttgtagatcgtttcggtcgctccaacgaattgtagtctatacgcagatttggccgagcagactgcattagccatcagcttttaggtaaatggtgtccctttgctcactcatgggacccacacgttgtatcatagtccacaaatggacgtattgtcgtagatgatccgctgccttaatccgaaggggaggttgatgtctcggacccatgttttggatgctagggcatcgtgcaccgtcctagttttgcgcttggaagccacaaaaattactggtgcgatctctttgggcatcttgttttctagctagtgtgagttctagaaggttgccgttttcccaaccctagagtgattatcgtcgcgccatgaagaggtttctgtccaattgaccacaggggatcgcagtgctgttccaaggtttatccggtttagtccatttgtaccacagccatcttattctcagtgctctggcgaactggtctaggttaagcacaccaaggccacccaggttcttaggtctgcactctgcaggctttatccctatttgctttgcacatccccacgatgtgtcgtctcttcttgcccagaagaacttccgcctcatcttatcgatcgagtgtagtatctcgtctaggatctttaaagctgttagatagtagattagttacaccgtgaggacatatttagtaagagtcgctcttccttccgccgtgatcatccttccttgcaaaggcaccaaccgcgtcttgcatttatcgagcaatggttggacatgtatcttttcgaattaggagatcaccagcgggaggccgaggaactttatcgggtagctggtgatgtttgtgggaaaaatccatgagatatcttgtaggtcgctaacggcgccgcagaatctgacttttcaccatgttggtttagaggcccataactttccccaaggaatgccgaattcgagcgaggtgtctcatatctctctttgtcggtcagatgaacatcgtggcattatctgcatagtgagatgtgagtaggcgcgctgttctcccatttagcagggagagatatagctgaggcccacggccttctccatgacgatacgaaggggaggaaacgtggatcgaaatggctagttagcgcacgctcattgacttccgatctggcgaacgtgtcaggacgatgcgttttccttttttgatcgctttaaccttcaccttcattactagaaaaaacatttttacaggcagccaaaagtaatttttccaggcggggggcggaccgcctgcagaccaacgactgtgaaaatcaggcaggaaatccaatgaacgaacaaaaaaaatcgcatcccggcaggatctaggaggggaggggagctgcgccgggagccgctgccgctgccccgcgtgtcgtcgtcaccgccgccctcccccgaccggatttggaaggggaggggaggggagccgccaccgccgccccgcgcgtcgtcgttgccgcctagtgccccaccggccacgcgcctcaccgccgccgccctcccctggcatccctctggtcagatctgggaggggaggggaggggagccgccgccacgcaacacgcgtcgtcgacgccaccccgcgccccgctggccacgcgtctcgccgccgtcgccatcgcttcccctccggcgggagggaggggaaggggacagcctagtggagggacaagtgttgagggagagatagagagttgagagagggaaatgagtggtggggaggggtaggcacaatttttgcaggcggaccacatacggtttgcctgccgcttaagtggtcgattttcacagaggcggacagcgaacttcacccccgatttatttttttaggcggttatttggttccaagggttatgtccgcttgcgaaaaaaagacctccacgtcgggaaaaatgctttttttagtagtgcttgacaaagtaaaaactggtagagccatccaacgaaaacgaatggatctcaccatctgcaactcccatgtctttggagaaggaatttggcttttgccatcaaagtgatgcttttctttatccatggtcctgtccatccatcctgtgcgtgattcgctcctaggtttagcatgctgggcccatggaattaggagagattttccagcgcccatggaagatttgctccatctccaaagctccaaaagcagcatggtctacgatgtggaggccttcgtgtccagctgattgttgcggctgcgttgccccaagcaaaccatacatatgcaacctcgagcctccggtctggggagatctccgtggaatataatctacataaagcgcctcgccttctcacaaagatacatgattccctgcgatattttcaacgccttttccttgtcgaatccatgctagtgtaattcacttttgctaacagttttgcagcaaacatcaagtctatggaaattaacagcgtttcagtgagctacaactgataagctgtacaatgtaaagaaaacaagcaaaagtaatttatggataaacttttatatctatgttattagtattaatggtttggaattcaagattggaaaacagaaacggtaaaatcagctacgttttaaaatatatttttattttttcgccaagacaaatcaacaagcagaatgagcagctgacatggcggttgcaggttgccgctaggttgagtggtttcctaccacggtaaaaatcttgctgaatattatgatctatcttccagcgttgttaatgagttattagccgtgtcaaactttactgggtacgtgaaaaaaacgagatttcgagggagaggcactcctcccaatattttttaagtaagatattgtgagtatgttgagaattaaacgcatgacctcggggttgaaaccacgtaccccttgatactgcatatccagtgcatctcattttgctgggatacagactatgaactacaggcatggtcggtgtattgatgactaacacgcacgcagccactgcatatgcacctatacatgcagtcgacatccaccagatcccaaatctgcgaaagaagaagcccagaatccaggcaccaacttgcatcgcagggattggaatcaaggtggtctctgctctccacatcaactctcaagccgggattcagaatattttacctccagccctcactgaaaaggcgtcaccatccagacgttcggattcccttcggctcatatacccaccctagcatatctgtctttacaagtgtggagattatgggtaccccatacccacacggcatggttatccgactagtcataggggatagcttatatctatggaatatgtaaccgatcatgtgtagcgcccgttccgtcgtggcgcctagcggaaaaattatctcttaaaaaccctatttgcgaaatccgtttccttgcttgttgtctagtgtccgtgccatctcagatctcaaatccccgatctatcgtcaagttcaatcccgaatccaaatccttcccaaatcaaatccctccgcaaaagtctattttgcctccctcgggttcgatgggccgaatccctctcggcccatctccccctccctccccatctctctctctctctctctccctctcccccgctctgcccgtgcgctgcacacgcgtgcgcgtgagccgcgccgagccgagcgccctccgccctcgctgccgcttcccgccgacgccgctgaaatcgccgcgccgcccgttgcttcccgcgcgcgcgcgcgccatggtggccgaccgcctagtcgctgccgccgtcagcatctgccgcgcctgcccgcgcctgccgcccatgtcgccgctccgctccacaccgccccaccgtcatcgccgtcatcacgacccggcccccgccactccacgcgctagcctccaagggacggaggcagagctcctcctccctctgccgcgtcgcccccgctccctcctccttttcccaaagtggcaaggggcaagctccctttctcccttcctttttccttttcccctccccgccggcgtcatccgcctctgtcaccgttttggctgcgagcgccgagcgccagctcgcgccttgaccgcccaaggtcggtttccaaaccgacatcgtcgtcctataaaccaaggcgccttcccatccattcctcctcccgtttcgctcgccgccaccacgccattgccgcccctctgtctcgcctccgccgttcatcgccaagcaccgggagagccggtgcgttcgtggacgcggaaggggactccgggagctcgacttcctcctcttccccggcccgaggccaaagagatcactcccgtgccgtcggcccatcgtcactgcgccccgtccgcacggtagtgcatctccccgttctccctcctcaatccatctcttccccttagttttcggtagtagcatgtgtagcctccccgtagctagccggcgccgccccgactgctgccgtcgctcgccgtgtgctcgccaccgtcgccgcccgagctcggaagcgcctctcgtcgccggcctctctcaatgcgtttcctcctaatccggcgcaagggatgggttcccgtatccgcgtagatgctctcgccgccgggaatcggcccctcatgacctcatcgccgtttcccccttttctctctgccggttgccgccgccgtaatccgccgccatcgagcatcccccgatgaatccgagccgttggctcgtctcccctcgtcccgtgcaacgtcccggtgtgctcgctttcgcctgtatcgccgtggttcgctccgccgctcgctgtcgtcgtccgccgtctgttccggccggcgtcgtcgtctacctcccgccggcccgcgtggcagccacgtaggcgccacgtcggtgccacctcggccgcgaccgggtcaagcagaccccggcccgctgcttctctccgcccctcgcgcgcgcggtccactgcgagccgtgaggctgcgcgtgggcccgccgcaccgcgtcctccgtgaaccacgcgcctgcgccgcgcctccctccccaaaccctagcacaccccgcgtgcacctcgctcacggtgagccgagtcgccgacaagcgggtcccacccaggaccacgcgggatggacccggcccaccggcactctctctcccctccccgcccgcgcgcgcgccttgggccgccttcttgggccggccggcccattaagctcggccgagccgccccattctctcaggccgcgccctagccgtccgagggaagtctaatttccctccctccttcttttcttttcttttctttttcaaaaagatttaaataaatcctttttcctttagaccaaaaatccaataatcttagaaattcaatatcttcccaaccgtaagtccgtttgactccgttcagcttccaaaattcctcaaatctcgagatctatctaatgtcacacttagaggtcattaatagggctttattttcgccgcttgttgagttgtcccgtttcgcgtgtagtttcggagcccgaagacccgcagtgcgaggatttcgaggatcaatctcaagatctcgagcaaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgcgcctcggtaatcgtgcactctgcacgggtatcgatgatcgccttcaaacttaaaatctgagaaacatcttgggtaaaacttgggttttacaaaagacttggaaaacccgacacctgggtcggtgcttgcgaactaaatgaatttccaaaaccacggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatggtgctaagagacatgtggattcgccgggctggtgtcggggaagacccctgggcttcctggcacagtgtggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatcggcggctgatgggatcagccaggcccgggtggccgtttgaaagctgttggccgggtgccaatcttgatcaattcaaaagactgaaacattgcacatactccgaccggacgagacgcactgtctcatccgtgtcgtttaagaagcactcccttagttgtttcagaaaagagtttaaataaaatcaatcgcaaaaacaacagcctttctttgaagcctgcattaaacatttatttcccatggcttgctgagtactcctgtactcacccttgctctatataaataatcccccccccagttgctgaagaagatgaagcggatcccgctgacgaggagttcttccaggagcaagccggctacgatgagttttagggtttcggcctagttcccaagtcgcgcctgtcatgtgtggtccaagtcttggcttccgtttcccttttgtaatgcagttgtgagctcgggatctatccgcagcccaacatgactgtactcctactctataataaagagacctctgttgctgtgatattctgtcttcctgtgatatcagcactgtttcatgggactggtatcgattaacaggttaatttggagcgtcacgggctagttccgctcaggactagttcggagtgtgacatcatgacttgggtattacgtttccttttatattatggagcggcctaaaatcctgatttgataatattgtaaaatagatttagaaaaccgataccgtattggttaaggtttctatcttgtaatcctgccccccatcctatataaggtgggcaggaggccctctgaggggcataagcacatatgatcgtcagatctatactacatccggcggattcaaatccccaaacaggagtagggtattacctctcattgagagggcctgaacctgtctaaatccttgtctccgcatccatccacttttaggtctcgtgcgctacccccttttattattgccgaattcatgtttcgacagttggtgcgccaggtaagggttgcgtcgagctttccattgagaagtgcgatggaatcaatttctggagatgtgctgagatcgacctcaaagagtcgtcggcttcgtcttcacttcgcttcgggatttttgcttcgtcgtcgccgctgacaactttaacaagttttcacactctgacttggatccaaaccagtcaggagagattcaatctaaggcagcgacgatctgatggatcagatggtcatccaccaccaagcctactgagccaatcaatctaccccaacgaagatgccatgatgctgcaagatggatctacagacacaaggcatgacaaaaccgatctaatcagcatgcatgggagacggttgcagctgatggacaccaacgacgccagggccgcgcacgcagctacgccgcctgcgcgcggctgcgacctccgcctcctccgctccgacgactacgtcgcctccctccccgccgtcctcccagagtcgcggatctgttcctccgccgcttcaatgtcggtgaggactgcccggctgctgccgcgtcgtcatcgtcaactagtcgggcgggttgcatcacgcgaaggagtccgagacgtcgacagatccctgctacgaccgcgacatcgctctcgccatcctcaagctcctcgtcttcgccaccggcgacatcatcaacaaccaaattcaacaaggctgtgaatggcaacatggccaacaaatgatacgatgacacgtcaccagcatgcacaggaccatgcatcggcaacatgcatgcccatcaagccagcaaccaatcacacctcacgtgatatttgtgcatttatctttaattaattccttgctgctgctgatcaatttaattatttgtttgattgcatatgctactgagacgccgtggtggtcaggccgtcgccgtgccgcggagtatcgacttgatttgtccgcgcgttagcccgcactcacttgcatcttcgcctacatggttggctacatccgctgacactgtcgaccgtctcaacaagttcgcgattggctgcttccacgctgccgagcccgactatcgcccctgcatggctcacgctgacccggctgcgcctctcatagctcacgctgacccggctgcgcctctccattggccgttgctgatgggaatcgtcatcttcaccgccggcctacttctgtcgccgccgactagtgtcctcgcctatacagttggttggtcataccaccgttcatgggcgtccacgtcttcaccgaccggcctgcctttgccgccgcctactggtgtctctgcctacacggctggcctattatgccgctgttggtgagcatcttcgctttcactgtcgaccgccttcgtcgccgccgactggtgtcttcattgttattgatggacaactttattcccacattggccacctctgccatcaccaaggggaatattacaaagctaagtcatcatttattccttatatgatattttccttttcctctgcctcactacatcaattggttctccattgagtagtgagtcgggggctacagatgttatatcatatttttcaataattttcataatatttatcttgattgcttgcgacataatctgagtacaaaagtgtctatcaagttatagagttctatcttcctatgctttccgtttggtttgtcatggatagttgcctttgggccaattcctagcacccgggggctcgttggatagaccgagtaacgcaaggtgctaagtattattcggaataaatcaaaagtatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctataactagtcgggcaaagtgtttaaacgtaatgagtcatctgctcggggaaatcaaaattaacaagaaaagaaatacatatttataaacattttaaaatgcttgaatttttctcgagtattatatttacatcagatactactcatcctatatgtttgttctgcaggatccaaatccagatatgcataaaagggattcatggctttaagcttatctcttacgctccaggaatggatcagtcagaacatcaccaccggctcgccgtcgtcgccgccgactggtgtctacgcctatacggttggttggtcacaacaccgctgttgttgggcgtctacctcttcaccgactggccgcctcgtccgccgccgactgctgtttccgcctgcacggctggcctattatgccgctgttattgggcgtctacctcttcactgactggccgcctcgttcgccgccgactggtgtttttgcctgcacggttggcctattatgccgccgttgttgggcgtctacctcttcaccgactggccgtctcgtccgccgccgactggtgttttcgcctgcacggctggcctattatgccgatgttgttgggcgtctacctcttcaccggccgtctcgtccgctgccgactggtgtttccgcctgcacggttggcctattatgccgccgttgttgggcgtctatatcttcaccgaccggccgtctcgtccgccgccgactggtgtttccgcttgcacggctggcctattatgccgccgttgtagggcgtctacctcttcaccggccgtctcgtccgccgcagactggtgtttccgcctgcacggttggcctattatgccgccgttgttaggcatctacatcttcaccgaccggccgtctcgtccgccgccgactggtgtttccgcctgcacggttggccaattatgccgccgttgttgggcgtctacatcttcaccgactggccgcctcgtctgccgccgactggtgtttccgcctgcacggttggcctattatgccactgttgttgggcgtctacgtcttctccgaccggccgcctcatccgctgccgactggtgtttccgcctgcacggctggcctttatgctgccgttgttgggcgtctacgtcttcaccgactggccgcctcgtcagccgccgactggtgttttcgcctgcacggctggcccattatgccgccattgcaggacgtctacatcttctccgaccggccacctcgtatgaccccaactggtgctatcgtcttcacggctggccacgtcgccgccaccgcaaataggcatcatcaccttcaatgcaagctgtctacgtcttctaccgactggtttcttcactcccatggctgcatgattctgccagtgttgattggccttatcgtcttcatcgctagtcatctcttctgctgctgactagtgcccttgcctctacgtctggtttatacagctaccactactgatggacatcatcgtcttccgttgccgactggttatgccgccgccgactggtgctttaatcttcacaactgcgcgtcttcactactagtttgcttctgttgccgccgacccgtgttcacttcatcacggctatgcaattttgtcaccttggtggagcaacttcatttttattatcttcggcatcagcaaactctattgcctctacttcaccaaccatgacgactacaagagtttcgacaccttggcatacgtcaccaaatatgatgccgtgttattttattacaacaagtggtgttccagtcttcaatatttatcttcactcaagcaatgactactcgacgacaagaagttacagttctcgactctatgttcagttgtttcccaactaaccaaagagtcgggggctacacaaatacaagactctcaaaattcgacaagctgaagcaatcaatttatcagccaacgagtcaattccaggagtcattatcttcgtctttgctttagagcagagttatcaaccaatcagctcagtttcgacgagttggacaacatcatctactttcctccaagtgaagcatctgcaacagctataacaccaatttgatgcattattgtcactgacatcatcaccagcacctctgcttcatcggccctgacatcaactctgttgctaatggatgactatgtcttcgccgacttattatttcactttcacggttgctatcgactggatcaccgacatcgttatcttaatcaacatcctgtcaagcctcttcaatatagcccactctactgctattgatgggcaacttcgtcattatatttgatcatctatgattgctgcttatcatcattactgttggttgcgtttgtcgtcgccgactattttcttcatcttcatgattggtggatttcgtcatcgcctttgatgcgtgtctacatcttcaccgtcggcttgctttcgtcaccaccgaccggtatcctcgccttcatggatggcttattatgtcgccactaatgggcatcttcatcttcttcactagctgcatcgtctgtcaccaactgattatttcgctgctatggctacacaactttatcgctgggcgccttcatattcattgctggctgacctgactgttgccgactggtttcttcgcctccacggctatacaacttcatcacttttgattggtatcactatcttcactactaacaatatttttgccacctctggtgggcaatattatctctatattggtcgtcttgtctctatgccaactgcgtcagctaccatcaatggacaatggtgactatgacagaaggacaagctatatgctcaggggctcatcaactcaagcgtgaggattatatctccaatttggacttgttccggatacatgcaacatgaatttgatgatcatgggtctattttctatgctcaaagactagactatttattattccccgtatgggttatcagcctaatacttgcgccagtcggaattcaattgttatatctattttggagtatcccataaaggataatcactcagatcagaagctattcatatgagctacacttggtctatatcacctgaaagatttattactcgagagcatgttacatgcgtaatcctttaaagggtgtcaaaggtatattttttggcctaggcctaatatgtctgcagctcatattttcaggtgtggcctgtcacgttcttttagggacttaggcatctttttgctttggcaaaagtgcgcgtgattatgtgcccaataccttaaaatccttttataccgcagttactcaactttttaggagttggtacaatacattttaaaaggtgccaaacagtaatgctttatatagctccccgctgactttttatataagtcaaggcgctgtttgggttcataaagcaattgattggatacaatatcattgctttttgccacgtaagtgtgcatttttattgaccaatattatggcttaggctgattatatattttggtcattttccaaacgattgataaatccttatgagttcatttactcggattttataccacatatgctatatatttccaggtgtggtgaaaccatgtgtcttttaggggctcaagcacatctgttaaagcagtgtgcgcatggtgtatgcccaatactttggaaatttatttattcacaacatacaagcttctttatagctgttttgctatgtgtattcaatgatgtagtcagctttaggttgcacgcatcatattttacaaagcagtcggtatatcactcgatcatgttattcagggattcacactgcatatgctatatattaatattaagtcacttggttgactacaattatcaaaaccattcagttggtgcatctattaggtacatctattcgatgcacctgactttatttttcagccctccacagtcttcatatttggtaaaagtactcgggaaatcatggcgaagatgattgaagcactcggctttggagtaatctagttcgagagaagattatttttctgactgtgaaggtctcaggggctactgtggagattatgggtaccccatacccacatggcatggttatccgactagtcataggggataacttatatctatggaatatgtaaccgatcatgacttaggtattacgtttccttttatattatggagcggcctaaagtcctgatttgataatattataaaatagatttaggaaaccgataccgtattggttaaggtttctatcttgtaatcctgccccccatcctatataaggtgggcaggaggccctctgaggggcatgagcacatatgatcgtcagatctatactacacccggcggattcaaatccccaaacaggagtagagtattacctctcattgagagggcctgaacctgtctaaatccttgtcttcgcatccattcacttttaggtctcgtgcgctaaccccttttattattgccgaattcatgtttcgacaacaagtactatctatctatccatctatatcttcacggataagaaataacataagagattgttaagaaaacaagtaaaattcaatggataaaggttacgattgattaggaaaaaataggtaaaaaattgtggaatggtgatattttttgagaagaaatacagattaaatatataaaaatattacttgacatgataaataaattttaaaagttgttatatttaaaaatagaacgagtacatcttatccagtcagccagtgtgctagcagattgatactgaaagtagatcgattggtggagaatccgtgtggcgtgtcatttgatcgcctgagcgagctagcggccggcagcgtggattggaccggggaacattgttccaaggccacaggccggcaccagattcgatcctgcaggcttcttctttgtttttttttctttttctttctctcgccgccgacgtacctgtcgaccaaatgaaaagttgcgtcttgacggtgactggcaaaggcggcgcttggatgcagaaaccgggatatatattcagcatcttcgtgaaaaaaaagggcattcttcagctgtggctactgcggcctactgcatcaccaagaggcagctcaagagtatatcagctgagactgagaggtggtgtggccaccagctcagcaacacatttgctgagagacctggaagacgccacgtcggtgacgacggtgaggagcgatcgagctttgcggcctagtggttgccggccgactggtgcagtaggcggaatgctagattgcttggtatactgctgcttttgatgctggacctccagctatatgctactttgtctgatccaaaatgttgctaccccatcctaggacttatgtccagattcgttgtcctaggatagatcaaatcctatcctagatagcaacatattaggacagaagaagtattggcccaacggcatatttacaaacgaaaaataatttgtaaataaaatttttatatataagttctcagtgatctaaaagcaaatattgaaaattaaacttcaatgaaaaagctctcaaaatcaactccaaatgtaaaggtgaaaatttaaattttgattgataattataagtataagagaaaagatgagaccgatagtgatgcccgagtatactgcttgcaggtcagaatccttgtataattcgttttgtttttcggggtaaacattgagctgcgcatggcagtgatgtatctagcatttttatatgagaaacgctactgtactctctactagttatattatactactcacagaaataattttggaccgttccttaataaggacattttttaacatatcctatacacatgtgctttctgtgcatactccatgtacaccaactaaaaaatatcacggaaaattctagaaaaaaatatgacatgtactattaatagtgttatacatatctgtagagtcttatattcaaattcattgtattttagccgtaataaaaaggagaaaaacctgacagttttaagagtaaaaatctgtcaaaattttgtcttttttgttacggctaaaatataatgaatttgaacatgagatttcataggtatgtgtaatactattaaaaatatgtgttcaattttttctataatttttcgtgacatttgctagttggtgtgcatggagtgtgcatgggaagcatgtgtgccaagaatatgtttcctcttattacttgacaaactcaatgattaggggtaggtttaccatttagtttttttcttctctggattgctggcagattgcttgcattcgataaaattttaaaaaataaaatttgcttacctctcgagaaatcctctcgctggcggctccttccgctagcccctcgagtcgtatattaattcatagcaaatacacttttggagtggtgcatgtgcaagctccgcgagcgccgcctgctccattccggccatccctgacaacgccttaggcctcgttcggtaaggcccgaaacggcctctatttccaaatctggtctggctcggaagcgtcgttcgttttggccggcccagattggaaacggggccggtttggcctccctcccttcccctgttcctggcccggatcaattcctcacatcagaccctccagctccaatccggatgcgaggcggcggcgtgcggctggtgaagcgaggagacagcgcgcgcggctggcgacgcgaggaggcgacgcagtggcgcaccagcgtcgacggcgatggcgacctcttcccatctgacgtccgcgctctctgctgccttctcgccggtaatgcatcgtcttcttcctttctctccccggcgcctacgaagatgacttagagtctgctttaatttggctgagaagtgaaatggcctagcatcaccaaaggttagttcctgtccttgttttctgcttgagatgacatgaaatggctgagatgacaccaagttcagtaaaaaaaaattccctgttttagtgtgggtagtgtgctgacatatgtttgagaaataaaaaagtatactttgtttgaatttctacagggacagcagcattttgaatttcttcttttatccgttcaactgggttagcagttatcgcatatgcttatggtgcttacagttacatagcatattgtaaaaacctgccgactttagtcccttctctcttggtagaaactatacatcctataattttatctgggtacattgaaatcgacattgttaactggaaaaaatgaatttcatattagattttggaatatagatgagttacattccgtacatacatgcatgtatgatgctattagttcttgtgggcttgaagctacgacaagcattgcatttaacgcctttgcatatgatgctgtgtaaattacttctcaaatattttttcccccatgtgcccatctaccattttcatacaacaaaatggtcaaaaatacacggtgaccatttttctgtaatgtcataatgtcacatgccttttctataattggtcctatcatttctactgcaggcatttcaagggtccgtacccatgtggcaaaatacctagtctgaactgattcctctgttgtgtgttaacttctgatcctgctagtgctttgcttcatgttctttgcatatgtatgcgtctgctataaatatactcaggtttatatatgcataatatgtatgtgcagagcccaacgacgcatacatatataagccagtttgcttcatgtgcctttgccttttctctgcttaacttctgatcctgctagtgctttggacttagcgtcggcagcttgaatggcttcattccagatggattaagaaataaccgaatgcagttttttgaagaggtggattaagaaaaggagtggattcaatcgacatgtggtttcagactttcagtgaatttacctggatccattcaatccaggccaggaactgttccaggccaggtttggaaatgggcctgccgaacaaggcctaagcatgattgagatgcatgcgtctggcaagccggttagtagcacgctttagatccctatggcagagagcctgccggcggtgctagatgatcgattcgccacctgcaaggggtagaaacagtgagtttaatggatgtgtagtgtataacctctgtttgcgatgcttgccactgcaatatcaaatattaaggacttcctattttctccactagcgtgttagcactagtgctaattgttatgtggcccagctggaaattaaaagattatgtaacatcaaaacaatgtgtttcaaggaaaactgttagcaattgaaagaatacagtttttcatcctgtggcgttgatgcatctacatgcatatagcttcttgcattttagtcattggcatcagcacatgctaacattgctgagtactactaacactagacagtttaacggtttatgtccaaaggatgttgctcctctctgttttcgtttagccaaacgaaagcaacgatgtgtccagtttgaaatttcgtcaaacaattggattgtttctttctgacaattcacaacagtggaagagctgcatgacctagtgcaacttggggggaatgatccaagatatctaactctcccaacaaccggatgaaattaactggaactggaatccttccagggtttactctagtaaagaagcctactcctatcaatttgcaggaacttttgcacgattggattttgatgccctatggaagtcaccagctgagctaaaaatgtgatcttttgggtggttgatccttcatcacaaaaccctaacagcccaaaacctgctaaggcgtcactggccgtgcaactggatatgctgtctttgcacgtctacattcgaggatacaaatcatcttttctgtgactgtgtgtatgtcagagaagtttggactctcgttcattcctggcgaaatctactagtccctatcctatagccggcaaatatctctacttggtgggatcaagtaaatcaagatggatcgacaaatcaaaagcaggacgttagaggagcactgttaactacttggtgaaatatttggttagaaagaaataggagaattttcaataatcgttcctgtacagtttatcaggtagctcatcttgtcatggaagatctagaccttagaagatcggcctttaggcacccttgattgttttattttgtttttggacttgaaatcccattcctgggattgtaaactttttccttttccccttaattaaattccggcagaacggaatcttctgccgttgttcctttaaaaaaaaaaactaacactagacagtgattgttgagtactactaccaacctgttgcttcgggctctgagtgaagtgaaaagctgaaaaaggtaaatgctgctttgaccggaaggcagttattacaatttcagaaatttcctcactcacaggtaaacacaaatctcgtctgaaatttacgggttttttttcattttttcaatttgttcgaagttaattcaaattcattaaaaatacgtaaaacttctaaataatttcggctcagaaattttccgaaacttccaaaatttcgattctttcgcccctcccccggcccgccaaaaaaaaccctaatttggagattgcaaaccctgctgaaggaaaggatgatgaaggtggtacacaggacatggaggcttgcttgctccatgtacgtgctccccatcaattcacttcccacgagggcctcggaagatcggagcccaacacggcagcatgaaaccattgtggtggctgcctcggacgcagcgagctccccgaagatcacgtgcacggggatcgctgcagcgtcagcgcgattcaggtgtagacagtgcagagcaagtctacaattccacagcaccagtctcgacgtgcctgaagcagcggccgttaagtacaacgagccgcatctaccttgtgaacaggccatgtcgtggcatctcccttcgggcagcgtggttgaggagtgcgtgccgagatagttggtaacctcagcatacatcgccatagctaaatgcttcatgccatcgatcaggaaaagctctagactgttcttcacatcagtgacactacagtttgcctacgataacgccattcccaatgcccaccgttcctatacttttgagatacagaaaccatatttttttcccctccccataatcctctagatatatcataagctttgtttgcttcttctcagttttgtacagtctcgatttatgggagatgatggatcttcggatttggtgagggaagaagtacaacaattgtgatggtagctcaagatgtcttgatctgtgacatttgaaagccgaagctgacttttatggatgccatgtctgcgatgacggcaagctgcgttggatttgtagttcactaggggtgtgtgtttagttcacgcaaaaattgaaagtttggttgaaattggaacgatgtgatggaaaagttgaaagtttatgtgtgtagaaaagttttgatgtgatggaaaagttagaagtctgaagaaaaagtttggaactaaacatggcctagaattgtaggtggtcaccatagatgaaacatttattgacaagccctccaatactggactccatgtcactgactcactgcatgctcttgtgaacatgcttcattcaacatatatacctagctacacatgctagtcatggcatctccaaatcattttttcatatagtggataaaaatccaaccacaatatttacacacagccatccaaatcataacctttttattaagttgttttcttttagtttggcagtagtagttgtgaccgtagtaaatacttggatcgattgcatcttaaagaagcagttgtgtatgagtgccacctaaaatagtactcccccattcaaacaaaaaaaacctatacatcataatacaacgaatatatacatattttatgtccagatttgttacgttagaatatatcgaatgtcttttttgggatggagggattactacttttgcctatctacatcgggcttggcatgtacgctgcttaggtcatatctcatgctatggcttgggtgaaaagtttttgcgtgtcacatcggatatacaaacacatatttgaagtactgaacgtactttaataacaaaacaatttacagattacgcctgtaaactgcaagacgaaagtattaaacctaattaatccgccattagcaaatgtttactgtaacaccacattatcaaatcatgacactattaggcttataagattcggctcgcaatttacacgctgtataattagttttttttctatatttaatactctatgtatatattcaaacattcgatgtgacagggtgatcgaaaagcttttatttgggaactaaacaggcctatatccatcttgtcctggggcgctgctacacgtcacggatgggttatgccacgaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaattagcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatatttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatatgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgagcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggtattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataaccgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataagggggaggcaaaaatcgccctcgcggagggcggcaagggggccgcctgcaaaattccatgccccctcgccgcccatttgcaggcggccccccggacagtgcaaaatcgccctcgcggagggcggcaa

SEQ ID NO: 41201 - DNA, 4883 bp, Oryza sativa
  unsure (1)..(4883): unsure at all n locations
tgcaaatttcgttgacgcccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataataaaaattataaataaaaaaaattcatgccacgaatgggcgcatcatgggctgggttaggtgctcttgcacaaaaggcccaagcaagcccaagtgatagggaacaaaagcttgtgcagctgaatttatgggcatcgaatagaagaaaggcattagaggctcgggagtggtgatctggttacgcatgaattgaaccttgtgaatgtctctatccctctcaactcctcatactatctcttctataatgttctagaaccttctagaatcatgtatagcttatttcttaccactttccaacaaatacatgtgattgagttgaattagagattgttgctatttaatttggtgaagaaggttgctaacatatatctgaggtataacaaagaaaaatggaaatggcagtgtagatggtatataaaacatatatactccagctcgtagttttacagacttacggttagtgaagtacaaattgacatagcccattctcgtcttttagaaagtttagacctgagtaaatataaagttgataaacataatactatactaatatattagccaatcaaaagaaataaatgcttctagataaacatggaaattatgatcataaatagtccttaaaccacagtgaatactaaatttggtactactcagattattgagaaatatatgtaatttgagccattctttctgtcatcacagtactggaataacatgtttatttttagcttggacatagaatatggtttaagaacaaaattaaaatagcaatatatatgatgccagaggtgacaggagaaaacgattaagatgtgtcttcttcatgttaactggacagcccaggcagcatatgcttgcgaccgtcgttccattcccaatacctgtaccattcttacatatttaatttatagaataaatttctgtctacttttaacttctagatacattgtaaggtttgtttcctttttttttctatcttgtcacctcaatttctggagattgaatcaggggagtggagcagaaattgttatggtaagataacgatcttgaaaggtgaagcagttttctgaacagatgccaacatgcgtatacatggatggctagctctgctctgctaggcttgaggctgtaggtgctcaccaatacttattactgtttcagacttggactacaaatttatcgcaaattaagcccgtcgcttgtaatgtactcctcgtcactgtgattctgtgagttactaacttaatattcattactacacaaatcattttttgtaaagggggccattaggttgcaggcgagccacttgtgtatggggagagctgtggagattgtgatagcaaatagctagaatggtgacatttgagagcagcaatagctggtagttgtgtatgaattccaattgtgtatggcattttggtttatatatcttttgttcattattggactcgaagacaattaggactaccattatattttgccaagacaactgtcatagtctgtttcagcctacttgccaatctacagccagaataccctcagagtgaattaccaccatcaccagttgatatagtttgcattcctaaatgatgttgctaggaaggattgctcgctcctcgaaccttatatggaacagttttatttcagagtttccattcacatatctataatacagatttgagtatactttgggtcatcttttattactcgtgtttcatattggaccacccttcaactaattttttcactttcgaccgggtaattttacctttatggtactttggatcactctcaactcttttatccatttatatccaatttgtcatatgtcaaagtaacggtcaacatatatagctgatggagtttattacgaataggagctggtgtagttgatggtcgttcatatggttaagaagcaagtcggagtgcttcaaagtgaaataattgcaagattactcggtctaaagtgaaaacattagctgaatggtggtctaaagaaaaacgccggcataaaagatagtataaggtgatcttagtactagtctaggctatagttaaacaaatagttttactcattcatcattcatcatgtcacatatccaattatccaaattaatctgatgagtcgtatcggacggcatcgacgcctccctcccgatcgcgcccctcccacgccccctccccatgcacctcctcctcccacaaccctcccagaaaccgcacctccctcccacgcctccctccgccgtctccgccgctgacgccggaaaccgccccaatctcctcccccttttcattcgcacaccctcctcacgcccacatccatcccgtcacccgcccactcgccgtcgcacgagcctccccgtcgtcgatcccctcccttctcaccctcatcctcaggtattgttgccgattgtcctgtctccgctcgtcgccggcccctcatagcgcaaatcgtcatcctgcatcgtcgattccccatgcctcgatctcccgttgggcttcctgccgctcgccattgaccatcgcccatggctcctccaagagtcaccgccgaatccggttctttcatcttatgatggtttgcctgttctctgcagttcagcttggtagatcagtttagcgttgagaagcaagctgttaaaacatccacttaatgcagaagaggtcataagctccactcctgaaaattccacattttttagatatcctcacattattcaccctatatatgttttcagttgttcctgtatatttggtacactattctcgtttaagttgtatgtcagttcaaatagaatctggagcgatgctaacttatggtgccagcttcgaaatttgattgctcatggagacaggggacagattattattttgtctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcagtcaacaagagacgataaaggactatttttgcatgtgctcttttgcttggagtattgtgtgattatatagctgattgagctatgtttagaaaactgaacttcccagaactaaaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcgttgtttaaaaaatgaaatgaaaactgctatccatgttgactccatcgattcatttatcagatcagggggtttgaatgaataaggatatctatgctgttcatgaagtgcataatggatggtgtgatcctctttaatcatactgcttccttcagagttcagatacaaggtagaatcttttacgctactttcagcttaattgattgattcattttcgtatttgacttgcagggcctaaccatggtaactaatgatgcacagctgctttgctccagggtgaaccctcactctgctggttggatttcagccgtggattagcaactggttcatgttctgaaatttttataataaccatcctcactctgtagtatttgaaatcaacctttcagtttattctgaatttttatgcataatataaccatgccagtattttggaatgagtgtagaatttgatccgtcggttctgaagaaacccggttacttattagaagaagcagagaccacaacctggcagtggctggtcacttcagtggtctccaattgcatgtacgtcttaaaaaggatgtttggattacaagtatctatggtatagtagaaacctaaaattagatgtacgaaggtacgtaaaaaagcaagaaaaaattgagttgcaacttcgaaagaaatatactgtttcttcaattagggctatctacatcagctgcatttgagagatatccgaactgttgtagttcaaggaagcatttgaaataaaaattctggtaacagccttaaattaattgagagaaatatcctaattagggcacacaggatcagttggatctgttgagtttcataaagaagaggtgcttgtgcgttcatcaaatagctcggacgaagctgtattttcgctcttgtctgctagcaagccatctaaaaagtcaaagcgtatcgtcacatatttgaaaatgtgtttataaattttcagtaacttgctttgtaagggaaaaacaccaaagtttctgtgcatttgcttcgaacatttggttctgcagtactgttgactataaaatacagctcaacagaactttattttctcacatttctcataacaagttggatatggaaaaccatcgactctcataaaagactacgcgcaattattaaactcaaatctattttaaagcatgtgaataggagacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41202 - DNA, 8169 bp, Oryza sativa
  unsure (1)..(8169): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagccgatctcccaaattctgttgaagagcagaaggcaagactaaaatcggctatcaaaaatgttgctgatctgaccaagtttttaaaagtcatccctgtaaccgatgctcaaggtgcccatgccattgaagaagtagaaaaaatcaggcaaagagctatttcagctttccagcaatatttgtcttagtgatatcttatgtaataggtcttagaaatttttttgcaatcggctaagaaactctgactctttatgtaactcatctcaacaatctttaagccgatttaatatgaccccatatttggctcaaaaatatgcaatttttcatatatatatgtgccccccctaattttacaatgtcacaagcattgataaaattataaaagcggctaagggcgatacaacaatatcggccattatacatcggcaaaccataaccgattacaatatgaaaaacaactaagggcgatataacaaaggaggaactgattaaacggcttgctgattatcagtgatcaagggccgataattcgggaaagtacctccttgaagataaaccggtcccgtagtctgatagtcagctattgaaccatcaaccatcgacttcaccatgtttgacaaagtattgactaatatcccagattgattgatcaaagcatgatgtacggcatagtctacctgatcttggaagttattaaactgtagctgtgctgcgttactaacttggttaagattagcacctttaaatccctgagaaccatcaccttgaactccttgagagccaataccttgaactccttgagagccatcaccttggtctcattgaaaaccatctgcagcacctttatcagtcggttgagccgagccatctagagcttgtttcacttctccatccttagaagaaccggtcccaggaacatcagcaactacctttactttgtacttctgaactaatgttcccttgcgagtctccgtgaatgagctcaagaactgattccgtgcttactgcatcattgtatcaagatctttttgctgctcaagtgtcaatttatcaaaagtgatgggcacaatgttggcttcatcaatctcagatagacccagcttcaggatcttttctttaacagagccaggaccagccgaggacggcgatgctactagtttctcggccatgaggaaagctgctgttgtgattctgacttctgataggtcccaccaggcgtgccaaaagcgtgttgacgtaaaacacgaggcctgggagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctgtagatattaacgatatatgatccttatatcgatatatacttaaaaccaagtgattgggatagatcggtcgccatgccgagacagtataaatcacttagatcgaaatatatattaataatgagattatatatattcatagcatagccgatcagatagatctagcatgtatcgactaatactccgatacaactctatactaagatatcaaagcaaatagaatatatcaaacaaaagcctaatatacctaaatgcaacaagatcttaacataaagggcagatataacatatcaacgaagcatatagagtaaaactagttaaatcaggtaagatcggctgaaaccccgatgctaccctaatcgtcaaccagaaggcaggctagagattgatattctaagcacgacttaatagatcaaactcaactgatgcagcattaagtatgaaaaaaagaacaatatctagacaatcaagccactggatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaacaagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctaacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccagccgattcttactctgttcccgaatcgatcttcgtctttgattccgcttcgatctaatcttcatcttcgatactgacactggtggagaaaccctttgtagtcccggttcgtaacccccctttagtcccggtttccaaaccgggagtaccaatccgggactaaagatcgctatctttagtcccgggtgaaataaccgggagtaaaaatcgatctttagtcccggttggtaacaccaaccgggactaaagatcgagctaaccttttttttttgcatggccctgttgctgcatggtttatatatatatatatatatatatatatatatatatatatatatatatatatatatataaaccatgcatatatatgtttcaatacatatatatgcatacatatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaatcgccgcgataaattccttgtgtgtggtcaggttatccctcatgcgaataaactatatgaatgtatgaaattgattagtaattaaacaagaaatcgctacgtaatgaaattttgaatttatttgtacatacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgtaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacatatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagaggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactagtttggactttccagaagatgctttcttcagcgttcgctcatagtccgatagcttgatggtctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagtggagcttgcgggggagtaggtgtaggagcacgaggaggagtcggtgcaggatcctgaggaggagtcgatgctggagcctgaggtggagacggtgctggcggagcatgaggaggagacggtgtaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcagaatggctaaatcttacctttattgataagttcttgaaaggaatatgcagctcacatggtgtccgctgagtgatgtcatcaacgggacaggtcgattcgtcctgtgtttgcatatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactggacgtccatcttcttccacttccgttatgatgtgccgaccctcaagcttcttcgctgcacctcgttgcccgggcctcttcgtccacgagggttgactatcactagcctcctcgtcgtggttcccttccacatccctttccacgtgcccttgttggttcccctccgcatccctctccacgttcccttcttggttcaagtactggtttggatcctcgtttccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgacataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtcatgtatgctaagtgtttcgggcgtatatgctaagtctaattaagactacaatagtcaattgctaggagtcgcaccaattccgtagtcaataatgtcatactaagtctaatttgcaataaaataatcttatattaaaact

SEQ ID NO: 41203 - DNA, 1196 bp, Oryza sativa
gcggcgtggcgtggcggcggcggcattgcgcgcgcggcggcgaaggcggcggcggcgtggcgacggcggcggcggcgtggcgttggcatgcggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagatctggcggtggcagctctcaccccagagatgcggcggcagcggaggaggcggaggcggcggcgaggacgacgagctcaagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccccggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattacattggtacagactctaattaagatatgtatgtacatactgcatgatttaaaattaataaaaattgtactcatcatatgtacttagcgtaggaattatattaaattaaatgctaaaaactctaattaacatatgtaaatgccacatgcatgatttaaacattttagaattcgaatagtcatatataagtagcatatgaaagatagtaaattaaattgtgaaaaactctaatatatgaatgatagttttaaaaatatattacatttaatacttttaaaaattctccagtcaattataattagcatatgaatgatagtaaattaaatgttaaaactgtaattaacatatgaaattgccacttgcgtgatttaaaacttttaaaaatcctctagtca

SEQ ID NO: 41204 - DNA, 8446 bp, Oryza sativa
  unsure (1)..(8446): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggtacatagaaaatgatacacaaggtcaaaatcatgtttttcactcatctactaatggtatgttgacggaggaagggaaaataaaagataaaatttgagaatgaaggagagggagcagatttcatgagggcaaatgagagaactgatcaactttgaagggaaaataaaacgagtagacacaagcagttcataaaatccagaaaggacaataaaatggatcatagctcttgtatgcatgtatgtcatattgtccttggtagtgcataaaggtcttcagatataatttgtactatagtccacatcacaaagtacttaggttgattggtactgatttgccataaaacattacaagttgcactttctgttgaatggcatactattattggacggcatccatcacttgtacactgctaaacccttagtcatgttagataaacagtgcatgcttattattactgcaatgctgcgggtgacattgttgcatccaagatactaaatatcatcttctgaaccaacccatgatgaagaagataaagtttcttagcactgtatggaataccacactatctagctctatcttatttaacttgttttagaatttgggaaactaaggttccacttgatcaaacaaaccaactaggtattgccttgccacttaactgaatgagtacacacaaaaaaatataagtgattaaggctgttatttcgctattccttgttcccaaccggaatagtacgcacggaaaacggagcagtccattagcgcgtgattaattaagtattagctagttttttaacaaaatggattaatttgatttttttaagcaacttttgtgcaactccacttgataaaaaaaacgagaagatatttcgctgccaccaacttcaatgtgttcatacaaaaaatatataattacttatacaaataattgggtaaatagcattaaattgcaattattttgtcaatcatcacagtttgcaatgatatatgtcgttatatcagaaacttttgcagggcattaaaaaactgcaatactagtgcagaatttaataaataacttgcaactccatgaatagaagggttgccggacatatcaagcccatccatcataaccacatgctataccacattaaagtccaacctgagttggccctgtttgagaccaacttgctaaacgatctcatttccagttgagttgcagttttctaatagaactagctagatacccatcaattataatttatttcaaataaaaatgttataaattttaaacttcgaatttgttatataataccaagaagaaaatcatctgtaatttgaaacaaacatcaatgtgcaaataacattattaaaagctacatgcacaagcatccacttgtctgcagaagatccacaaactcaacaggtgtaagggtggcagagtcaccaccaccattagctccttttatgtagagaccatgtgctatccttgcggttttcagaaaaggaggtataccatcgcaatcttgggcaagtgaaccatcacaaactatagggtttggaaaataccaccaacaatcaaagaaatttggggaatatatctcttgactgttaaagggtgtgaaatgaccaattcaccctcacttttcatttagaagggagcaaactatggatcaattatatatccacactaaagcattgaggtggagcatggctgcatccacaattcattgttgatctcatctgcgacaagatagaaaattgcaagaacaggagaaggttgaactggatgttaacagtggtcatccatggaaaagctaagccatagtccaattttttttttggacttcatgatggtattgtgcaaatcttcacatttgtgatgataacttgcaacctgctactattattatgataccaaccaaatttactctttctgaaatgtcttgcggaagaagtaatgaattattgtcgtgatgccattaatttttgaaaaatagttgcagttctatgaaatttaatcaatataatattgttattaaatagaagcaaacactttaaatggttgaaaccaaacgactgttgggaaaaagaatgattaccttcttgaccgtccagcaaagcaatgaaccagaacattgccaccagagctgatagattcatcaatgaaactaaagcattcatcaaaatgctttgccaaatcaatgtctgggctgtcaagtactgtatattggtaaacaaataatgatttaggagtgcttgggaatttggacaagggcaacagaaaaaagagggtataatcacatcaataggtatttgaaacaccatgacacagtcaagaagtttaagtgctccatgcttatttcatttctcttgacattacagttttccagattgagtgataatctaacatgtctggtaaacttcaacacaacagatgaaaagtacataatttagaagtaaatgcagcacatttcttaaacttgcacacagagttcaaataggtatgtgaacttaagcgatgcgcattattactcctaaatatgcatacttcggttctaacttagttcttactggcaatagatgattgaatggctcattgcttcacttacatgacttcctccctccatccctcctcaccctctctactctctctgcatcctgccacaaccctaatttagttgttgcatccccaaacaacttcctcaaaacatagctggctagctggtaagattgaaccaccatgacaaagtgacctcaggcactgggatacgttagaattggggccctcaacactcaacaggcaaagtagaggatacgtgtgaagaagaaaaattaatccagaaacacacttatcagtcactgtggttcgccagagagaaaacaatcatggctttatattgtaggagaaaaaggaagtaaaatgagtgtggcagaagagatggaaaacaaggagtaaatagtgcttcaaaagtgtggggacagaaaaaagcatatgggagggctttctcacaggtgagctttgctgctggtgtagctggaggaggagaaaagggaagtgtggggatagaaactagcatgggagggctttctcacagatgagctttgctgcgggtgagactggagaaaaatggcacatcaaagccacatgagcgcctgctaggctgccattccatgatcaattgaatttaagctgacccacatatgcagctgtaggaatataaatatgcatctctcaagtacatagacctgtttgaaccaaacatacttttttttttcttgaaaacgcaggactgcacttcatttcattatgaagagaaactgtaatgtggttatggtgcaagcaacacattctaaatttatatggtgcaagcaacttaatctgataaaccaagctggcatgtggttaccttcaatcttcttgtagttaaattcagctgcaaaggctggatttaatgatctggcaacaatcaagatatgggttatgttcaagctctttaaagcatccttgttcattgctgccccaacagatcccaagtatagcccctacgaatatgtcaaagatattctatcaaatagatggaaaaagctttaccatagtaatgcattcttcaagcaaaaatacggtaaaagaagcaatatgttgctacttgattggcttttccttgcattcaattgaattggagagctcgtattagcacaatcgagtttcccaatttccaattaatcagtgtagtttctccattcgcgacacggacaatcaacggtgctaaagttaggataaacggtgaatcaatcatcctgtccttcatcgcgagaataaaaaaaaagaaaggcagtctgttttttttctttccatccagttccccagatttgcaccagttaacaagaaatccactcaaatagcgcccgaaagaactcaacctccttggattatccggtgtcagatcgatcagccgaaacctgacctccgacatcccgcggacgcatccatcaccgaatcggcagcacgagaacaaacggattgatcacatcaaggaggaagaagaacatgggcggggaaagaggaaggaacctggacgatggggcacgggatgttgtcggccttccggtagcgtgcggcgcagaagccctgcatcagtgccatgagcaccctggcctgctgctgctcgtagtcgtcgtcctgctcccgcccgtccctctccgagcgccccgcctccggcatcgacatcgtcgtccctccctcttcttcctcgatgattgttggggggtggggagatgtgcctgaccgaataggggaagtggcgaggagagaagcgaggacaccggctgatcactcgcggagcactgccaaggaatacatggtgggcagtggcccccgaaatattcaactatttgccactcacacgaaaagaatttttttcccaaaatccactctactttatttttatttctatttgtcatccggtctcactacaactcgcgcgtgtcattatttttccttttctcactggcgtagattttcaatttcatccagtccaatgtgaaggataagatgaaaagaccaaaatgcctttcggctcacttataagtctcttccctcctcattcgatccgatcgagttgagaagagcaaagcacatgcaaaaaagggagaaaaggccaccaagataaagcaagataaaggaagggagggagaaaagtagagagctattagggttggcattgtctaaagcttgtcgcctcaccctcgatacttgagcctgccgctgccctgctttttgctgccaccacaaccaaggcatattgttgttgttgttgttgatcttcggctttgtcacttgactgtggagtcgtgttccatgacgatgatgtagacaaaactagcggcatgcatatattgcctctgtctcgaaaaactcaacttaggtggagatttgacccatcctagtacacatgtccagatttattgtattagaatgggtcacatttccatctaggttgagtttttgggatggagggactatatgtttgtatgatgtaggggaggcggcgtcacgcccagaaatttagcctaaatttccggactattttgtgtattaaatccctatccaggacaagctagggtacacaaaatgacaaattaatacacatatccaaatgtaaataaagcgtaaatacttacagaagaggcacttattcctcacaccgaaaaaaagccgcagcggcggaaaaaaggcgatcctagcggggcttcagctccactccacaggcaaaactcaactggggtcaaagccttggtcctctaatttcatcttcagctcagaagcactacacaaaggggaaaatagcaaggctgagtacaaccaccgtactcagcaagccacaccaatgatgcagacgtgcaaagggatccaaggatggttcgtggctatttgcataaaggcagttgcaaaacatttatagttgaaaacggtaaaacagttgattaattaaggtaatattaaatctccactgatcaacgctataccacgttgaacaggcctaaccatcccacctgaactaaccagttcattaagccaatttattaagggtgagactaatcacggtgaatctagttgaccgcccataaccgtaggcataactattcgaatagttttactctaatcagatgtgtacaactgtacccacaagacacagccccacgacatgtttctgtgcgctgtcatgccaccatggcataccagaaagaggccatgacagggccattcgcataacctcctctaaccaagcgcaccacacctcaggtttcgcccccactcctcaacaggcagcgggcagccccctctcgtgcctaggtgaattcggaagcagcaaaggccgtcacaggtcccactctatcacgccactcttgcctggatgcgtcagctagaggaaagctacaatacaagtacagccgttgcctacgctggcttgtggtaactatgataggttcttacaggtcatcctgtgaaatggtccttaattgccatggcgcgacaagtaaaaccatgcacctgcagcaatagttattagaaccagaccggactggcggtctgaccaaaaaaaccggaaccagggcgtcggccagtccagtccagctaaaagattggcgagcaaacggaccggtgaaaaccaattgaaccagccgattttctgcagaaccggacaaaaaccgaagttggttcgaccggtcacgttgaggagcagaagctgcagcgttgggaaaatatgaaaaggttttctacagaaccggacaaaaattggagttggttcagccggtcacgtggagaaacagaagctgcatttttgggaaaatatgaaatggttttctgcagaaccggacaaaaaccagagttggttcgactggtcacgtggaggagcagaagctgcagcgttgggaaaatatgaaaaaggaaaatatgaaatggttttctgcagaaccggacaaaaaccgaagttggttcgaccggtcacgttgagttgaagaagctgcagcgttgggaaaatatgaaaaggttttctgcagaaccggacaaaaattagagttggttcagccggttacgtggaggagcagaagctgcattgttgggaaaatacgaaaaaggaaaatatgaaatggttttctgcagaaccggagttggttcatattttcccaacgggaaaatacgaaaaagctgctgttcatacatattttcccgttgggaaaatatgaaaaagctgctggattaagggatcaaacctacaccctcctcgttcccaaggagggtttcaaccaccaggctatgccacatgttgtgactagtgttataacacatatctatttgaaccgtattaaaccggcggtttgaccggttgaaccaataaaccagtgaaccgagtgccctaacggttcatcacaggtccggtcttaataactatgcccacagcccaccattcagttgcactttagttggataattacgaccaatgaaacatggtcgggtgtctagagcacgcaactcgtcatgatactaaatgtctaattagcaagacatgcaattttatttgcaaataataaaacatttgtaaattaggctcaaaatgctcaaggggaatgcatgacttgccttgcttcttcaaaataatcttctgaactctttcctcgcgattgcgatcttccgaaacggcggaatcaacgcgctggaacgcaaaatgaggaaaaactctaacaaaaacctagtaaaaagtacataaaaagttaaaaaatgtgtagagcttaattttagatgaattttgcaagttgaatggcccaatttggagttcatatgaattagttatgaattttaaaagttttaagccatttaaatgaatttcttagaatttaaaccaaatttattgcgcaattaatattagttatggcgagagccgaggggaaggggtggcgccgacaagcggcccccacccgtcagtgactcaaggtggcgggcgcacggtggaccgggtccacgcgtggaataggcgcgggcgcaccacgtggcagccacgtggtggccagggcagcctagccgggaggaggtggcgcccacgtggcgccacgacggtaccgaccggggcagcactggcaagcaacgtggacggcccagattcatcgaggtgaatcgagcggccacgggtgagcaggagaggcgtcagccggccgaccgaccgggaggcggcgaccaccagcgtggcggcaggcgcgggaggcagtagagggaagcgaggagggaaagaggggggcagcggagctcaccgagcgcccgatggcagcgagcagcagcacagggaggtcccacagtggatatggcggcggcgcccgtgggacgacggtgtaaatgacgctcctgttggtggacggaggcgactgggtggcggccagggaagcgcgtgatgcggcgaggccagcgatgcgggcggcgcgtcgcagcggtggccgtggtgatggcaaacggcggctagaggcagtggaggcggcagtgtttcgggtttgctttagggtggtggtttcggcggcgggttgggggaaaagaggcaacagccgggcttgcccttgcggcggggcagccggtgg

SEQ ID NO: 41205 - DNA, 10073 bp, Oryza sativa
gaccccgataggtgggccccacctgttgatggctcggggagaggagggaggagggagaaaaaatagacttgggagacaggggccaaggtagagaggtcggcccgaaaggaaggagggaaggaaggaggacgggatgagccacgagggaggaaaagcaggactttgggccggaagaggcccaaagtgaaaagtgaaggaggggatttttaattggttttccatttaatttaattgattaattgaactttgtgattttaaattacttcttgagctccgaaaattcacgagaaattccaaagagtacattagggcacagagaatattacaaaaatgtttccggccatgatttttaaaggaaattttaatttcctcaataattcacttgattaaattgctttaacttttaatataatttctggaatacattatttaatgatttttaatcccaatcgaaaattggggcgttacaggcggagtggtggtgcagcgtcgccgagaggacgcattagcgtcaattaagtggctgaggctcatgtcgttgtccgtctctctctctccctctccctcttgctgtttgctttgttaaatgtcagggagtggaagggagaacattttcaatggggccaaaccccaatgacatttaggtctttttgccacatcttccatatcaaatagtggtgaaaacaaaaaaagtaacatcatatggacaagaaaaatgaaaatagtggcacacgggagagttttagtggggaccagatggtaaatgaaaatgaaattttgaggaagtggtatatgggcatatgaaatttcgagggagtggcatttggatatatgacatttggaaggatggcaaatagtaaatgtcccgtgcctcctccagagtgctttcttttaaaaaacataagaacttgtgaggagacaataggggagactccattctaacccctccttttactcctctccttctcctcgttccttttttccacttcacttcttgatccaggttattagatttgagatctatgagggcaatttgttgtagaggggagagagatgcgaactcacgcacaggaggaggggaggaagggggcgccattggaggctggggagctagggttcggtttcctccaaccctccttcctccagggtttttacatatgggcaagggagtgggttgggctcgtgggcctagacccaagctgagttggctcacttacatggaaactgctcttttatttatttctattaacatctttattttaacaagcaacccaaactaaaaacctaaatatcttttaatatacaaggtattacaagtggtgacagccctcgagatctctatagttctccctgtccaggtatggagtagagcgtgatttggtaaaagcgagcaagccagtgcctaaattattacgataggattaaacttaagctttcttaagaccttgttcctcactagcaaatcctctctacccctttgcctatttatgccttgtgtccttggatgaacctggagaagagttaagcacacgcgttccctgtggaaattcaataccttggaatacttcagggtgaagtgctacagcggtatatccgtgtgcttgcagattttatctgtgactgtaagaaataccaacaagcatttctggcgccgttgccgaagaacggttgttgtttatctccgaaccttgttcattatcgtatctttttaattttctttcttctacctctacccggatacctttagagaagccttcctgtaaacacttctctaccatggagcacaaacctatctatcaattatcagctcctaggggtgaattttatgagccacctccttcaccgaagcccattcttacatctgggctatgaaattcgccctaaaattataaacatgattagggtgaaatccttctctggcttagatcaagagaatccctaccatcatctgcgagagtttgaggaattgtgttcatgcctcatgattcaagacatgacacaagaaatcatacggtagaaattgattcggttctctctttaagagggagcgaagcaatggtacacatacatcgttgggaatgtaaacggtaactagattatgttgtgagataggttatgcctcgccttcttccatgtaacccatattacatctcttcaggtacatatcctcagttttcggcagattgaaaaagaatcaatcaatagcttgggccagatttactttattagtacaatctacgcctaacttgtctatacccgattatgtgttgttacaacattttcatacaggcttagataaggagtctgcattccatcttaacatcactgctggagagtcgttttttcataacaccccatctgaaggcacggaaatcctagatcgaatcttggaaaatacttcctttgttgagaaatattctgaacccctccaaaaggcatctgtgtcaagtcgtgaggacccatctttagtcgaacctgagtctgacctttccatatctgtagattcaattaaagaatcctctcccaagccatcaacaccggagagcaaagaaattcgaactccaggatgtgctcctgacttcagggacgattttcatgaagattatggaaacaccctgaattatttcaacaaaaagaagccacatattcttactccacctcccgatccaatcgaagatgaatatcttggagtaaccgttggggagttaaccacaatcatgagcaacgaatggttgaaagagaaggagttctcttctaaagtaattcgggttaatacttctcctcataccattccttgccaaataggagggaatactgtaggcattttgtatagtccaacggtgatgtgaccatggctactatagatacaaccattgctcacatcatggatgaacaagatgatatcaagatcaagtcctccaagtgctggaatctgattcggccacctgctacaatgctgacttcaaacagccgccaaatttgcatacgaactccgttttgggcccgttaatacttgatggaaaggtctaggagtcctgtttccaacggatccagcctcattaccaaactcagtctcagttggccgcaatcaaagaaacaaggtgctacgtcacttgtcatgggcctatgggcatgtaacttcgttagggacctcggcccaagtggggcccatgtggggtgcgccccaactaggtggaacatgaccctagggttcctttggtcatccttccaccattataattagctacgtacccctttagagtttcttgggttttgtttagattaaagtttagctttgctactttgccgtgtaatcccgtgatcgattagatcgccggtttactcgttacggaaccccaacttatcatttgtgttcaattcctatctgcaattcagattgcttttatcttgttcttgcttgtttcttcgatttgcttgcaggaataaggttgatctgcaccggcaagatcaacaacccacagagaggtgtatcgatcgctaagacgcaacacaacaacatctcgtacggttgtagtcgggtcgtcaacgtttcttccaaatcatagttatcatcaactcaccgaaagattgggccaacaacagccttgagtgtctcgagtggagctcagggttcatcaggtggtatcagagctttcgttgctcggtgagtttttatctacccataaccagaaaatagccatacaatttttttttatcatttacctagccatattgtgccattgcattgttcttttcagtttttgctttgttgaattttgcgttgcatcgtcacgtcgtgttgctggtcttagcgtctagttcatttagagtttcgagttctggtcacgttttgttccactgttatcgccgccgccgtgttcttgttgtcttcgggacctacggaaacggaatcggctcgctgccacggtttcatttttctagctttagaagtttctgtcggtcggttttggagttgttgagttgtatctaggttttctgttgcgtggttgtatccgtgatgatgcgcctgtgatgtgcgggtgagaaagatggaaggagaagattatattagattggatatttggagaacggttgatttcttgttttagcgcacagtttccaaaccgtgtttccggtttccattgagtccaagtcccacacatgcccagtcgcacctctctgcccagacttattagtcggactccctcctccctctccaaatcacgttatctctcagttctgagtcgtgtcaaataatttggagaaattctgttttatgtcggttttgagatctgtttggaaaaacataaccgagataatttgtgaattccatttttgtataattttaaattttggtgtggacttttacaatcgagtccctgtaattttcatatttatgtttgagtccctgtaattttgcattgaggtccttaagccgttttgttaaaaaaaatttaaaaaaggagagaaaaggcagaaaggtgcataaaaaaaagaaaaaaaaagaaaagctgcaccaaaaatacagagaagaaagaaagaaaagagaaaaaaaagaaagaaagaaagaaagaaggaaaagaagaaaaaaatagttgtatctttgagctgaatttaatatatcagagtgtgcttgagttgtttctggtgttatcttgtggtattgtttgtgtctaggatcgcgtctctagcacgttctagcctaggaccagcacggtgcttgactttgaacaattattcaactttgcattctcttatttgagcatttgctattcctttgctacgtatttaagcctacccagagctccatagaatagattgcagccgtatagcaagtgtttggccaaggcatcgatacatccaacctctatcggggtgcttggttgagttggtgtatatcaccattccgcttgctttggtaagaacttgtaagagtttggttaaaagcttgagtatgtgtgatatcatgagctgccactacctagtagttgataggagcgtgcatattcttgtgtagtgtttcttgtttgctactaaccatggcaggattgagcaagggaataagagatcatcaagttcttcactttcgacgagatatgacgacttctccacgcaatgcatataaggtacatgataatgatcttgcaagggtagaatctaaattgccagtttttgatggtaagtatgattccgccgcttatgttaattgggagctaacagtagacaaacaatttgataagtatgatttctctaatgctcaaatgattaaggctgctagtaataagtgtaccggttctgcttctttttggtggtatactgttggcaataagcttgaaacttgggatgaatgcaaaacaatgatgaggaaaaattttgtgttttcatacttgcttgcagtgttgagagcaatattttaaagaacccaagggagaaacaggttatgcttgtgcctccgattactgatattttgtagggagttcagaacattcaccatgaggagaagagcaatatgctcgagatgtcatctccatcactcacgaaggaagaagagaagactgatgcacctatattatctaaagagggcataaaaggtaaattaaatggtgctgatattactcaaggtgagtgtgcttctgatgagtcacatttgtccactatccatgctaatatagagcaaatttgggtggaaactacttctgatttgcatttgtcacaagttgatttacttgctgttccttgtgataaagaagagttgtgtgataatgcttcacttatatccctaccacaactagtgaatgaacatgctatttctagtgtttcattgtgtgctgattttaagcatgttgttcacattgctaatgatgttgaggaatgtaaattgataacttctttaaatacttttggctatgtttagtttgatgatttttgtgagcttaataatttggaggagaaattatttgctaagtctgatttgccatacccaactaatgctatttttcatatctttggcgaatataatgatagaggaatatatttggtgcatagagttttcatttgttcggattcagagaaacatgttattgctaatcacacaccttcgagtttctctagttttgattggatgaaacaagttattttgaatggactatgtgacgagcaccatatggaaaagccgaggacggttttccatgaagaagggaaggatgatgtgaccatggctactacagatacaaccattgctcacatcatggatgaacaagatgatacaagatcaagtcctccaagtgttggaatccgattcggccacctactacactgctgacttcaaacggccgccaaatttgcatacgagcttcgttttgggcccatgagtacttgatggaaaggtctcggagtcctctttccaacggatctagccgcatcatcaaactttgtctcagttggccacaatcaaagaaacaaggtgctgcgtcacctgtcatgggcctatgggcatgtaacttcgtctggggccccggcccaagtggggccctgttgatgtaagaacacgaggcctgggagatctgcttaactccagtacaggtccaaaaacttgcctttaggttcgtgaacgtgccaattgatttgatcctgcaatcaacaagaaataaagacaagaaaccgtggttaaatccataaacgatagtcgatcggctagttgccgatgacatatcatttatctttgagccaatggcatatgtagatcgatcggcaatcatgaataagtaagaaagaactaaatctactcgatcggctgtagatattaacaatatataatccttatgtcgataggtacttaaatcaagtgattgggatagatcggtcgccatgccgagacagtataaatcatttagatcgaaatatatactaacaacaagactatatatgttcatagcatagccgatcagatagatctagtatgtatcggctaatactccgataccactctatattaagatatcaaagtatgtagaatataccaaacaaaagcctaatatacttaaatgcagcaagatcttaacataaagggcatatttaacatgtcaatcgagcatataagataaaagtggttaaatcaggtaagatcggctgaaaccccgatgctaccctaatcggcaaccaaaggcaggctaaagattaagatcaaactcaactgatgcacctataagtatgaaaagaaggacaatatctagacaataaagccgttggatgtttcatagagtggtagatatcctatataatctaagtcaacgtcagtatttaacttgatcggctgtcttctggcaatagacgttagccgattgaaggttagatagcgatattgccagagattatataagatatatgataactcgacaaattacataaacaagattagagtatcataaagatggaagcactaatcccgaggacgcaaaccgccataacaagttttacctctagttgaagatcgaaaccgatgcagctcaacccgaaagcaagaactcgtcgaaacaaaacgaaagtaaaagggtggcgatgcgccgagattgtattgaacgtgtgtgttagtttaattacatgaggctcagggtctatttatacgcgagattacaagatatgtccatgtcggcacgactcttatctctaacaaactctaagataccataagtctttgcggcagacttttgctcaaacatatctataaggaaattacatgaaatatcctaattaatagatacaattgccttctcagaactctatccatgcatggcaatcctcatgaagcacattaactcaacccgacaacgtatgccgtgtcatattgtcggattcggctcaatcggctaaccttgtctaactcggactctgccgatcctggtcacagctgattcggactttaaccgatcctttctctgtttccgaaacgatttccatcttggattctactccactcctatcttcatctccgatactcagattaccaaatttggttgttaacaggcccatgtgaggtgcgccccaaccaggtggatcatgaccctagggtccctttggtcgtcctcccaccattataattagctaggtagccctttagagtttcttgggttttgtttatattaaagtttagctttgctactttgccgtgtaatcccgtgatctgctagatcgccggtttactcgttacgaaaccccaacttatcatttgtgttcaattcctatctgcaattcagattgcttttatcttgttcttgcttgtttcttcgatttgcttgcaggaataaggttgatctgcaccggcaagatcaacaacccacggagaggtgtatcgatcgctaagacgcaacacaacaacgtctcgcacggttgtagtcgggtcatcaacatttctcccaaatcgtagttatcatcaactcaccgacagatcgggccaacaacagcctcgagtgtctcgagtggagctcagggttcatcaaacggccggtgctaatctgatctctaaatctctcgctttctcctatttgggcaatggagtgataatactgacctacaaattcttcaaacatcatgttgggcagttgattgaaggatttgcgattataaaagatgttcttgttcatcacaataacaaagaggttgtcatggatttccacgcttttgaaatccaagacattgacgtcctaatcgggcatccaattaagaaacttctcatcgacaccatgtaattaggaagcctcgaattctcattaggaggggatgagttttctgtttcattctcatggtcaagatatgccttgaccgatgcccttcctgaagatgaatttgcggaggaagtgacggttgttcttccatttgagccccctgaatctcttcttgaatatgatgtccccgatttcattcaagaggaagaatcgggcgaaacctttgaattgtcgtccttagaaccaccaccaccacggcctatgatcgaaataaaacatcttcctcagggccttcgctatgcttttctacatggcaacaaggaagctcctgtcatcataagtgacaagctttctgaggatgaaaccattcgtcttgtaactgtgttagagaaacatcactctatcatgagctgctctcttcaagatctcaagggcattagtcccgctctctgcacccattgcatacctattgagcttgagagctcactgtcaagggaaccccaaagatggctaaacaatgcgatgagagaagttatcaagaaagaggtcttgaaactcttgtgtgcctggattatttatcccatacaatgtagtgagtgggttagtccagtccagattattgaaccagattactataagttagattataataagccgacatagaataagttgttagctgtttgtttctctagattattagctgtttgttagctgttagccgaccttagtcatgtaaacacggtgcttagattattgaatatcatcaagtttgctttccaaaaccagatgagttttaacaaaatgatagagactcagctggcgcagctagctgctctagttcctgctaaggaagcgggacggattctagggcaacccaaaccgtccctagaaaatgttaaggcgatcaccacgaggggaggaaaatccactcgggatgtcacgcccggaaaaataccttttcccaaacgctagtgtattaatccccgtcctagaaaagccggggtacaccacacaaacatgatacaaaagacgcatctttattatatcgataatatttacattattacaaaggcacttcaggcctgacaatcaaaaataaacagcagcggactagcgggcctacggctccatcttcacaggcgctgaactggggtataagccaggactccacctaggacttcttctccaaagcttctcttactgaagagggaaagattgagcaagaatgagtacaaccacagtactcagaaagtcacaccgggagatgcataattaatgcgaggggatacaaggggataataatagggttaggttttgcagtaaacatcatttaaaagtcagggctgcaggaat

SEQ ID NO: 41206 - DNA, 6609 bp, Oryza sativa
ccatatttttgttgttacgcaagttttaagaagtaaaccactactttggtacattgctaggcttgcccatacccgagggtgcggctattcgaatagattatactctgatcagaggtgtacatctttacccacaagacacgcctttactctgcattccattgcaagtggtatccatcataaaaaacgtgacataactgttgacggtcgttatcgatcagttttgaccgtcaatattactaaaatagaggggaactagtgatgcttgcaatgcatatatatgttagaataataaatttccactagtattatgtatactaaccttttgcagagaatgacaataaagtggaggagaatcgacatcaacacagacgacaaatcaatcggacgatgtcgagaaccagacttatgtatgaatgggccaagaactcagaattgatacaaagaattgggccaaaattcacaagtcagcgaatagaagcaacagaggaggccgctagccgaaattgggctggattgggccggccccaggttcggccgaaccagggagttcagccgaaccctcctcagcgccatccgatccagggcttcgcctggacggtatggattagcccccaatgacggttagagggtatttccgaccattccaaccgtcacaaccgtcattgtgaggctatataaggagttgccattctcacttcactcacagatctcaagcaatagctttctcatttctgtcaagtttagtttagtagtatctagctggtggaataggaatagagtagaaatcaagagtccggaagtcttcggaagagttcaggtatggctctagtagccaaataaatatatagaacaacggaagcttgtctacccaatccagaagcataccgactaggggtttaccccattaagttcaagtcctagaagaagcagacgatacccgcatcactcaaggactaaatctaaaacctgcaagcaaaaggttaattcaagagcaagagtcagtacattaatagaaataatatactggcaagcaccaagacaagcctaacaccctacttgcaaggcatataatcaagaaaggcataatatggttctttttagcataaagcaagttttgtttgcataaaacatttctaagtcagatttgctttcaaataaatttcagcaagctagtacttagcatatgggcattaaagtaggcattaatcatgtataaatattcacctcattgccatccatggcagcaaggagatcattctcaaatctcaatataatttgaaggtaaatttcagcatttagaagaataaacacaagactatactcaatacatatccacatgccgctcgtaaccacgagcacggctaatcgattagtttttagactctgcagagtttgtacagatttacccacatgatgtgaatcgctctagtttatccggtacccgtcggtaccaccatactctacacacattgagtgcgtctagaggtcacaacgaggcttttacattaagtcttgtccaatccttgcatgagcacgatgagtgttgttccacactaagtctagaatcttaatgtcattatattggggggggggggggtctttaccaatataacgccataggcaagccggtacagtcgcttcctatgtggcactcaacgttgtacatgaggcggaacattgcagtcgtcccctcacgcggaacaatacagttgttccctaccaaaccataaataaaagtgaggcggaacgttacagttgtcccctcataaacatcatgcacataaaaagcggatcggtacagtcgtcccctttgcaattcacataaacacaaatagccctaaagttcactcgtaggcactatcgctactacaacggcctcccgaatgcaaggttagacaagcacttaacttaataggccaaggtcaccccataataacacatgtggatgtacagtaaacataatgaacaaacattgagtgaagtccttaggtcggtttgggcgcactctccccctatcggtacacaactaatcaccatatgtgtaccacttgaggcccaaacctaaactccatgttttccatcattttatttatcaaaatcacaagtattaaagttctgttcagattatttcaaaatcaattttcatatttgtaatgaatccataatgataaggaagatcattctaagcatggctaagcattatagtaacctaatgactccaaaactcatatataaagtggtatagtcatattgttcctaaggttaggaatctgggatatggatatatgtggggttagggtgataatgcaagtaataggagtttgtctaacaagtttaacaaaattttaatttattagtgtacaatcaacatgcaagatttgcaaacattttcaataacctccaaaacataggtttaaagtgatcaaagagagggaggtgggacttgccttgcaactgaaaaatgtcagcacctaaatcacttcttcaccgtttaagcattcatctatataaagtacacgttatgcaattaaacaccgaaatatgcgaaaaaaaatccaaaatgctctaaaatgcatgatttgtgcacagaggataggcactggtttaagatgaattttaggtgaaagaatttctattttatctctttttatttgggagttatgaattttagaagtttgctcagtataagatagtatcacctagggagtgttataaaatatttttataaagtgatgtttattaagtttgacttcacagaggtgtagaggagtgttttctaagactaacacatttggtttcataatttttggagttaatatgaattctttatgtattttacaagttataacgtgttctaggcatatagtctctatgaatatatggctttagaagttttatgtccaaaacatgttctatttactagagatgcataaaaatgaataatttagctaaccaatttaatcttagttcaaaattttagagtttatattactctactacatattttataagctagggagtgttctatgttagtgacttaacatattaacctagagcatagtgtgccaagttctagtggttagggacggaacttatgttttctctggtccaacaagttggtttattcatagctagagtgcattttaaatacctctacacatatattttgcttaaccattactatgttgaattccactatgttcactccatttggactaaagatgaattttctacaaattttagaaattaaggtatgctctatgttgcttattccttacacaaatgtttaggggtttttattatactgtaagtatgtctttttattttactagtgaacgtgcttgcacgttccctcacgtataaatacgagtttattatgttttcccactatgcatattaaacagaccacatatctctctgtttacagtttgtcatataaacggaaaacaaccaatgataccaaatatacaatttgtcatagtttgataaatgtttggcataatatgaagtgtacaattgccacatatacatacatacatacatacatattatatatatatgtatatatatatatatatacacacacacagagagagagagagagagtcctttatgtaagttatagcttccttggtcacctggttatgatgtgcatatatgcctgggaagaaaaccctgaaaaacacctaatagaatgggagaaagcaaaaagaattacttgcagaaactattggcaatccctatcactataataaaacagcattatatactttctataatgatgcatttagcataattagttactactcttttctaggtagcacacaaattaaactgaggggcaattttggtgcaccaaacctgtcagatgagtcatttttcataatctataccacaagatttcaacattatcttgctacattcgtttttaattttggtgctaaatctacgtctatgctaaagaaacataaaaaaaactgacttaaaggaaaccaacctacactaaggagccatgcaatgttgtgtaataaaaaaatataatatgaatatttgttgtatatttttttctcgaaagatagtgctctatagctctacctgcgctaaaagactccatttttttttctgaacctttatgttcatcaacaatgttttagctaacctttacaaggcaagttattatagcttcggcatagtttcagcagcatcgtcttggataggaaattgtgttgcatgttatggaataattcaggataaaaataggatgggatctacatattttataaatagattctcactatttatcatgggattagatggaatcatacaaatttttaattcagatgacagagttctcggttgtcaacgtaagcaaaatattattcttccctcacaataatatctccagaagcttctgaagcctgaaaaagatatattggtttacataaacaaccactgagaaatggaaatgctttgcagagctcgtaccaagaaaaataaaattaatagttgccattagtaacttaagaaacaagagctttatttgataaaaggcagatacattcagcaccagcaatctataaaagccaagatctgtagcagcatttagtaatgctgaaaattttacatatacacaaattgtggttccatgttgtttctataaaaagtattcagatcagcttaaacatatatgcctattgagctgcagttaacaacagaattcaaaattattttaagtagcaaggtaattgatatggaggattataggacactacgaggaaattaacaaagtacgtcgcaggaagaagttttgtacattgagcatatttgtatctcaagaagcttgctaataagaaaaattcaagggaactgaatggtgttcctaacctggaaactcaatcatgcgtcaaaatgataggaaaacaatgcaggtccaaactgaatgaaactttatatataaattgatctatttaggcaggggcaatactacttccaacactcttactactctagtgtatctagaaaggtggtggtttatacagagataacactttaatgatagctcaattgaccccaatgtcacgacgttgatggatgatcgacggcagggctactgatgggcaaagaggacatatcgatgtggggagggggggagggggtaggaggaggggatctgtaccttttggagatggcgtccgagggtgcgtagggggtggcggactggatggcgcgaccagcaatgggggcagcagactggacgacggtggaggagggctccgcaacaaacagacactgaggttcactccttgcaaactacagacttgaccccaaacacctgatagtaaccaatcaagtggaacagctgcaccatccacttttgaaactcaaattaggtacctcttgcaatatgcatgagctcaaggaccaaatccccaacatcgctgcaactcctttttatgtcaggattagcagaagctcattttcagcatatttatgcctttttttttttgaagagaataggcttcattgctatacaaacaaaacaattgatttcgaatagttggatgtcaaaatttgaggcctgattttagtctaacatgtatgacaagtgcaataacaacataaacaaataatcttttagaaagatgtcgtctgatgtaaacaaaggatgtcgtcagtttatttcagtttcaatgcaaaatgatcgtgaaaaacaacatgtattatttctatttccttcacagaacaaaaatataaaaattactaagcttcatttccacatctatccaaaataaaagaaaaaaaatagttatattagataacacaaactgtatctgtagagcatcagtcatacataaacaacattgatataagtaattaagtagccacgcttccaatcaaaagtagaccacttgacaaacctttcaccaatttttggcctagaaattgacaaagggatgccgacacgcaccatgtggggcttaggacgctataatcaggagttcgtcttgatcaaaggcaaaactcacaaagtgtattcacagcatttgatgctacatcatatcaatttggggatcaaatctactggaaagccacatggagcaccgcccaaacggaattgcgtcatggtggttagttgctcgcaggacttgtagttgtaccttagctagttggttgtggttgtgcatgggcgcagtcgcagctgtggttcatcctcgttgccacccaatcgaccgccagagccacatccacgtcttccgtcatgccatatctacccatgtaataccccacatggattagaactgattttataatacttagagtactgatagatccatatgtgaaaagaagctcataacaaaggcaagagggagcagcagtacattaagatcccattttatatgtcgattaaatcaaattgaataatcaaagtcatcatattttcctaaagttatcatatttcccttagatttcctttagaagactcaccaagatggtttgttggctcatcaagcaaaaggatggttggattcataaacaaagctcttgccaaagcaatcctcacacgcaccagaaaaatccagagttttctttgcctgcatttgtttatta

SEQ ID NO: 41207 - DNA, 21317 bp, Oryza sativa
attttggtagaatttctatatagttactaaaatttggcagcaaaataaatgtagctacttttttttttgtaaactttaccaaaaattggtaaggttgaaaatggcattaaagtgaacagccctaaaaacaaacaaactccgaactcacggtggtggtgatccaacgggcggacacagaggaccccaaccatgacgaggtgcgatggtccgaggaggaggtcggtgatggtgaagatgtcagcggcgggcgacgctgtcggtcagcaagggctgtgcctcaatcgagccagcgtcggtgaagatggcttcgacggcacgacgactgatagagaggggcggaggagatcgatgcgacggcgctcgcttcaacgacagctgcgcgtggcgacggggacccggcgactgttggcgctgcgagattggtggcggccgggcggagatcgatggggcggtggcgcggcgactgatggggaggggaggggcaacgataccctcgctctcagcgccgatgaggcggcgatgaatctggcgttgcggcggcgcgatggagcgggaggggatggaggagcggcggagcgtcgatgtgcgacggttcgggaaggaatgaggaggcggcggcgtggggattgcagaggttagatcgtgttcccgttctttttttttcccgttctttttttttcgtatgagtagtttcctttttttcgtgcgcgagatatggtgctgtttctttgggccagatgaccaggtgggtcccacgcgaaggattgcagaattatggatgaactcgtactttttatattaatatacataacattgaagtgcatagctctatgatgctatagaacttgtgtttactcaaaaaggatctgagatgaattttatataaacttctaaagttcagctaatctaaaactagtcattttaaaggtaatagttttagaggcatttgatgtaaagtgtgtatatgttttatttcactttgtttttagagaacatgttggtggatctttagaaactaagtttgctctaaaatgagttgaaatgtattttgtatgcattttataaatttgtatatgctttatgtatgatttatcttagatgaattttagaggctaaatttgtactgtgagtgcaagtttttatttcataactttaaagttcataatctagtgagttcaaagaaatttgaatcatctcaaaataagctttatttgattttatatggattttacaagttctaggtttctctcttgtatagtctcagattttatctccagggggtccactgtcagtgatttgcgaatatgcagaaagacccttacagtttttaagaatcaatccgcagtcctaggcccatatatatgtcattgagtggaaagattgtacaataaaccttatagttgtttaaattctcaaaatgaggtcctcgtcttctacagaggcagagcagccatggctgagctcgatctcaggttcaccggaggcgattggtggctcgtttggggttgaggtaaaaatataaaatgaagagaactctctcacgattccattcctctacttttctcgattagtggacatcggagtagcgccggcggcgggtccgagcgaaagatggtttcgggtggtggtgcatgtgactttaggggctggatctagatgaataaagtgcatgaatgcgacactaaagcctcaagaatgctcgccatgagtctagcgaaggttgccgtggtcttggcggcagcggtggcttgcagaacggcttggcgacggcaagaacctcccgggtgaacggcgacggctcaatcggcaccaagaactatcgtgcaaatgtgtccatgaggttagtgaggccagagagatggtgtgtgcgcgagtaatcgagcaatggctcaccggaggaggcggaaacgacaatggcgacggcaaccggaggtgaagaagacggtggccgatctccacactcgtagcaccattcttcgtggttcttgaggggaaatggagaggagtacgaggcgaagacgatggcgcgatggcatggcccggcttggtccagatcggtggcgacggcgacgatgccaccacagcgacgtttggagcgcgctctggagctcttgagggcacgtcggcgttcccgtcgatccgctgcacgagagaggatgaaatcaaaaggagaaattttccgtatggtgaggtgagtatggaacgtggaagagatagggttggcgaagactcgtaggcgaggacgagcgtcgtcttcatcacagccggcggtgagatcgaaggcgaggaaagcagctagagcttgttctctcggtttggtcggcactggagtgaggagtgaggatgggcgatgtggctgggaagagaaggaggctcggctcggcgttgccacgtctcggccacgcgtcgcgcacgcccagagccgatcactctctctcgttcattgtgggtctttagattggtggaaaagttatgcacagagttggagctagcttgtgacaccgtcaagtgggcccaggtcggagcaaattaggtgaggatgagaagtttgggtccagaagcaggtgggcacagccgacacaggtctcaggcaaattccaggaatttttcttgattttatttcttctcccttctttgttaatttatagattaatttttattgcatatgagttcacatggattttattggaggcagatgaatgtacctagtttccattttatttggttgtactaaaaaattatggatagattgttcaaaaaattaggagaagatagactcattggaaaccagtttgaatttttaagaggcttagaagagaagataaattctgcaaaaattatatttattcatgataattaacctaatatttgaataaattatttccctatacactttcatgcagtttaatgcacatttattgagggtaggtttttagccgattaaggattataattaacctactgtttgactggtttgaccgatttattttaggtatcaaatttagttattaaattataccaaaattacagtgagttgcatgtattaagtagagcctacatgaatttttccataattttatcttgcacgaattattttagataattagcaaggtcttttctttatatggacatttccaaatcttagatgcatctaaatagttgtaagaaatttatttagactactcttaatctatagtgatactatttaacctcattttcatgtctttataattattgctcaagtgtggttgtaggtttgattagtgaaactttatcttttatttatgctcatgagtcctagtatgcaatgccaaccaaaaatctaaatgcacaagaaagactcaagtcaaaacatgttttatgcaagtatccatgctttcacttgagttgcatctagtcctaggttgaagatgaaaaagttttaatttattctaaaattttattcacgcaagagttagatcaacttcacctagatttaaaatggaaatttttggttcacaaaattgaagaactttcctttcaactagttttgatggaaatttcttaatcctagaattcgggtatgttaaccggccgggagaggggactgtaccccatttcaacacattttcattccctctccaaagtttgctctcaagctcattcaagctttgatagtttccctcaaattcaaatcacttagttgcatttatacaagttgctttggtgaaactaactggcgggtgaaactcttgtcattcctaacccccgtcgagttagtccgttcttgcttcattgtacagaatgaggaggcgactgtctcgtctattcaagggatccggctcttcatcaagtcatcatgacgagtctagtactcgttcatcagctgatgtttcgatggaggatgccgaagttccgcgacgactcctgaacgacaccgacctcgaccttgtcagtgatcgggagagacaagtctactatatgctgagcgaccgggagtatgctgacacgcaccggagctgctgaaaaagataggtatggatgttgaatttcgttctatttggaaagcggttggttggcagagatttgctgtggtagatgagcctggttctcgtttgcttactttgcaatttctgtgcactttgaaagaaatagaatatggtatttcgttttgtttttccataaggagttcacacttacatggaaaggcttaagtacacttcttggttttcacgattcatgtaaaatcgatctccagaaaggaatttctaggttcgagacaaataggttttgggaagatatttctggtgctccaatttgcaagaaatctagaacaaatgatatccataatcctacaattagactcatgcacaaattgattgctatgactttgtttcttagaggtgatatgagacccattaggggagatgaattgattatcatcatggttagaaagatcaaaattgttcctgtgaaatgtatgataagacaatggttagaaagtataaagttctctgctcctgttgagtgcacttctctgattactcggatagcaaaagggctaggtgtcattagcgaccaaattatttttatctcagctgctcgtccgcgtattgatgaggcttatctagtgcaagggcatattctgaaacatggaatagatggatctttggtatactttttccccggttgtacaaatgaaatcccattgccaaatgcggggtatcatttgtacaactgccatgaactaaccattcccctgtagaccatagaaaaacctcgtgcaggtggaacatacagggagacgcgcaacatgacaatgatgaaacgagaaagttcatcatccttgacacccgtgcagatgtatgaggcaggttgggcaccaaccggggatgcacccggatggacccaagctccacgccatagcattggagtctcaacctgggcaagtgccagtgaggaccggtggcatgcgcctcatgacatccaatggggggacaatcaacctcccagatcaagtggtgtgcctccatctccaagtgaatggcgctcgagttcctcttgttgggacttaggtgaaatcactaggagaatggacacccttgatatgcagacaggggagatccagtacaacttcacggaacacatagctcaaacgtaagaatggcaacaatctgctgatgctcagttcgccaacatcaacaatatgatgcagcaacaacacgatgaccttcaggcgtactttcgttttcaggggttcaatccgcatcaaggaccctgagcgaaagccaagcttggggggagatatctctccccccactgaggtaacttgtatcacattgcatatttccctttccaattgcatatttccttttccaaattgcatatttgctttctaattgcatcttacaaaacttgaaaacaacataaaaatttgcaaaatagaaaaataccaaaaagataggataggattgagtcatgctaggtaagacaagctagttctctttgttgaaatgatgaatagttgctctgttttatatctctgatatatgggttcttggtaagtgctctctcaaaggttaaatataagtagccaacaattatccgggaacctgaggtaaatgggctgcacttgctgatctaaatctaagttgttgcgagatatgagatagtaatatgagttgctatgatcctgatactagtttgacttgaattccggatgttttgtttttcaaaatgataaaattgaaagttcctcatttgatataaattcctaccagagccaaaaaatatgctatcatgattaaaccatatacattttggttacttgtcattccaatgaactttgtcaaactcttgtgacttgtgtagttacttctcatgctctatgatcaagatcatacacccacatatatgcacatgctaaactcctacactgggagctaagcaatattccattccatttccatattaccaccaaaataaattctccatgctttcatgtgctttcttcccctaaagagaaaagtccttttgaaaaaaaaaagagaaagaaaaggagggaaaggcatggtcatgaaaaaatataaaaaaaataaagttatgctccatcaagcatgagcatgatgttaaaaaaaaatatgtagctatgctctctcctaatcaataaaagaaggattttgggagaagaaagtaagcacaaaggggaagcatttttcttttatctttcctcatataccatttccaccatatactacacacacattttgcacgatcttgatcttgagtatgtttagttatctgctttagtctaagtttttgacttagtaataaatgtgaatgcaagtatgccatgtttgatccctaccgagctccacataccaaaccttagagtaggaatcaaaaaggcaacatttggtgaggaattcatattgatacacttagacagactgagcgaatcatttgagaaacttggctttctttagcaaaatcattgaaaacttccggaatgagagttaaataaagattgggtgattggtactctaaattgctgttctgtctttcaaccacccaagacaaggagaagcagtgtctcgtgggaatcaggggtaagggtaagccatcgtgccaaagattatttaatccgagagagagtacatataccttgcacctatatctttgagatatgcagcatagtagcaactcatgatcaacaaccaagtctttgtttcctttcgtccttcactcgggacgagcaaaggttcaagcttggggggttttgttgacggtcgttatcgatcagtttcaaccgtcaatattactaaaatagaggagaactagtgatgtttgcaatgcatatatctgttagaataataaacttccactagtattaggtatattaaccttttgcagagaatgacaataaagtggaggagaatcgacatcaacatagatgacaaatcaatcggacgatgtcgagaaccagacttacgtatgaataggccaagaactcagaattgatacgaagaattgggccaaaattgacaagtcagcgaatagaagcaacagaggaggccgcctgccgaaattgggctggattgggccgaccccaggttcggccgaaccctcctcagcgccatccgatccaaggcttcgcctggacggtgtggattagcccccaatgacggttggagggtatttccgaccattccaaccgtcacaaccgtcattgtgaggctatataaggagttgccattctcacttcactcatagacctcaagcaatagctttctcatttctgtcaagtttagtttagtagtatctagctggtggaataggaatagagtagaaatcaagtccggaagccttcggaagagctcttctcttttcttttgtaagcattgtacttttattagaatactcttctttatacatttatggtattgaaacactttccgagtatatgaatgccaattttacattatgttcatgttacactgaatatacggctagcttatttgggagatgctttggtgcgggtataatgtttgcttatgcaattactctatctcatgacgatgatattagagtagtatctggtagtttagacgtggtgtctagattacgggatatcattatttgaggttatatattgcagatgagaggtgggccgctgatggtgacagctcagtacaggtattcctccgcgccggtatataatcctaagttaatttcctggggagggtattcctccgtatttagccccggttgaatggtcatgacgggctgtcgtaaggaactcggcagtcaggggtggcttctcgaagtaccaagagggcatcggatatagggtattagctagtatatcagttaactagaatatatgtatactatgtataatagaagtataggaatagatttcctttctcttttctttccacttagcttagatgagttattatgagaatgagtagttcatgcttgtctgttactctatccttggattatcttaacccctgtttagaatatgattatcacaagtaatatataaattattagtcaagctctctctacatgatcttcccacaggataaaataaatacgatacccttggaatactcttgggtgaaatgctataatggtatatccgtgcgcttgcggatgaactctgtaaacataatataccagaagtatttctgcgccattgttgggaattatatttccagcaatgtcgttaagaaatacccacaataacccttcacccatcctagccatgaacaaaagaaccgacccaaccctgcctacggccggtatcccgagacaggcaggttaggattgagcccctagcaacaggacctagaccgggtgcgccacacacataggggtgagaccacccgcgtactagtccagtgccatggcatctcgactaacggacaccggcccgtgtagccttcatttgcctagacatctcgactgccgagccgtagctcgtgtagctttcatttgcctcagagatatccatcgtcgcaacgacttcatccatctctatccgtgtccttttattcaggactagactgagcaccgagttaagccttatccattacacgtcatctcaatcagggtttagaattataatcataattatactcgagtatcatagaccatttacctgtacatggtaatggaaaaaattgcccttcgtggctatagttgctgtcatgcccagaaattcccgaatagaattctaagcagaatgtgcattaaaacccccatccaggaccagccggggtacacaaacgacaaagttgacatacagatccacgtcttacaaacattataaaagtcttacataaatgcagcggaaaattaaaagataaatggagctaagccttgacttgaactgcagcgggaacgccactccacaggcatcctcgacggcacggacgaagcctactcctcggagaagccaccatctgacatgtactcaaactctggggttttggggaaaatagagtaaggctgagtacaaccaccgtactcagcaagtcataccggaatagggggtatgatgcagggtataatcaaggtatggctagaaaggttcatttgcataaagcgggcatttaaagacggtagttcaaagcagtaaaacagttgtagtaattaatcagtattaaccaatcactgtccaacgctacaccacgttgcaacaggcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcgctgacatgccaccacgacataccgaaaagaggccgtgacaggacccttcgcataaccccctctagccaagcacaccacacctcaggtttcacccccgtccccagcgggcaacgggcagtcccctctcgtgcctaggtgaatccggaaggacagaggccgtcgcagggcccgtcccgctccatcacgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagtaatccctagtccaatatctagtcatgttatatccccaagctaacaaaggagcatggtacagaaatagcatggctgtaacagtaggtaaagatcccatagtaacattataaaacgatgcagtttttaaaggaaaacgatagagcatttgcaatataggatcaacatgttcaagtgacaagcatgacttgcctcgctctgctgctggaggaacctcggcgactatttcaaagtacaccggagcgtgaggagagccggaatctaagcgacatacaaagcaaacaatacaaacatgctataagactactgaaacagagaacaaaatcatttttaatggattctatgcatttttcttgatttactgagacttgaatgggcttaaacggagctcggatgaattagatatgaattttagaagattcactgtgtttttactacaaacagaaaaaatccttaattgatttattgcgcaatatatcccagggctgacgtcaacaaaggggggcggcgccaacatgcgggccccacatggcagtgactcgggtggcggtccgcggtggaccgggtccacggaccgcggaaggaggcagcgcaccacgtggcgctgacgtggcgccgacgtggcgcacacgtggcggccacgtggcacgccacgcgggtggccgaaccgacggccccgatctacccgagggtagatcagatggcggaggggagcgcacgttcggcgcgcacgggcggctcaagccggcccggcggccatggcgcacggcggcgctaccgcggggcggcggtggcagacgacggcgaccgacggctagcggcggcggcgcgacagcgcgggcggcgctagcggcggctaagtggctaggcggcggcgcagcggctaagcggtgcgggagagagagagagagagagagagaggaaggggaggaggtgtctcaccgacggcgattgacgacggcgagcgacagatggcgatgccggcgacgggacgagctcctgaaccacctagcgaacacggtgaaaggggttagagagggagaggaagatggaagaggcgaggacgccggccgaaggcggcggccatggcggtggcgcacggcgcggagtgggttccagcggcggaatccgacaggagaggggtggatagggtggcccgcacgacggcgaacgcgatggcgtctacggcgtggctcggtgcagcggctagagacggctagcggcggccagagcggtggcggcggcggcggaaaagagggcgacggtgctagggctatggagggcacgggaacggatggttgcaaaacgaaaaagagaggagggaatggggaacctttatataggcccacaggggtcgatcgtggccggggtgaccgcgatttcgccagcggagtggggagaggtggggaggagagagaggtgggattcaaaaattgaatcccggccgtctcgagtgcgggcgcgggagggagagagagggagtgggcgcggggaaggcgggcgcgagcagcgacgtgggcgatgtggcccgggagacgtaggagcgaggggcggcggcactgattggaggtgggagacgggcccgataggtgggccccacctgtcggcgaccccgggagagaggaggggctcgggcggccggcttagctgggccgtggccttcggccggcctagcagggatggggaggaggaagagaatgggccggcggcccattcgaaaaagaaaaagaaaaaggaggaaatgaattttcctgggattaaatattgcttgtgctcatttttaattggttaaaattatttctagagctctgaaaattccactaaaaatcttgttagcacatttcgacatgtagaactcaagaaaaactccacatgccaattccgattattatttgcattaatttatttagggtttcactcttgcttttacaccggtattttctcgagaccaattgtaaattcaattttggcttgggagaagaacttcagggtgtgacaaacctacccccttaaacggaatctcgaccccgagattcggaagagctggtgaagaggtgcggatgggcggccttcaactcatcttccttttcccaggttgcttcttcttctgagtggtggctccactgaaccctgcagaacctggtgaccttgttcctagtcctcctttcactggtctcaaggatgtgaactggcttctccacatatgtcagatcttcttgaatgtcaatgtgttccgaatcggcttgttcttcgggtaccgtcaaacacttctttaactgggacacgtggaatacgtcatggataccgaccatgttggatggaagttctagctgataggcaacttctcctcttcgttcaaaaattttgtatggtcccacgaagcgtggtgccaacttgcctttcatctagaaacggtgtactccccggagcggagtaacacgaaggtacacataatcccctgcttcaaaagtgagctcccttcggcggttgtctgcgtagctcttctgtcgagattgtgcaattctcagcctctctctgatggttctgactttctcctctgcttccgttagcacttctgttccaaacagttgacgtttgcctgtttgatcccagaagagaggtgtgcggcacttccggccatacaacgcttcgaacggtgccatttgcagactagcctggtaattgttgttgtaggagaactccgcataaggcagacttttatcccaagctcctccaaaatcaagcgcacaggctcgcaacatatcctccaaaatctgattgacgctctcggtctggccatctgtcaacggatggtaagctgtgctgaaattcaaacgggtacccaattcttcttgcaacttctgccaaaattttgaggtgaactacctccctcgatcagatactatctttttgggtactccatccaaacacatgattcttgagagatagagctctaccaaccttttgcctgtataagtagcgtgcactggtatgaaatgagcaactttggtgagtcgatccatgactacccaaattgaatcgtggctagatgatgtcctgggcaaacctgtgatgaaatccatcccaatctcttcccatttccattccgggatctgaagaggttgaagcagtcctgcgggcctcttatgttctgctttgactcgctgacaaacatcgcagagtgcgacgaattcagcgatttctcttctcatactggcccaccaaaatttctctttgagatcttggtacatcttggtactacctggatgaatggagtactgagtctggtgagcctcggtgagtatcagatctttcagctctttgtcatcaggtacgcacaatctttctcccaaccagattgtgccatgttcatcttcgtggaaatcccgggcttttccgaccctcatattctttttcagttcagctatctcaggatatttacatgagctgctctgacttgatccacgagcgtaggccgtgcctctagagcagccacaaacccgtgttctacgattcccaagttgagatgtttaagctcctgctgcaattccttacacatgccctcagtgcacaaagcattgcagtagctcttcctgctcaatgcatctgccaccacattggctttgcccggatggtagtgaatgctcatgtcataatctttgattaactccaaccatcttcgctgtcggagattcaggtcaggttgggtgaagatatatttcaaactcttgtgttccgtatatacttcacagcgatcgccaatcaggtaatgcctccagatttttaaggcgtgaaccaccgctgccaattccaggtcatgtgttggatagtttccttcatgcagacgcaactgccgtgaggcataagcgaccactctgccctcattagaatgcatccaagcccatgacgagacgcgtcgcaatagacttggaagtctttcgtctggtcgggcaaattcagaactagagcagacactaatttcttcttgagctcctcaaaacccttgtcacactcggctgtccacttgaatttctcgtctttcttaagcaactgagtcataggtctggcaatcctggaaaaattttcaatgaaccgacggtaataacccgcacgtccaaggaaactccgaatctgtgacactgtcttaggtggggtccacttggtaactgactccacattcgatggatccactgccacaccttgagcagtaatgacgtgacccagaaatttgacttccgacaaccagaagtcacacttactgaacttggcatataactggtgctccttcaacttctcgagtaccagacggagatgttgctcatgttcttcttcggactttgaatagataagtatgtcgtcaatgaacaccatgacaaacttgtcaagaaactccataaacactttgctcatcagattcatgaagaatgcaggtgcattggtaagtccaaaagacataaccgtgcactcatacaacccataccgagtggtgaaagctgtcttgggaatatcctcttcccgaatcctcaactggtggtaacctgatcgtaggtctattttggaaaacaccttggctcctttcagctgatcaaacagatcatcaatccgtggcaaagggtatttgttcttgattgtgacctcattgagtgcgcgataatcgacgcacattctcttcgtcttgtccttcttctccacaaaaatgaccggagcaccccaaggtgaagtacttggtcgaatgtaccctttctgcagttgctcatcaacctgcttcttgacctctgccagctcattggctgccattctgtacggtctcttgtaaattggagcagtccccggtgccaaatcaatccggaattcaatctctctcttgggtggcatggtagtgaggtcctcagggaacacctctgaatactcgcagactatggggatatcttccaatttcctcgaacttttctccgcggtgaccaccgaattctccacctcaatctgatttaaggagattccctgcttcagtgcgactggtgacttgtacaccactgtttcccctctctcattggtcaaggtgaccgtgcgattcgcacaatcaatgatacccttgaacttggtcagccaatccatcccaagaatgacatctaggtctttggattcgagaaggacgaggttggctagaaatggtgatatttggatttctattgttacagaagggctgaattaaaccgaggtggaactattcccgggggtatgaacccgtattggtgtactaagctcttctcttattagcccatgttccccaataaacttctttgaaatgaatgaatgcgttgcaccagaatcgaaaagtactgttgcataaattgagttgacaggaaacgtacccagtacgacctctagtgctgcttgcgcctcttccgcggacgcgtggttgacacgagcttgggcaaaccttggcccagcacgccttagcttcgggcacttgtcagcaaagtggccatgctcgccacagttgaagcaggaccctggctttactccagtctccttcttggcttggactgatggagctgcctgtgctgtggccattggtgggcgcggagctgcactgcggttgggctgacctcccgggtggttctggctgccactggcgacctggtggaagctacttgagttgaacgggcgatactggtggacaatcatggtggtaggtccaccctgctgtccgggagtgaagcgcggtcgctggtgacttccttggttggaccggaactgcgctgcctttctcttcctgtccattttgttgcgctgatcctcctggcggattgccttgtctaccagcttctcgaagtcagcgtaatccctagagatcaactggttggtcagctcgtcatccaggcctgctaggaacttctcctgcttctccgcgtcagtgcggacatcctccggtgcatatcgcgcttggcgattgaactcatggaggtactcagttactgccctgttgccctggtggagtgcctagaattctctcttcttttgtgccacgaccccgtctggcacctgtgccttcctgaagctgcgacagaactccgcccaagtgacctccgtacctggcggacgggtagccatgtgattgtcccaccaagctgacgagggaccctggagctggtgtgtggcgtaggtgaccttcttctgatcattgcactgcagaagattgagcttcttctctatggcatggaccaatcattcgcctccatggggttggtggtgctagagaaggtgggtggcctgacgcgtagaaacttcggcagcttggactgagggggagggggaccaaactgctgctgctactgttcgacttgctgctacatcctctggtgcatctgctggtgctgctgcagcatctgctgcatcatggccgccatcatctgagtctgatgggccatcacttgtgcaagcgtcgggttctctgggagcggtggcggaccattgccagaggcgctgttgggatatccactgtcggtgtgctcttcgccattgctgccctcaccggctgcgcggctgccattcctgatgttgaccatctgaaggaagagcagacggagggggtggaaaagaagaaaaacagatgctcaggaactaagctttattatagaggaatttaaactgcaattgttctgatctgaattaaaacacttaaaacagcaagcaaaatccttattaagacagccacatcataggcacatgatgtcgaccgtcgactgacccacaagcgaacaaacctagacacacaaactaacaggcaattactaagcagtcgataaactaagggaaaacgagcctaatgctcggaacggctcctgcggttggtggagtagaaggcgtcctcctgctcgtcgccgggtccctctgagcggctcctggagtctggcagatacgtcttgccgctgtccggctcggagctactggaactgctgctgctgtggtcgcggctgccactgggagtagcaggcaaccaacctccgttgccactggctggacccctggcggctgacgctggagagaaggagagagcggacgccggagctgacactggaacgggagccggaaccggagctggagctgcgagcgctgcgggaactgcgggaggtgctggaggagctacgtgtcacgcctggaatttctatccaaaattccaaacgcttacatgtgtgttaaatcctcgtccaggaatcagccgaggcacacaataacaaattgataatagagtactattaaacaattaattaatattcgcaaattaaataattattacagaggtggacaattcctctcgaaagaataaaattctacgcagcggaaataaaaacaaaagactaaacagctatggcgactccactccacaagcaacttgacccgaacaaagcctaatcctcctgatcatcaccttcattgaagtactcctcctctgatgaatgaatattgcaagaatgagcatatgacatacttaaaaagccacacagcaaatatgcaagtgcataggataacaaaggatgacattatatagcttatttgcatcaacaacaattaataaacatttgagaatagtaaaacagttgagtaattaagcaatattaaataaacactatacaacacacccgtgttgcataggcccaacctcatctgaacaaccaaccccggttgtacagatcaaacctccataccaggaatataccattccaaaccaagagtcaaattaattatcacagtattatcattaatgagtagtgcgatactaatcacgaaaaacattgttaaactcacccataatcgcgggcacggctattcgaatagttttactctggccagagatgtaccactatacccacaagatacagctccacaatatgttaccatgcgcctcgataccaccacgataccttggaaaggaaccgtgacaatacctctcacacaacacaactcaccacagtgcgccattcctggatcataatctccccctcaaaaccagaggcaatggactccccagcgacccctacggacttctcgccgcttcacagtctggcaccccgtaatgaaccatgctatacaaaaggtaaagccgttgcccacgttggcttgtggttggcacgattaatgtttcacaacagtagctcgcgaatcggtccttaattgtcatgagcacaaccatcaaaaccatatgctcacaacccacctttaatcagcttttaattatcaattaattatcataacaagattaaccatcgtgagctaccattagatataaccataattaataatgtagtatgattcatcccattaatgagctaatgtttctaagcatggctaagcaattatacatatagcatttagctgaaccaaaccaatatataaggttctagctaatcaaattataacccataggaaaaataaagtcattttcggccattaattaattgggaaaggctcaccacccgatgacattcgaaaataatgcataagttgaaataaaacattagctttaaacgggttcaacatgctcaaagggttgtttgggatctgtgtgacttgccttaagcttccgcaaacgcttctgaaccttcctcaacgtaaacgctctcctccggaacgtcggaaactaaagcaaataaacaaaatcaacaaaacagtacaaaaataagcataaacagtatatgtggatatttttaacatgtagatctcgattttagatgaatttagcaacttgaaccactcgaatccgagttacgatgatttagttatgaatttccgaagtttaatcgattttcatctaatacagaaaattattacgaattaaataaaggatttatgacgtcacgatgacgtcatcgccggcctagcactggacgacgctgccaccggtgatagtgagctcggccgggctatccgaggacaccaacacgaagaggacgacgacgcgaactcaccgtgcaaagaacaacgatggacgacgacgaacgacggccggcgacgaggtccgacgacggctcggctcgggtccccgacggcgacggcgctccggtggtctttggcagctgcgaaggggcggacggggtgctcctccaccgtgcgaacccggtggcggcgacggacggcgacggcgacgacgctagcggcggcgccacgcggatggagcggcgtcggcggcggcggcgctagagctactcggcggcggcgctacgggcgacggctcggcttgggacttgaggcaaacggaagaggacgacaaggggatgctttatataggcttggactagagagatcggactccaaatgagaggatttgagctggaaaatccgagggttagtttggagagataaactcgaaaacgaattcgattcggtttatccgggcaaaattaatctccgagactttaggggaaaggaagaggataaggaggagataatttcccctcaactaattttaggaaaacacaagagaggtcggatttggaggggaaaaaccgagcccactcggtctcagttcggctgtcctgaggttgaaaatgaacagtgcaaagggaagcaaattagactttcggatggactgagaacagaacagggaaagaaaagggcagctcgacttgggccggcttgggctgcacagcacgcgcgcgagggagagagatgttgggctgaaatcagcccaacggcttaggagacgattttaaaaacttttccaattaaaataattcgcgaaatgatgtttcatttattaaaaatactttccttgctcaaataattcccagaaaaatctagaaaatagataaacaagcaaagtatttaatgaaattttatctagctcaattttatgttgaaatttttcctaggttattagtgtttaacttgtaagcttttaaaataggcgattttcatagcgtgacactgcgggaggaggtgggtccctgtgtgcaagctgaatgcgtacgggtgtagtcgtcgacttgcggggcgtggtgcggatccggactcctcctggcgctgggagacccttcaactgagcgttctccttcttcaggcgtgctatctcatccttcagagctatgatcctcacaagcttcccatcattcaaggctttggatgccttgtgcaggtcagagtgcatcctgtccattcccctcatcacggcgcacatgtggccgaaggtggtgtcgttctcgccgactgtcgggcggaaggtgctgatatcgttgccacttgctcggcgagggtggaaacggtacgccgtgttgcagaagatgtagctgtggtgatcacgaagcctggccatcattaggtatgctgcctcctgataggcgtgatctgcggtgcctccagatgcctcaaccaccatgttagcgaggctggtgcccaaatagcaatgaacctccagacgaacacggtggggaagctcgccactgagcggcggaacggtcgagtactccggcgcgttggggtagcccaccaccaaggtcatgcgagccaactcagccacaaaatcatccatgccgtctccgcggtggttgggttggtggtcggccatctagagaagacaaaggggtaggatcaatgcatgctcaaatccaatttaaataaagcagtaaaaaaaactcaattaaaatgaacaaatgagagcagaattttgtcaattaaaactcaaatagatcatttttgcatgagagcgaataaataagacggacttacatagcgataaaataatgagaaattagatacatactaataataataataagagcataaatacctagcaacccatattcctgagttaggacctaatgcattcctcccatcaaatcccgactgactgtcgaataaatttcaaataattttactaaaaccctagactgacctaatttgacaaatctcacattaaatgagcgaccaagatttttcccttgaaccacaagaacagatcccaattttcccggaacaaatccaattgcaaagaacacatgcaatgaaaaggattgtcctacggtcaaggttggctctgataccaacttgtcacgcccagaaattcccgaatagaattccaagcagaatgtgcattaaaacccccgtctaggaccggccggggtacacaaacgataaagttgacatacagatcaacgtcttacaaacattataaaagtcttacataaatgcagcggaaaattaaaagataaatggagctaagccttaacttgaactgcagcgggaacaccactccacaggcatcctcgacggcacggacgaagcctactcctcggagaagccaccatctgacacgtactcaaactccggggttttggggaaaatagagtaaggctgagtacaaccaccgtactcagcaagtcataccaaaatagggggtatgatgcagggtataatcaaggtatggctagaaaggttcatttgcataaagcgggcatttaaagacggtagttcaaagcagt

SEQ ID NO: 41208 - DNA, 11883 bp, Oryza sativa
agtattaaccaatcactgtccaacgctacaccacgttgcaacaagcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcactgacatgccaccacgacataccggaaagaggccgtgacaggacccttcacataaccccctctagccaagcacaccacacctcaggtttcacccccatccccagcgggcaacgggcagtcccctctcgtgcctaggtgaatccggaagcgacagaggccgtcgcagggcccgtcccgctccatcatgcccacccttgcctgtatgcgtcaactagaggaaagctacactacaagcccagccgttgcccacaatggcttgtggtaagtacgataagttcttctagggcatcccatgaaccggtccttaattgccatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagcaatccctagtccaatatctagtcatgttatatccccaagctaacaaaggagcatggtacaaaaatagcatggctgtaacagtaggtaaagatcccatagtaacattataaaacgatgcagtttttaaaggaaaacgatagagcatttgcaatataggatcaacatgttcaagtgacaagcatgacttgccttgctctgctgctgaggaacctcggcgactatttcaaagtacaccggagcgtcaggagagccggaatctaagcgacatacaaagcaaacaatgcaaacaggctataagactactgaaacagagaacaaaagcatttttaatggattttatgcatttttcttgatttactgcgacttgaatagcttaaacgaagctcggatgaattagatatgaattttagaagattcactgtgtttttactttaaacagaaaaatccttaattgatttattgcgcaatatatcccagggctgacgtcaacaagggagggacggcgccgacatgcgggccccacatggcagtgactcgggtggcggtccacggtggaccgggtccacggaccggggaaggaggcggcgcaccacgtggcgccgacgtggcgcacacgtggcagccatgtggcacgccacgcgggcggccgaaccgacggccccgatctacccgagggtagatcggatggcggcggggagcacgcggccggcgcgctcgggcggctcaagccggcccggcggccatggcgcacggcggcgctaacgcggggcggcggcggcagacggcggcgaccgatggcggcgtgatgagcggcggcggtgcgacggcgcggacggcgatagtggcggctaagcggctaggtggtggcgcggcggctaagtggcgcgggagagagagagaggaaggggagaggggaggaggtgtctcaccgacggcgattgacgacggcaagcgacggagggcgatgacggcgacaggacaagctccggaaccacctagcgaacacggtgcaaggggttagagatggagaggaaaatggaagagggcgaggacgccggccgaaggcggcggccatggcagtgctcaccggcgcacggcgcggagtgagttccggcggcggaatctgacaggagaggggtggacgaggtggcccgcacgacggcgaacgcgacgacgtctacggcgcggctcggcgcagcggcttgcgacggtagcggcggccggagcggtgtcggcggcggcggaaaagaggacgacggcgctagggcgatggagggcacgtgaacggatggttgcaaaacgaaaaagagagaggagggaacggggaacctttatataggcccgcgggggtcgatcgtggccggggtgaccgcgattttgccggcggagtggggagaggtggggaggagagagaggcgggattcaaaaattgaatcccggccgtctcgagcgcgggcgcgggcgggagagagagggagtgggcgcggggaaggcgggcatgagcggcgacgtgggcgacgtggcctaggagacgtgggagcgaggggtggcggcggttgcgggatgcggcggcgcggctggaggtgggagacgggcccgacaggtgggccccacctgtcggtgaccccgggagagaggaggggctcgggcggccggctcagctgggtcgtggccttcggtcggcccagcggggagggggaggaggaagagaatgggccggcggcccattcgaaaaagaataaggggaaaaagaaaaagaaaaaggaggaaatgaattttcttgggattaaatattgcttgtgctcatttttgattggttaaaattatttctagagctatgaaaattccactaaaaatcttgttagcacatttcgacatgtagagctcaagaaaaattccacatgccaattccgattattatttgcattaatttatttagggtttcactcttgcttttacaccggtattttctcgagaccaattataaattcaattttggcttgggagaagaacttcagggtgtgacagttgcctcctgctcaaggacttaacaataagagccactatacagaggtaccacattgctaattaacataatgactaggtcagtccccattctagaaactgcggtcgcacccgttcgtttgacataagtacctggtgacaacttatatcgatcgagacagtactagccatccggaaatcatccaattcgtatgtcctgtcccaatctaagtataaaacattttaaccagattgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaggaggggaggtagatagggttccccggcgacggcgagcggcgccggaggggttaatttggtgtgtgagtaacctagcggctagggtggcggtgacatggatgagctgagaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaacgacggattgcgaccggaaaaacctctcggcagcgaagaacagagcagagcaggggcggcagtgctcggctcggtgtgacgaggtgtcgacgcagagcttcggttaggctttagtatgctagaacatggttgaatataggtgttctatgggttggttagggtagagggtggatggagtggtgtgaagtcgctcgcgcacaaggtgttcgaccggcgggcgaggatggttgatgagatggattggtaaagcagagctttggggttgtggggttatggttggtgatgatcgatgatggacaaggaagggattggggtcctacttatagggtcacaagatgtcgatgagctcgggcgccatcaacgccattgatgagctcggaaattgggtatggcaggggtggtagaggtgatgcagcaacgggggttcccgatcttttgatgagaggaggataaacttcgatttgggggagggcacgacgttggcggtccgactacaactaccacaggggtgctgcgccttagcaaccggtacaccgactccacgttgttgctgttcttgccgtgccaagaacaaccttgaacctgtaagcaatcgaagaacaagcaagaacaagatgataaggaaacagctcatggcacctatcctttctcaaatgcaaccaaaccaaatcaccaggttcaaaagtaacatgtttctttcctttgctcccagcaagtttatacttaatattcatgcgctctatgttctccttagtggtctcatgcagttttaacatcaattcagcgcgctgttttgcatcaaagttcactctctctgaagttgggaggggcaaaagatcaattggagtatggggcagaaggccataaacaatctcaaaagggcacttcttagtagtagaatgttgtgaacgattataagaaaactcaacatgaggcaaacattcttcccacattttaatattctttttcaaaacagccctaagcattgtagataatgttctagtcacaacctcggtttgtctatcagtttgggggcgacatgtagtagaaaataaaagtttagttcccaacttagcccacaaggttctccaaaaatgactaaggaattttgtatcgtgatcagaaactatggtgtttggcactccatgccagcgaacagtctcatgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacatgcaaaggcatatacaaactatgagggttaaggcgtgacttagctttttggcatgttgtgcagtgagcaacgaacctctccacgtctctcctcatcttgggccaaaagaaatgatcagtaaggatatccttcgtcttcttcacaccaaagtttcccatcagccctccaccatgtgcttcctgcaataatagcatacgcacggagctagctggaatgcataacttattagctctaaacacaaacccattggtgagaacaaatttgttccaagtccttccctccttgcaatttaacaacacatctttaaaatcatcatcgtgcgcatattgctcttttattgtttacaagccaaaaattttgaagtcaagttgggatagcattgtgtaacgtctagacaaagcatcagcaatgacattttcttttcccttcttatgtttgatgacatatggaaaaaattcaataaattcaacccatttagcatgcctacggttaagttttgcttgacttcgaatgtgtttcaaagattcatgatcagagtgtataacaaattctttgggccataaataatgatgtcatgtttccaatgttcgcactagagcaaacaattccttatcataagtagaataattcaaactaggcccactcaatttctcgctgaaatatgctacaggtttgtcttcttgtaacaacacaccacccaatccaatcccactagcatcacattcaagctcaaaagttttgttgaaatcaggaagttggagtaaaggagcgtgtgttaacttatctttcaaagtgtcgaatgcattcctttgtgctgcagaccaagtgaatgtcacatttctcttggtaagctcatgtagtggggctgcaatggtgctaaaatccttcacaaagcggcgatagaacccagcaagtcctagaaagcttctcacttgtgtgatagttgttggaaccggccagctatgtatggcttcaaccttggcttgatctacttcaattccctgcggagtcataacatagctaagaaaagagactcgatctgtgcaaaatgtgcacttctcaaggttaccaaataaacgtgcatctcgtagagcatcaaaaatagcaggcaaatgaccatgatgatcctctattgatctgttatatatgagaatgtcattaaaatataccaccacaaatctgccaatgaaagcacgtaaaacttcattcattaatctcatgaaagtactgggtgcattagtgataccaaagggcatgactaaccactcatataggccgaatttagttttaaaagctgttttccatttatctcctaacttcatgcgaatctagtggtaaccactacgcaaatcaattttagagaacacaagtgaaccactcaattcatcaagcatatcatctagcctagggataggatgaggatatctgattgtgatgttgttaattgctctacaattcacactcatgcgccatgagccatctttcttaggaactaaaagcacggggatagcacaaggactaggagactcacgcacatactcggggggggagaactcttgcacttgacgttgaatctcctttgtttcctccgagtgggtcctgtatggtacacggtttggcaaagaggccccaggaatgaggtcaatttggagctcaatccctcgaattggtggcagccccaatggaacctcctttgcgaaaacatcagcatactcctgcgaaatgttagtgaccggaggaggcaaagaaataggagtatcctcaattggaaataaagtttgtttgcaaaccaaagcatagcaaacaacagtgtcagtgtcaacttcatccaaatctgattttgtttcaatgaaacaagatcccttcagcttaatctcatttttattattttgaatagagttggtggatttcttcttatgcttctcaagttcattagccacaatatgatgctagtatgctcctgtttttttgtttgctagctctagcaagttcattctttaaaataacttaaagagacataggatgtaacacaagtttttttccattatgcacaaaggagtattgattggatttgccaaagtgtaaggaatctttatcaaactgccatggcctacgtaataacatagaacaagcttgcatagacacaacatcatagttgattgaatcatgataagaaccaatggcaaaatgtactcttaccaatcgtgttacctttaccttgccgctgctattaagccattgaatatagtagggctgcggatgtggctgtgtgctcaatgcaagtttcttcaccatttcagcactaaattattgcagcttcatccatctatgatcatgcgacaagagcgttccttgatcacacacttggtttgaaacaaggtgtggcgctgattctgttcagccccttccatttatgcgcttagcactcgctgcaccacgaggctctcatagtcctctgcagcctcggcccaatgtgttcctcatcttggtggggcgcgtcgccttcccctgcattgttagttgcaagcaaagcataggtttcttcatctaaatcactagcggaggagtacccaccatcagctctcacgatcattacacgagtgcttggccagtccttgcgcacgtgaccaaagcccttgcagcgtaggcactgaatatctcttgtccttcctgataatgccactgatgatgagctcttggaagatgtagcagcaacccctcttgtgggttcactcgggcatggtgtagagtttgttgtagagggacgcaacttgttgcttgaggacgatggtgctgctgctcgagttgacggtgcagcagcgttggaaggggtccaagagctagcacgacctgcagaaatgttagtcctgaagccagctcttcgtccctgcacttccatttcagctttacaagcaagatgaaacaaacgatatattgaattatattctttgtaggctagaatgtcctgaatttctcggttcagcccacccatgaatctatccataccagcatcatcattttccaccaatccacagcaaagcattcctgtttgcaaagcttgataatactcttctacagatttgttttcttgtctaagttgttgcaatttatgcaacaaatcacgtgcatgatatgaaggaacaaatctagatcgcatgaatcttttcattgcatcccaggtttggggagtgttatttggattggaacaaacaaattcactccactaaatggatgcaaaatcagtgaactcactagtagcaaccctaacacgtttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtgcctcccgccgtggtggagcgcccatgccatggcgctaccggcactgttgtcttcgttgacgaccaagtacctcctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagctccactccacaggcaaaactcgactggggtctgagccttggtcttctaacctcgtcttcagctcagaagcactacacttctgaaaagggggaataatagcaagactgagtacaaccaccgtactcagcaagccacaccaacgatgcagacgtgcaaggggacacaaggacggtttgtggctatttgcataaaggcagttgtaaaacattttattgagcaaaatactaaaactgttgagtaattaaggtaatattaaatctccactgatcaacgctacaccacgatgaacaggcccaaccaacccacctgaactacagtgcattgagtcgattcattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggatccttcgcataaccctctctagccaagcacaccacacctcaggtttcacccccactcctcgcaaggcagcgggcaatcccctctcgtgcctaggtgaatccggaagcgacagaggccgtcgcagggcccgccccgctccatcacacccacccttgcctggatgcgtcggctagaggaaagctacactacaagcccagccgttgcccacgctggcttgtggtaagtacgagaaattcttccagggtttcccgtgaaccggtccttaattgccatgggtgcgactagcaaaaccatgcacccacagcccacccttcagtcgcattttagttggataattatgaccatgaagcatggccagatgtctcgagcacgcagctcattctgatactaaaaggtctaatattgtaattatcccatcaactgagctagtggtaattaagcatggctaagcatatagttctagctaggtcacataagtaacatgagctagtcgatttattacccaatgttgacaaaggacatatatcaagtaaatatggcacaagcgagcagataggtaaaccctgatcccatgtaattagcaaaacacgcatatttatttgcaaatagtaaaacatttgtaaattgggatcaacatgctaaaggggaatgtgtgacttgccttgcttcttcactttgatcttccgaactcttttcctcgtgaccgcggacttccgaaacgacgagaactacacgctggcacgcaaaacaaggaaaaactctaataaaaaccaagaaaacggtatataaaaagtaaacaaacatgtagagctcaattttagatgaattttgcaagttgaatggctcaattcggagttcgaatgaattagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcagtggctcaagggggctcggtccaccatggaccgggaccacaagggcggtccaccgcccgtccacgggatggacggcccagatcggcccaagccgatcgggcggctgaggagagcggtggccgggcacgggcacagccggggctggcccgaccgaccacagagggcggcggcgcgcagtcaccagcaacggcggggggcgggcggcacagggagcagcggcgcgcagcgcgggaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccggcgatgcgttgcggcggcagccagggtgaagccgaacggcgaccggaggcggaaaaaggcggccggtagggtggtatggcaggaaggtggttctggtggtggaggggaaaaatggatgggcggccgagcttgccctcgcggtggtaaagctaatggcggccgcggggtggctgagagcagtgaggtgtggccggaggcgacgaccggagtggcggaggatggtaacggcttgggtgggtggtggaggtgatgactcggccacggattggtggaacgaggcagtggccggtgctctgcttggagcggcgaagccgacactggcggtggtgcggcttggcggtggctagcgtggcgaggagaggcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggctgcaggaat

SEQ ID NO: 41209 - DNA, 12913 bp, Oryza sativa
  unsure (1)..(12913): unsure at all n locations
gcgatggggttcaacgtggagagctcggtagagggcgtgggggacttggtaaaacggggaaaaagtaagaggaggccactaggattatttttacagctcaagggggcgagtagagggccgggtagcggcggatttcgagggggagtggggcggcgtcttgggggtggtggcggcggtttttcgcgggacggagtgggggaggggagcggggtcgtgggtgacgaggtcccacggtcgggcaggagtggtgcagggtggaggaggtgggcggggaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtccccccctcttaggcctgggcaccctttttatctggtcaggggtcaccacaagggcctccagctgcctaagaaaggaaacatgctttttacaatgagggctagtctacagccggaagtgacctctgacaagcagagcacacgcctcctgcccgctcgcccgcttttccggtggacgcccatttcaaccttcatttaatggccagcgacttccttgccatacttgcgctgaagcctggaatggttctgaccgggactaacataccaactccaggagttagcacgccggctccggctagggacgagagccaggaagctctcatcattccgacgggacggggcgaggcgtgtgacaggccgcctgttgccacctaacccgtgatctgaccggtctgtgaccggtcacacaccgcgactggtcacggaccggataagcgtgcgctgcgtcgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctccgggagacagagggaggggtggacacntcaccctcgggcccgaatccttcccctttcgagggggtcaggccacgtgggtgaccgcggctacccaagcctctagtcacgatacccctggccccagtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataatgagcggcttctttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatctgccgcgtgcgccgcaaacgagcgagtgggttagtggaggcgtgggcgcgagaagccgggtatagcattggcaagggtgtaaagacgtcgaggaagggattcgttcctttcctctcgccactctcccccttgccttcgccacttgtgctctaactcttcgtttcctgtgccctacccttgccgcactcgctcgctctcaagctcctcctccgccggcgtcatggcacggagctccgcaccgctcgacggtagcgtgctgccgccttcccgcatcgtgagcgagaggcaggccgggctgccgcgccgattcatgccagaatccgccaccggccgggaggtggtcgcgctgggcgagggacgcccgacaccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttattggggtgcgcccatctctccggctgttccggtggttcttcaccgtacagccggtgtcgccgccgacggtagtcggtggctgctacttccagccgcgggggcaggtgctgaaccgctacattctctgcgtcctccgcaaaaagtgggatgactggaagagcgattggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccatggtgttcggtgactaccttcatcgccggatcgcgctgctccagcggcgcgcccggggcgcctgggtgtacaccgggcccgaggactacgtgaggacccaccaggggcgcaaatgggacttggaccctgaggacttcaggatggtggtccaacgggtgctgaatctcagctccgtggaggcatccctcatcccccaaggggtcctccccatctgctgcgatccagagcgcgccaagatcctggccatcatgtaggtggtcggggcgtcgggggagcgggccccccgaggccacgatggcgcgggcgggagccgcaggagggaacaatctaccccgggagggggtcgtgcttctgggccccgcgacgggggcccgggggtatccgccctaccgacgcccgggggaagaggaagcaggagggtacccctcccccatctcctccccgagggggcggggcggtgcgtgccagcagcaggcgcccggagggtgctgtgtcgacgccgcagcccgagggggagcgaaagaagaaacggctccgcaagatggggggaccgagccatgccgggagagcctcatctcgcccccgaggtggtcgtttagccgacatccccgcaggttcgtccccgcgcccaccgcgagttttcaaggcgagttttcactcacccgtttctttttgtcttctggtttttcttctgcctaagcgagatcccgtcgcgccctccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctagactccgccgggccggggagtccgtccgggaggcagaggcggcgcgcgcacgccaggcggcctgccaaacccccgacccgactccgcccgaggcgacgccgacttccgaggccacccacgacgaggccgcgggcgcgccgctcgggcccgacccctcgggcgacgcttgggacgagccaggttcgggggacgcccccgagtccggcacgtcgatcggcgggccgagccgcggggcacccacactgaggcggctctcccctctgccttccgctgccccactgagcgcggagcccctcctgcaggccttggccgccgcgaacagcacggtgctggacgggttaagtgcccagatggaggccctgcatgcggagcgggcggagctcgacgcggcgtgggcgcacgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgctgcccggggagtccttgacgccgccgctgcccgggaacggcgggcggcggagaacaaggcggcgtcccggcagcgcgaagaggcccttgaggctcgcgccacagcgctggaggagcgcgcccgcgccctggacgcgaaggagagaaacctggcggaccgcgaggccgcctgcgctaaagaggagtccgcactccgcctccgcgaggacgcgctcaccgagcgggggcgaactctcgaagaggccgagcccgcggcgcagcgactggcgaacagcctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggcagcaggcgggcctctggggcgggcggtacgcgaagtacaccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccgtgggcagcactggaagatttccctcccggaaccgaggacggcgcgcgcgcgcaggtccgggattccgccgaccacatcgtccacagctttgagggtacggcccctcggctcgcgttcgccctcgacttcgacgaggagggcggtgacgacagtgcggacgacagcgacgacgaggccggcgacccgggcgcgtcggagtgagcccccaaggccccgccaatcttaataacttttccttcttcttccgaggccttcgggccccctttttgtatagactgatttaatctgcaatcaagtaaagaggaaatttctgcgtcagttctgtttgttgtgtgtataagacgaggatggtctgtgccgcggtccttctgtgtcttggcttgaacaagggctagtgcccaggtcccagcctcaaacggcgcgggtcggggctagtgcctggggagatccacgtgtcgagactggccaggccgggagagcggtgaccgagggttatggatgacccgattgtgggcctttgccgattcccccccggagttcaccacgccccgggaaacggctcggttctgggccccatttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaagataagtatatgcatgtggtagcccccggccaaccctgcacgcccgggggggtgcggggttggcccgagcccgagacatgacacccgacccccactaggggtagaagcgacgaaggtgttcgatgtttcacgggttaggcagctctgtgccgtcgcccgtggccagccgaatggagcccggccgggggacgccgatcactcgatacggaccctcccacattggtgagagcttgctcagtccggcacgcgtttggacgcggcgtaggacgaggtcgtcgacgcagagtgatcgggcccggacgtggcactgatggtagcgccgcaggctctgctggtagcgcgcgccgcgcgccgccttcgctcttccaaatagtcgaggtcgtctcggtgaagctgatcttgatcagcctcgcaatacatggtgacccgaggggacctcagggtgagctcagatgggaggaccacctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcattggcgcgctccacttggccattgcttctagggtgggcggggtaggcgaagcagagcttgatgcccatgtcttcgcagtagtcaccgaagagctcactagtgaactgggtgccattatccgtaatgatacggttgggcaccccaaaccgaacagtgatgcccctgatgaatttaagcgcggagtgcttatcgatcttgatgaccggataagcctcgggccacttagtgaacttgtcgacagcgacatacaaatactcgaacccgcccggggcccgcctgaacggacccaggatatcgagcccccagacagcaaacggccacgaaagaggtatggtctgcagggcctgggccggccgatgggtttgcctggcgtggaactggcacgccctgcaccgccggatcaggtcgaccgcatcgttgagagccgtcggccaatagaaaccctggcgaaaggccttgccaaccaaggtgcgtgaggcggagtgggctccacactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggccccgaggcctggactccgacgggcctcgggggccgttcaggcgcgtccgtctcccctagggggtcgggtcgcgccgacggctgggcaagcctttcctcaaaggcgcccggtggggtctgggctcgcgaggaagcgagccttgagagttcgtcggcgaccgcgttatcccgtctgggcacgtgccgaagctctatcccgtcgaaatggcgctccatatgccgcacctggcgcacgtaagcgtccatctgcgggtcagagcactggtactccttacagacctggttaacgactaactgggagtcgcctaacaccaggaggcggcggatccccagtccagctgccactctgagccccgcaaggagtccctcgtactctgccatattgttggtcgcccgaaaatcgaggcggaccaggtatctgaggacgtctccgctcggcgaggtcaacgtgacccccgcaccggcgccctgaagagacagggaaccgtcgaactgtatcacccagtaggcggtgtgaggcagctgcgaggggcccgagctggcctcgggggcggagacgggctcgggagctggggtccactccgccacaaagtcggcgagggcctagctcttgatcgcgtggcgtggttcaaagcgcaaatcgaattcagagagttcgattgcccatctcaccacccgtccagtaccttctcggttatgcaagatttggccgaggaggtaagacgtaaccaccgtgacccgatgggcctggaaataatggcgcaacttcctcgaagccatcagaatagcgtaaagcatcttctgggcctgagggtatcgggtcttggcgtcccggagggcctcgctaacgaagtatacgggccgctgcacctttcggcggggccaatcctcttcgccaggggccgcatctccagggcgctcttcgtccgagaggccacgcggggcgcactcggcttctgtgccgatgacctcggggtcagagggcgacaggcgcagccttcccgcagtggccccggggccatcctgggggtcgggggcgcctggcaccgtcggacaagcaggcggagggccagctccgaccgtcgggggccttgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggtggagcggagacttccgaaagtttccgctagatccgagagtaaggtctcttggttgcgcgtcttcacaaccaagtcatcaacataggcctcaacattgcttcctatctggctacccaaagaaattcgagtagtacgctgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttggccttgggaacaacgaccgggttcgccagccactccagatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggacccctggcatgtctgccggtctccaggcgaagacgtcggcgtttgcccgcaggaaggagacgagcgcgtcttcctatttgtcgtccagaagaccaccgattcgtgtggtcttggacgagccgtcgcccagggcaacctccttgaccgggacctcgtcgcacgtgaccatccgctgccttggggcggccgggacggaggtgctgagcctctcgtcgccacccgcgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccctaggaccgcgttgtagggtagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatgtccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggtgggagccgccggggttttgccctcacagcgctcctgcttcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcacaggcctcccctttcggggggcccgcgaagcgccctcgacggcgaggacgtgaccctcgtcgtcggaacgggccgaccccttcttcctcctcctgtcccgccgccctgaccgagcggcggacccgggggcggccgaagctgccacaccagaatcggaggagttccaggtccaggcctcctccttttgagccacacggtccgcgagctcaaaaagctgcgcggtggtctggggctccttggaggcgatcttctcgagcatgcggttgcgccgtacgccccccctgaacgcgtagatcaccccgtgtgcggggatgcacggtatggtgttgcggacttgacagaaccgctgaatgtacgagtgaagagactcatcgtcccttcgctgtaccgcatgcaagtccgcttcttcgcctgggcgcggatatatgccctggaagttcatggtgaactgctggcacaaatccttccaagagtggaccgacgcgggtggcaagttcattagccaaccccacgcctgacccttcagggccatggggaagaaattcgccatgaccctgtcgtcacccccggcggcctcgatcccggtcgtgtagatctggagaaactcggcggggttgacgcttccgtcgtatttttcggtgatggtggggccggaaccttggggccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgcgtcgcgccgccgctcgatatcgaggcgggcatccggccccccacgcacatcttcttgggtcggaggcgttgacgagggaatggcggacgaacggcgggtaacggccgccgctcgccgcgccctccgcctcgacgacatggagccggcggcggcagcgccagaggcctcggtggcggaggaccgcccgccggcgcctaggcgctgctgcgccgccatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacacgccccgtctcgccgtcctcccccgtcgcccgcgggcggtgaagtcgcggttccttcgacctccccgagcgcctccccccgcccaagatttcagtgagagggggacggtggggtgcgagcccgacggcgcgggttctgctccccgtcgtcaccgctagcgttcggagagaggctgtgcgccactgcccgttcggccattaggctgagcgggagaagcttggtgcacacgaaagaggacgagggcttaaaaagacacgcgcgccccctacctggcgcgccagatgacggagcgtggggctcctcaccgggagaccgcgcaggcccccctttgccggttcggccgggggcgctaagtgaggttctttgccctcgatctgaggaacgtccgcgagagaggaagtgcacaagacacgggcgacgtagataggttcgggccgctgggaagtgtaacaccctactcctgtgttctagtggatctgtgcgtgaaggaatacagagagctggagagcgagccagagttcagggtctagcacccattccccttttttctcctccctccagagtcccctttctttttttcttttctcttttctctccagagtccccccctttcctaggcctgggcctcctttttatctggtcaggggtcaccacaagggcctccagctgcctaagaaaggaaacatgctttttacaatgagggctagtctacagccggaagtgacctctgacaagcagagcacacgcctcctgccccgctcgcccgcttttccggtggacgccgggctgcaggaatt

SEQ ID NO: 41210 - DNA, 2355 bp, Oryza sativa
ccccccccccccccgagggggtcaggccacgtgggtgaccgcggctacccaagcctctagtcacgatacccccggccccatgtcaccgacacctgcatatacatatacacgaacacttgtggaatatgtgagattaagcacctatcactatattggatgttttattatctgaactttatgcagatgttgtcggtatagaatctgcatttaacatccgccaacattcactaaggtttagggtaaaggaaataattagggtaggttaaaagagttctaaagaaataatacttgaaccaaaattaagaataaaaagagttcaaataacaatgattttaattttgctaatatagtcaaaagccagcatgatgcagtcaaattttagtttaaaatttgaggatgttacaaacctacccaccttaaataaatctcatcccgagatttgcttaggagtcttcaaaaagatacgggaattccaattgtaaataatcttcccgtttccaggttgcttggtcctctgtatggtgattccattggactttaaacaactttattaccttagtgcgagttgttctttgtgcttcatccaaaatagtagcatacaacataaagagtctcatgaaagaatcacatattcattaaccaataatgagttatctatttcaaggaacaatatcggataaatatgtaaatatagtatgtgatacaatcatctctatgattgcctctagggcttatcaccaacaggtatgatggttatggaacgcgaaaagacacttctgccctccaaccgtcatttaggagctcatctagaccatccacgcgaagccccagttcgaacggctgtggtagtggttggccgaaccatgggttcgaccaaacccaggtctggctcgacagagcccatcttcggcctgttgctccttctctgcgtcctctatccatttctgtgagtggaaagcccatttgaagatgttttctggtagtttttggcccactcttggtatggataggaattattcttcactcaagtctatttttggtccaactttggtggtttattacctgcatacaaatatacaccaacactcgtggaatatgtcagaatttaaccctatcactatgttggatgttttatttccttgatttatgcaggtattggtggcataaagtctgtcattaacaacagccaacagcctcatagttaaaatcctccattctcgcattagcaagttgcttttggtgcaaagttaactggcgggtatattgtcttgtgctaacccctgctcgagttcgctttgtattcttgcctttgtgcagtcatgaggagacggctctcccacttgctcaagggatccggctcccgatccaaccagtcgagcgatcgggcatctgccgacgtgtcaatggagaacactgacgctgtaccacagctcctgaccgacaacgacctcgatatcgttgacagacgagagaaacaagcctaccagatgctgaaggaccgatcattcgctcacaaccgagcgtacgatccaaagctactccggaaaacaagtatggatgtagattttagtgtcatttggagaaccatgggttggcacgcctttgcaacggtagacgagcttggctcttgtctactaactatacagtttctgtgcacacttaggctcttgtctactaactatacagtttctctgcacacttagagaagcagagggtggtgttactttttgacttttccgtaaagagtttaatcttttatgtagtggattgagcacacttctcggtttccccgaatcctgtagagtcgatttttggaaggcaacttccggttttgagaaaaacatattctgtgaagatatttctggtgcaccgatttataagaaacccagaaccaatgacatccataatctaactcttaggcttatgtacaaatggattgccatgtctctgataatgaattgattattctatatgccatggttcattagaaactattaagtgtggcggaaggggcggacgctgggcgtgtccacgtcggattttgctacagtagctacagtgcgaggttggatttttgcgaaaaagccctccggttcttcgtaatcaggtataggcccctcgcgtcctgtgtttgaagagaaaaaatcgcggacaggggcttcgttgtgatatgtggaagacgaggggctttttcgaaaaaatactcccactagcgcagacccctcaaaccctagccgcttgctctccctctctcgcgccgctaccaagcactgccgcctccgcctccccctcacgccgtccccgtcgcctcgcgccgccgcctccacccccgccgccgcctccccatcgcgctgc

SEQ ID NO: 41211 - DNA, 7093 bp, Oryza sativa
ctgtcgtcgcgtcaccgtctccaagcgcctctgcttccgcatccccctcgcgtcgtcgccatcatcgtccccgtcgccctgcgccgctggcgccattgcgtcgccgtctccgaccgccgtcaccgagtgcagccgtctccgcctccggcatccgtcaacgacgaggtcggagcgccgacggctgcatcacaggcggcgcgaaaagctgagggcccaatcctggcggcgggactgccgcgaggttccggacgcatcaactcgagggggagacggcggagggagtgggggttgaggcgggcgcggtcttcgtcctcccggcgccagatctgcttctcatctccacaaggacaccccagcccaccactcatcggcgtcgccatggtcgtcggcgtcgccctcactgtcgccgtcgccaacagactgcgttaagaagccacttcaccaccagcagcagcaggggcatccaccgtacgccgcaccaatgccttccccttccctcccatctgtgccctctgggtcacaggtagtcgcttcatcggcagccgcgttgccgtcaatgtacaaggccaatgaccagcagcgagcaactcatggcaccagagacggcggtggcgacggtgactactaaactcttggcacaggagcttacaaaggatgtgcaggtttgtgtgagttgttcttttaaggttgccatgaggaatagttaatctcgttttttcccctatacaccatgaattgttgcacatcaacattgacagtgattttcatttttttattaatgcaatggagcaacctaactattataccaatttaccaggtgctctaatgccactgttggtgatgaaattttgagagaccctaatcttgccatgtttatgatgttctacagaacctgcatccattccatctaaaagaactcatcagctgggattgaagtactgatcagatctttttttctaggtgaactctagaagaaagttcgaaaaatgggacattgcaatcacaacattggaacctaatatcaacactatgctcattgccataggttctcccatttgtatagcatttagagatttctttttttataaaaaaattgtgaacaatttccataaactcacatcaaggtgtctcatgcagtgccaagtaaagaaagggactacaatgcttattcaaaggattatatgtcttccatagtgaagcagtcttgcactaatactagaagctgctttagagatggagacatcccatcaaaaatctgcaattacccaatgagtgagccattttttccccatgataacttactatttcagatatgtatttctatacatgtggcaccttttcattctagtgtttttttgactgggcttttcattccagtgttgtgcctgaggatcatataaatgactctgatcaatcctccaccttagctggttgctctgcttgctgtgaccatgccacgacatccgaaaacacagaggaccaggttggttagccatatttcatactcgttgccctctgaacaatcaatagagaatcacttctagcaatctgttatgattcatttccagatgcattaatctattctctttcttagtactttacttggtattttaggttttcttggggcttagttatagaatagggttttggagtgggtttgtggaggggtgattggaaagttgaaactcttttgccgcgaataaatctgcagtaacatgcctatcatttcacttcagagccaatgcatttgggtaatgtctcaaaatttgttttgtatttggtggtttcggcttttttggttgaaggaatctgcaatatatcatgcttccccaatgagtgagccattttttccccatggttacttaatatttcagatttgtatttctatacatgtggcaccttttcattccagtgttgtgcttgaggatcatataaacgactctgatcaatcctccaccatagctggttgttctgcttgctgtgaccatgccatgacatctgaaaacacagaggaccaggttggttagctatatttcatactcgttgccctctgaacaatcaatagcgaatcacttctagcaatctgttatgattcatttctagatgcattaatctattctctttcttagtatttttcttggtattttaggttttcttgggacttagttatagaataggattttggagtgtgtttgtggaaaaatttagaagcttcacatactggatgaatttttttagtagttagcgtattggttattggcagtcaaatttttttagtacaactggtaggaggatgagcttatatttggcactattattcaaaagatgttaatctcaatctcccattttactgtacttaatgtttcttaaatgttaaatacttaaaatgggactgcagttggtcactgatggttgcttgatagccataaggaaaagagagacaaaaataattaattcatgcagaggtttcagtcaattgcaaataatatgagattggttgacttaaaattgaggatggtgtggtatgatgagcctctgttgatctgatcattttcctttttcatgtcaggtttgacacctttggattgcataccagaattttccatgttcttcagctctcaataattcatcttcaggtaatatgatggtagtccaggtttttagatgatttgcatcaaggggtgaaaataaattgatcagcactgcaacattgatctttcttatgggttgtcgctttagctaccacaatgcttatttgcaagctcgtgatgtgttgcaaggtctagagtagtctagtgaaacctatgtcataagcgccacaattccaaaccgaacctcccccagtgtactgttcgatgtggctgctatagttcttttactaaaagtatgtaaatttatttgttctatggcttgtgtagaggagaaagggaagtgaggaaaatttgtaagtgaagaatttgacagattgcgacgggcaccagttatgctggtaattttcttgaacctgacactaatttcagggtacgtacattcttaatccaagccacaacaatgtctgagtggttttatatgtcgaccatctgtagtgtcttcttaactgttgattctgtctcaccaagactgaagaatgcatttctcttttacctatgtgtattcagtactatgaggtcagatatgcagatatacttcttctacttcataaatttgtggaatacagataagctagggcgaagataaatatggcaggttaaactatccgtggatataaaatatgtcatcaagccttagatttttcaagattatcaggaagtgtatatttcagactatgtatttactttattttgtttcaagtgatgcaaagccagatgatttttggtcttgtttacattgtatcggtccagaggttttgttccttagaatcatcttcaattgtatgagcaacatattccaagctgctcctttaaaggaatcactcgctttccatatatgcagtatatttttattacacgataacatcactattaattggtatctatatggaaattaaatcatgccaatatatccagtgaaaccaagtgctattggttgatagcagtaaacatgtgttttctctggcattttaagttgcagtgttctgatgacttctaattactaatgatgtgatgcatatattctatggctggttctgttatttctttttatttgaatgtaatttgcttcaatgatttgatgtggttaaaggagaaaatatctaaggccatgtttggtttctcaggagtccaggagttggagccatgcaaacatgcatcatgctaatgtcgtcctgagcttccagattaggccctgctgtattgatcaatatattcaggtcagttgaggctctaaattaattctgatgataatttttattctgctgtatttgacgggcctcatgcatctgaagatctggattactgtggccgaattcgtgttctgattttggggtgtaaaatactgaaatcaataccgctgtccttgctttcatggggggtatttggtgatttggttacttcgattacatcgagttggaatgtcaatgctctctgaacctcgaatttattactgggttaccgcattagattattggcttcgcaagctgggccttgtgcaaatgatcctgcgtgaaatatgcacataatttgcttccccagacgagtttctgctaactattctatagatcatttgcataacccagcagccagctgtttctctcttcttccttttttcccctctgaacatgtttacttaggtcaatttccagacattgaaatgtcttgcaagattaaaattcaaggttactccgctcattctgttttgagagagttcaaggctagaagagtaaagttagtaagcaaataaaaatgatgcaaagaatatacttgatcagagctaagaatgctctcataagtcataagtctgaactcccagaaataaaacgtcaagctcttcgaaacatgatatatgccatttaaaccttaagtgcccctttcagttttaagagtagaagccatgtcttcttggatttcttttgattttctgccaaatggatcgtctcctttctagagatctaaaatagacttgcacaaaagcatgttgtgtatgctccccaattcttctccttcaactacacaaaaacacagaagataagcttattaatgaagagcggagtgtgcctgtttaaattttacctggaactaatatgaaatgaaataagcagcaataaaacgtgacagggatttatcattgcattgaaatgctacctcacagtgttacatgattatgatgtttctttcttctttcttttccttttggcatgataaaatgaaaacaggatagaagttggtttaattatgaaaaggccatggattttctacagcattatctgtggtgacttatttgctactcttcatgcactcaatgctaaccaaatgcatgaatagaatgagaaaatagtcccaggtatcgggaaactgtatcagacacatgcccattcattctaacaacatttcagtttgattctcaaaattcttcatgccatcaaagtaaatactatctgcactgtctcaaatcaactacaaagctgtcaataaaaaaacgacaaagaaagggaagaaatggtgaagatagagcttactacttattttaagcacatgtcttgattctcttgagggctcaatcacggacccctttggtaatttgtattcatccttgaaaagtgaaatgaaactgtggagaccaaggtgtcaaagacagaacaaacttgtgtagttatcattttaactcgacacaggtatgctaagattggaacttacgcattaacaaaaaaaagtggaacaacattatttactaaatagagtgacaaacctgaaactataatatgatttatttttctcagctgatgattagttctgaatcagtattgctcttcttcacaaatgacctctctctctctctcagcatgatgacagcattatttctatacatgaggatattgtgtatccggataagaatagcattatttgtaggtaagacatataagaagtaaatatatttctaatttataaactgagaatgtattattaagtgctttaacatgtcatatgcagaagttgctggaatgctagataatcttgtcctcttttaaacatagcatgggaattatagtagaatcaagatgctttcctttgcttggtaaaaatgttttggactgcatttcagaactcagaccatcatctatttcagtgtaattacattattctgcagaaagacacacaaaactgtcatggaaatatggaatagatagttctatatttataaggcatatagttcttaattcatttaatcaagccgagtgctattttgtgtggttcatgaatctttgcattacctgtaaagctgtggtttatatatttctttgggagctaggttcgcttggtaatataattgactggtagtaatatacattggttgcactttgaatgtgctgagaatggggtcaccttgcatgcttttttatattcttaaataatgatgaattttcatgtgaatgtatgtatagcatccacattgttcatgtcactgattaggaaaaatgtattatttgttcatgtatatctcatttgttctgtgttactataggctggaggctatagaaaaatatttcagccttgaaacagtcaaggacattgtggaagccatggtgagtgatgcttcagttgttttatacttccaaatctctgggcatggtatgtgctccttttcatttgaacatgagtaaacagaatgctgttgattggtacaatagctttcaaggctacattttatttccatctcattatttactcaaatgaatctcgtggatatttttttttggaattatcaagtattttttcaaatatagtagttatcgttaccgttttggcatagattttgttccttagactaccttttagtttgatcttgaaggttttggttccatatagcatatacataaattttgcttatggttcaaaacttttaaggagatgttgtaaacttgtaatcaggaaagtgaagcatctaagttagatgaggattgttgtaccttggccatgaaatgattgagagagccctatccagttctgttgagagcctcacagtgtttggtaagtaaagaaaatagaaatgctcacactgccattgccgatggctgacagattttattatatgcctgtcctacagatgaattgcaagctacaaatgctttgctgtagatatgaattgcaagcttacagaaaaggttgtgcactgtgggctaaaaagtcccattaaccaggaaggtgagtgttgtttttctcctttaatataagaatttgctacctcaattttttttactcatgtcagcactgagatataatactgatacatggattgatgctgaattatatacatactccctccgttttttaatagatgacgccattgacttttcctcacatgtttaatcattcatcttattcaaaaattttatgcaaatgtataagatataaatcgcacttaaagtactatgagtgat

SEQ ID NO: 41212 - DNA, 22176 bp, Oryza sativa
aggtagtatttctctagcttttactcatacgattaagatttcttttaaatgtcaatatatcttctttttatgtatttaagcgtccctttgtgcttttatttttggtttgcaagttgtttatgtatttcatttaagaaaggtgtatggattacatgtatataatcctcgcaaaaaatgcatgtatatattgtggatttagccatctattttccctgctctttcatgctttcaaaagggccagcggtcacttggtattgtgtgggtgctctgcacatgactatttttataaatatgtaaatcatgtttgcgtatccctgcatcttatgctagacgttgattagttttcagcaaaaaattgggaagttatacttggttgaaatcagtattttgtcgatggttgtcataaatatatcaaaagttctaaactagaaaaaaaatggtatccccaaatctaaaatatttccttatgagttcacgttaaatgaaatggcctcatgcatatacagatgagtatctaatggaatgattcactcatttaccaaaaagatagtacaatattattcatcatagaatgctaccatcaccgccactatgtttttttatattagtaaaagatggatgagcctttggagacttattagttattaagttacttatgcttttctcactttcagcttgaaggatactaatattagtaattccacaaatgacacaatagatatgctacaattttggctccacttacactatcctgtatatggctacaaaactgcagctgtgagaagatagaatggcattacttcaagggtaaaatcctttttttttttggtttataacttgatgaatgtgattttgcaaaatactcctatatattgctgctacctcataaaaatacatccatggatcaatgttcctctagcactgataggcctagaaacaaggttgtccttttttcccttagtgtgtgcgcactatgataagatgttactattagggtattagtatgtacctgcaggtctgcaggttcttttgaatgtgatttaattagctaatgtttgctttcatttcaacctgtttacatttttcaggatgtgatgcgatgctgaatctaatattggaaagtcgagccctttgttcttcaattgtcctatttgcaaagattatgacctttaaatttgtcatcaattatttatgacaccaatgcattctcttggtgtatgtaccaaagcaatttgtacgcggaattacttatattttttatataatgaaagcattgtgttcatgtttgaactaatagtgtaacaaactgaggttttagtaggggatgctttgcattgataataaagtgcccattactttgtagttacatgggatatttgttacatagaatggattactgactcaagtctggtgtcattgatatacacaggagagtaatatagaatatatgatgttactaatatatttatcaattgattgatttagtacatggacgtattttagtgtatgcaggcagcgcgcaatggcgcgccctagcatctagtaaaattaaagtttctcctgtgcaacctatgagtaggcaatggttacaaagtataaagttccctgctccagttgatctgttctgtctctcaattgcctaaggtggtgagaagcgggtgttctacaatttttaggcgtaagggtaagcctccgtgcacatttacttaacatgagagagagagtactcaaactatgcacttgtacattttaaatataacaatggtagcaactcctgatcaacaaccaagtttattttcctttcgtcctttacttgggacgagcaaaggtttaagcttgggggtttcgttgacggttgttacagacaatatttgactgccaatagaactaaaataatgaagaattagctatgcttacaatgcatgtttgttttcaaataatatatttccacttgtacttggagaataacatgttgcaggaatttatcaaataaaataaagagaaattggagaaaacctcactcctaaacaagcaaatggatacggagggcccacatgtcaagtgtaaccgccggaaacagccttaactgccaaaatcgccatgaggtcccacctgtcagccaccctgccgaagctggaggcctgttgggccagcccaggttcggccgaaccctggcggcgtccaatcagcctagccttacacgtggatatccaagattgcttgctgatgatggttacaggggtaaaatcgacatttcgcatatcagtaaccgtcataccgaccctataaaaggaggagttcacttcacttctcaacacactcaagcaagctcaattcctcttcatacattagtattagtggtataatgctaagtgtagtagtatagaatagtgttcggagtcctcggagtcttcggaagagttttcggtatggctctagcagctcttgtaatctcttctgtaatactttccgtattaatgaaatactcttctttatatatcttcgtgctttgcttagtcttagtactggtcttactttatatctgcattatatgaattgtgtgggtagcctaccagagaggtgtaatggtgcgagtttaatgtctaatttatcagttgctctatgtcgggtgcacggctatagagtagtatttagtaatgttagcatggtgcttagattattaaatatcattaattgggcatatatgttgcaggacattagaggtgggccgctgatggtgatagctcagtatgggtatttctccacgttagtatatattcctaagacaaattcgaagggagggtactcctctatatgtagccccggttggacggccatgacaggttgtcgtaagtatctcgccaacccaggtggtctctcgaagtaccaggaggacactgttagggggtattggccacatgattgtatattagcagatgtaaactaagatttgagtgtatattagaagaatagtaatagagtgctttatgtttcttccacttagttaaacttattttactagtaatatgtccgtgctaacgctacgacattatttataatgtaaagcaaacaaccaaaagtaacaatatatgtttcaaaagttttctgacattatgttcaaacaagatcacaagtattaagcacaaaaacgtaaaagaaagaaaaaaatctaaataaataaattatgttctggagccttagcatcgacatcatcgttaagaactaaattagatacaatactattgcatcgtgcttatggagcattaatgtcttccatcttagagaaaacctacccatcaaaaccatcatcactaccaggcaaccatatgcctatcttagtaaataaaaaacaagctaacttattcgttaggaacctttggattctcccagttctctcctcaagcaacgatcttattgaatatgccaccatcgtaattctgatagacaattgtaatatataccattaggaataatacactgtagtgtagcaaaactgatgtctagactggagagataaaccttacctgaattcaaaagaaaaccaacttacagaggctacatataaattgtttataaattatatatgtttaaatctacaaatagtactactccatttctttttcacaatctttgccatgtactttcggcataaattcaatggttaattaatcggggtccaattacatagaagcatgaaaacaaacaatttgcttgaaaagttcaaaagtgaaaaattgaagctattagtgcagattaaatcagagcacaatgaaaaatccaaatacactccactaacccaatttaattgctaggctacctgtatggtagccaaacccctcagccattaaatgcttagacagatccctcgagagtagtagaaatccctaagaaaacatgcagttgtcggttgctaaattatgcttagcatcctaattacatacttacggcaacatgatgatggtgtttaaccacctcttgctattttccattttgcaccctttcattccttcgcatgcctccccagaaattggtgcagcaaacacgatcccatctacacctccatacagtcagattggttctttgacttcttctggaccatggctacattggtttctaaatttgttaaattcagaaatggtctctctgtatcatgtacatttgcttgttgaaattataagcacataatgatttaatttattccataaataaatcatgatattgcagatgtaaactagcatgaacgcatcattagatctacacatgtaaactaagcagtaaaacatgaacagatcaaatatgcgcaacatatcgaacacgtaccgaggtggtggaaagactggttgctcagcaggaactactcgcggttgcgggagtcgacgaaggcgcgcagcacgcgagcggagaggaaggcgagccgtagcgaacgaacagggagcagtcgcacgaagcgcttcccaaaaactttattgccgccttctcccggtgcaggacgtcgaaggcagaggttccggagacctgctctcccgatcgctggtgcacgccggcgagcgggatggagtagtctacgagcgacggcgcagcacagagtaggaggcaaatcctagattgatttcgcgtatgttacgtgaaggcggcggctcggtttatatagagataggtcgcttgatcagggcgcccgcacgatctctactccgtgtaaccgaaccggataagtcgcgcgtaacttatccggacttcacgccgttttcacgcaccggatttttcggaatgtttccaaaacaaaaacaaatccgaattttccgcagcaaaacaaaactgcaaaaggaggctgcatctgcgcaaggatgaggagcacgacgcgcctgcccttccctgccaggcgaggcgaggcgagcgcgtgtgttccccctcttctctccaccacacatgcttcaagtggctaggagggcatcctcccttttaaggaggtcctcctctcctagaataagcaaggtggtcctaaactccacatgcatgccatcccatgaggtgggcttttgtgattttccaaataattaatcttcgaatgggtcttagcccatctattaattccaacaatcccccaccaaatctcaaaatcccactgagatttgccttttcaaatgtactgtttatataccagcggttcgatggagaccgattaaggttgaacatccacctagaactccaaactacacttactcacaacttgaacaatggactacgccttgaattgcaagtctcgtgcaagcaagtttcactcagagtcttatctagtactataccgtctgtagactacccctcgggtggagcgtataagtcatactcctaggtctttagtaagcttcctagaagattcacccaaaatctccatagactgcgatcaatagtcaagcttacaaaggtgagttctttcaagaatgctctgcaggataacatcttcgctaattaaagccaacagaactcattaagccataaccaacctaccttgcagctcacgagagtacatgcatcttcacttagagagggtatagattggtactctcctctagtttactaatggtttgttcttcccaggttctaattcacgggatctccgatcacatagactgggttaccaccattgtataactcacatgggtctcaaacccatctccttcgatgcattgtctatcacatttcgtgatagtcccttcgtgaagggatctgccaggtttctagcagtttggatgtaatctaacattataaccccggagtttctcaatttcctaacagacttcaatcgtcttttcacatgtctagacgatttcatattatcattagaactattcacttttacaattaccgtttgattgtcatagttcataaggatagccggcaccggtttttcaacaataggcagatccattagtagatcacgcagccattctgcctcaacagtagcagtatccagtgccgtcagttctgctttcatggttgacctcgtcaaaatgatctgtttgcaagacctccacgaaacagcaccaccacccagtgtgaagacatatccactagtggctttgatctcatccacatcagagatccagttagaatcactataaccctccagtaccgcaggatacccagtatagtgaagccccaattctatagtacctttcagatagcacattactcgctcaagcgcacgctagtgatcatctcccggattagaggtaaaccggctcaacttgctcacagcaaaggagatatcaggcctagttgcactagccaggtacatcagcgagccaatgatttgggagtattccagttaattcctagcaattcttttgttcttgcgaagcaacaagctaggatcataaggtgttggagaaggcttactatcaatgtagccaaagcgattcaagatcttctccacataaggggactacaagagtgtaatcccattctcacctctaattagcttaatgtttaagataacatcagctacttccaaatccttcatatcaaaattttgagacaagaatgatttaacctcatttatcacctcaaggtttgtcccaaatatcagtatgtaatcaacatacaagcacagaataactccctcacccccaccatggtgatggtacacacatttatctgcctcattgactgcaaagcctgcagatgtcaatgttttgtcaaatttctcatgccattgctttggagcttgtttcagaccatacaaagacttcaataatttgtacactttgccttcttgaccttcaactacaaacccatcaggttgatccatatagatctcctcatccagctctccattaagaaaatctgtcttaacgtccatttgatgaacgagaagaccatgtgaggctgctagggaaggtagcacacgaattgtggtcaatctagcaacagatgagtaagtgtcaaagaaatcttcgccttctttctgagtatagcccttagcaacaagccgagccttatacttttcaatagtaccgtcaggcctgagcttctttttgaacacccacttgcaccctacaggtttacacccatagggccactctgtcacctcccaagtcccgttagcgataatggaatccatttcactacggacagcctccttccagtagtctacatcaggagatgcatatgcttctgaaattgacttaggagtgtcatccacgtggtacacagtgaaatcatcaccaaaggatttagccgtcctttgtctcttactccttcgaggagcttcactgacatcctccttagtgacatgttcgtgtgtatgtttagtttgttctggtggtgtgatcgaactgggaattatttcagagggttggctcgaactactatgtgtatccttcattgggaaaaagctctcaaagaaggtagcatcacgagactacataattgtaccaacatgcatgtcaggtacatcagatttaactattaaaaatctataggcaatgctgtgatgagcatatcccagaaagacacagtccataatctcaggtcccagtttgcgcttcttcgttattggtacattgactttcgccaagcacccccatgtgcgcaaataagaaagtgatggttttctcccaatccatatctcatatggtgttttgtccttatttctattaggaactctgtttaacacatgattcgaggtcaacaatgcctccccccaccatgccttaggtagctccgcgatgtccaacatggcattcaccaagtcagtcagtgtgcggttcttcctttcagcaatcccattagactcgggagaatatggaggcgtcctctcatgtataatgccatgttcctcatagaataagtcaaactcgtttgagaaatactctccaccatgatcagacctaagtgtttttatctttctatcaagttaattttcaacttctgccttataaattttaaaatagtctagagccttgtctttcgttttcaacaagtacacatagcaaaatctagtagcatcatcaatcaacgtcatgaaatatcgttttccacccttcgtcaacaccccattcatttcacaaagatctgaatgtaggagttctagtggtgccaagtttctctcctcggcagccttatgaggcttgcgaggttgcttcaattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggtttacagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctatctatagaagagacatgctgcatgttcttcagctagacgatctttcctgaagtaaacttcagatctaccgtgccaataccatgaacagaagcatatgacccattccccattaggacggtggaacctcgtgcgacctgataagaagaaaacaatgagatgtcagcacaaacatgtacattggccccagtataaacccaccaattagtagactaattaactgaaaaaatagtaggtaaattaccatacccgcttccatctccagtgttgccaatggtcacattagcagacttagaagtctgccctacaggtgccttcatccccttgcgttgtggacacttcctagccagatgaccaggttggccacacacaaagcaagtcctctcatcctgattaggattgttattgttcttcttctgcttcttgaagttggtggtctattgagctttgtatttccccttgctcttgttctgggccttgtgcacaacattggcactggactgcccaccatcgcccttagacgcagcatctttttcccgagctttctcctcaacatcaagagacgctatcaacccctcaacggagtattcctgtctcttgtgattgagtgcagtaccgaaacttctccaagatggaggtagtttcgcaataatgcacctggccacaaatttgtcgggtaagacacacttaaggagttcgagttccttagccatggtttgtatctcatgagcctgttcgactacagaacggttgtcagccatcttgtagtcttgaaactgctccatgatatacagatcattgccagcatcagtagcaccgaatttagtattcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagcgcctataataaggtttttggattgtagaaattataagcacataatgatttaatttattccataaataaatcatgacattgcagatgtaaactagcatgaacacatcattagatctacacatgtaaactaagcagtaaaacatgaacggatcaaatatgcacaacatgtcgaacacgtaccgaggtggcggaaaaaccggttgctcggcaggtactactcgcggttgcgggcgttgacgaaggcgcgcagcacgcgagcagagaggaaggcgagccgtagcgaacgaacagggagcagtcgcgcgaagcgcttcccaaaaaccttattgccgccttctccccgtgcaggacatcgaaggtagaggttccggagacctgctctcctgatcgccggtgcacgccggcgagcgggatggagttgtctacgagcgacggcgtagcacagagtaggaggcaaaccctagattgattttgcgtatgttgcgtgaaggcgacggctcggtttatatagagataggtcgcttgatcagggcgcccgcacgatctctactccgtgtaaccgaaccggataagtcgcgcgtaacttatccggactccacgctgttttcacgcaccggatttttcggaatgtttctaaaacaaaaacaaatccaaatttcccgcagcaaaacaaaactgcaaaaggaggctacatctgcgcaagagtgaggagctaattttgcggaccattcgacgcgtaacaacgtgcacgcgcgccgcctgcttggccaggtgagcgtgcgcgtgtgttccccctcttctctccaccacacatgcttcaagtggctaggagggcatcctcccttttaagaaggtccccctctcctagaataagcaaggtggtactaaactccacatgcatgccatcccatgaggtgggcttttgtgatttttcaaagaattaatcttcgaatgggccttagcccatctattaattccaacattgctttggtccgataagtatgtggccttaaaattttgagttatcaatatacaaaatgcattaccgatgatgtagaacaggtttaggtgctgcagctatcaagacagaaactgtaccatttagcattctagcaatctagcacaggtaagaactcactaaatgagcatcactgatcaaaatgcgacagatcaaaggcactggttgatatcgcaccgtactaactcaacatagccacgcgtagctgaacacctgaaccgcgctgccaccggaggccacaagcgtacgagcaaatggaaccagctcccagaaacaccacaacaggtaaaatttcattaattttttcagggttagtctgatcataattttcagtataacgctctcagctggaagaaccttaggttgagtattgcatataagtatttatcatgggattagagtagtaccaaatcttaattcagatgataagagtgaacaggtgtcgatctgtgcaacattactattcccacacaatgatatcttcagaagcttctgaaacttgaaaatggtttgcaaagttcctgccaaggaaaaaataaaataaaataaaattttgccatcagtaacattggaaacaagagctctgtttgatcaaagtcacagacatctagcgccaacagtctatgaaggccaatatctgtagcacgatttgacaatgctcaaaattttagatctactaaaaattgtggtagcatgttctttccaataaaaagtacaattaaagcacaacacagagatcaattgaagtacaattaaagtacaacttatgctacaggacctaacaagaaacatggtttattcaaaggacctaatgcaaaccatccaattttcatttttacatatatagttgtatgtgacaagatgatatcaagggattgttgggaaataatctctcggctaaggaaaccgagagaaaatcacgcgatcctgttttccacccgttgaccagcgtgattagctcacgattaaatttccttaaatgcacgcgcaatagtcggtagcgcaaccaacgtttccttttggagcagcccccgattccctcagtgcaaaataaaaggggaggccggcccgtgagaaggtgacaatctcactcacggttccaatctccccgacatcccaaaaccctaatttcccgattctcagttgcgcaggaagggattcgtagtgctgttccgggacaatgtaagtggtgaccggaaggccgccgccaccccgcaggtgatcaccggtgacctcttcgggatcaagccggtgtactcactactacgaccacttctcctacaccgacaattcgcgaggtggttcgaggttctgcatctctacatccactccagactaagcgagaacaattgcaatggcttcaaacaacggtcagtaatcctaaattctgcattagggtgatcatgttaggccgaccggaaggccgccgccaccccgcaggtgatcaccggcgacctcttcgggattaagccggtgtactcactgctacgaccacttctcctacaccgacaattcgcgaggtggttcgaggttctgcatcctctacatccactccggaccaagcgagaacaattgcaatggcttcaaacaacggtcagtaatcctaaattccgcattagggtgatcatgttaggcttagcacttatgtcttagtagatcgcaatatctacagggattaccttgctttcaggcagatgttccagatgattagccgagggcgtggagctgcgttggttcagagacggtcgtggaagtggagcagctatcagcggagtaggcagtgatgcacaacctgatggaatacgcgtaggctacgatagcataaatcaaaattttctaccgcgtaaaccagaaaccatgcaagtattagatcataaatcgttaccactcgacacgctgcgtagcggaagaaagcgctaagaagtcgaaggaactttcgcgaagtagcgcgcgttgatgtagaggaagtagtcgatcgcaccggcttgaccttctcctcctcgtgcgttctcctcgccgtactcccacgtcgaccagcaccgcaaaccaacggcgcctctaccggtatccacacgtacagggacggaacgccacgcgcagatgtgctagcacccgctcgcggctagggttttgctcggggaggggagtggcggctagagtttctcacatgatgcaatacctccgccgatcacacccctcacgaatatataggatccatgattcgggcctccaaggcccataggactcctatttgaatccctatccgaattaaactcatattggatctccatccaatccccttattccggcccattaagcgtgcgaccctgtagattcatgtacactcggctgtaacccgaaaactcctttcggtccacgtgacaatagcggtccctagcagaacgtattgacctaccgggcatacataaagatcatattggctgaacctctagtgtatacttgtatgatccactttgcctcacgatatcgattaagctcaaggctagatatgtgctatcctctaatcgctcaatcattcactcgaacctgtgatagattatataacttgtgattgactcatcaatcacctttggcatggccatgcatttccataatctacaacatcgaggggcccagagatatctctccataggaggggcaaatcccatcttgattattcatatcacactacatgtttcacagcatacccggaaactacttttataactacccaattacggagtagcgtttatcagtctctaagtaagctactacacatgttgggaaccatgataatctcaggtctaaggattcaacaccaacactaaatgagatcactgatgacacaacacatatggctcttgcggtgtctcatgttgggtctatccaacaacatgttccccaacatgtgttcacattattaatttggtatctctactagttgggtgcccgtgcattgcaacgggaaaaaaataaacagacatattaaattacattgcgtaaaatgcgtaaaatgctgttaaataatcattgagcctaaatttgttgtaacaaaaaccttaatataacatgaaccataaaaaccaatctagtcgcagtaaaggcttgtcatctacttcctccgtttcacaatgtaagtcattctagcatttctcacatttatattaatgttaatgctagaatgacttacattgtggaacggaaggagtagaataaatagccgaaaatgatctaactttaactcatgccacctattatttgacctcctaatccagcggtatgcaagaccaccattcctccaggacgcatcaacgcgtactttcatttgtatatgcagttccttcgaacacgtgagtaccacgctcctttcatattattgaggagatcaaactcataagaaaccatgagggcggatccaacattgtagagatggtgccacatgacatcaattaatttttactacacataaatgtaggtcagaacttgtacaatgtatggtttaaaaatatatattgccaatttctacagaacttatggataaacagaaacaaaataaggcttatgaatgaaaaaaaagaaaataattggctggtagaacattttagtatattcatagctagaaaatgtgtaacatagttctgatgttctatagatggcacatctcagttttgataatgaaaggttgctagcacgggtgcaaaacaaaagagtaaatcaagacacctcacagatactctagtctggcctaccaagtccaatagaattcataagcgaaaaatatatgctacaactacgtatgaatatacaagagaacacagttcgtaagtacattctatcagcttgcaattgagttccctctgtagatcagaatcttacctttttccatagggtgttttcaaagtttcaacttcatgtcaaaaaagagaggaaccattcaaaacaaatgatcatatgatatgttactgaagatccatttgaaaagaagttgaataaaaaaggaactaaatgaagcttactggcatcttcttccccgccagggtagggatgcaagcgggccgacccgcgagttcacttataggtcaaataaatcatattttatgggttttcgcgtcggtccagtttaccgcatcatagatatgaaaactcatttatagatcaaattgataggtaacccgttggtcaaacctgcaggttacgtactaattttgcctataagcgggttcgtggacaatgtcacgcctagaaattcactagtaatttccgaactaatttgtgtatagaatcctcgtccaggaatcagccgaggtacacaaactgacaatttaatatagaaatccatcataataataacgttacatacttacaaaacaaaagaaaatcagcagcggaataacggtctagcgatggcttcagctccactcccacaggcagctcaactggggtataagccaaacgtcttcttctggatccttttcttcaactgaggttgattgattattgcaaggtgagcatatgacatactctgcaagccacacagcaaatatgcaagtgcacaaggataccaaaagatggcataatatagactcatttgcgaaagcagcatttagctcacatttgagaattgaaaaatagtagagtaattaatcaatgttattcaacactgaacagcacacccatgctgctcaggcccaaccatcctgaacaaccatacccggctgtatagatctaactccaaaccaggagctaagcaaattattaccagttatagcatcaataattactgtgagaggtgtgagactaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggcatggactccccagcgaccctcatggacttctcgccgcttctcagtctggtgccccgcaatgaaccatgctatacgaaaggtaaatccgttgcccacgctggcttgtgcttggcacggtaaatatttcacaacaatagctcgtgaaccgttccttaattgtcatgagcacgaccttcaaaaccatgtgctcacaacccaccattatcaagttttaattatcaattaattatcataacacaattaaccatcgtgagctaccattaaatataaccataagtaacaatgtagtgtgattcatctcatttatggctaagcaattatatatatagcatttagctgaaccaatccaatatataaagtccaagctaatcaatttattacccataggaaaataaagtcatcttcggccataattaattgggaatggctcaccacccgatgacattcgaaaataatgcataagttgaaataaaacaatagctttagataggttcaacatgctcaaagggttgtttgagatctgtgtgacttgccttgcaataatcggtcttcaattaatcttcttgaacacttccgacgcactcacgaaccttcgcaacgacggaaacaacaagctaacacgaaaaacgaagaaaaagactaataaaaaccaaataaacagtacataaaaagtagacaaacatgtagatcatgattttagatgaatttagagacttgaaccacttaattccgacttcatatgaattagttatcaattttacaagataaatatgattttagccttatacagaacaggattaacaatgtcatgacgacatcattgccggcgatggagggtttaggcggccaagccgaggcaccagaagaaagagcacgacgaggggaactcactgaggggcggcacgacgatgaaaaacggctggcgatgagatcgggagtgacgacggggtaccgatcgatggtggcggcggagtttcagcgacgggagacgacaaccgaggggtggacggggttctcctcgcagctgcgatgccgagggaggctgcggcgaggtccggcgaccttggggtcgatgaggaggcttcgccggagatcaaaacaaggcggcaacccactggttcacggtgacggcaatctcccggcgggatttggcgcaaaagaaccggtggccggggtagagctgacccttgcgaagccgagggaggcgacggctcaaggcggcgttgaccagagaggcggcgcggcgctgctggagatggtggcggcgctggagagagagggactcgcagggagagacggctagggcacgggagctcgagctaggggttggaaacgaaagaggagagcttgggggttctatttatagccacgggagagagatatcgggcttggaacgcaaggaatcgcgtcgggaaaacctagggtttggtggagagataaactcgaaaacgaatccaaattcgcgtcgaattcaaagggataaaaccggatttttggggaaagagatagaggaggataaggaaacaagtcccctcaactaattttcggaaaacacgagagataaggccggattcggaggagaaaaaccgagccaactcggtctcagttcggctgtcctgaggttgaagatgaacagtagcgagggacgtaaagcagactttctccgagagcatcctctactaggccggattgaaggagggacctgaaatggacttcggaggagggataaggccagccgaaagggagggagaatgggccgagaactaaaggtgaacctttccagtttcggcccgaaaaggaaaaggggattttaattacttttccaattaaattaatcactgaaatgatccttgaattgttaaaaatacttctattgctcaaataatttcaaaaaaaatcctgaaagtacttgaacactataagtatttaacaaaattaaaatcagaccatttaatgattaatttaatatgtgaataattacttaaatgttgtttgtattattaaaattaagaattgagctccgaaaaaatcaaagaaaattccagagagtataatgcgaacttaataaaaattaaatccagccatactttatatttaggaaattttatttcccacatttaactttacttgtaaattaatgaacatttaatataaattctaaaaataatttattaaataatttatgaatcctaaagtgaaaatcaggatgtggcagacaggcccacttgcacccctagcgaagggagaggcgaccacactggtgctgccacctcccccgccatctgcgtcgccgccttcccccaccatccgtgtcgcttcttcttcctcaacttcgccggcgccgcccaccacctactccgccaccttcctgaccgcgccacctgcccccgctattcgcgccgcctttctcgccatccgtggtgtcgccttaacccaccatccatgccgcttcttcttccccaacctcgccggggccgcccaccacctgctccgccgccttcccggttgcgccgcctccccacaccgagccgcgccatcgcaactgctgctgcctgctcctcattctaaccgccctcaatgtcgtggatggtaggggaaggcggcggcgccagcatggttgcccctccctttgcccttttatcctctcactcggctcggtctcagttgtgagtgcgtggtttagagagagagatggcagtgaggggcaaaaagggccaagaaataattatttagatgaaaaatagtattttgcaaatgcaacagacagcgaaaatggcattgtagcgaatgcccacaacttgagagtagcattcgagcgaatcctgtaaacaatacattattaattacatgctaaaaatgtaaatttagttgctactgactataggcagatttcatttcgttcttgaataaattctgtcatgaaaaggatatacatttagcatgaagagatgtataccgtttattagttgactatagatacgtgtacctacggtcagccaagtcagccactgaacagcaactgcccccctccagttgccaattctgggttagccaacatgccatgcaagttaagcgagcagagcagatcaaaaagaaggaaatggagtacacagtggagagtgattatctgtgggaagtgaatgggggtggtactgcttgagatactaacagttaccaaaatgaccaaatatatatttagtttctttcacatagaaacataattgctatgtaaatcaaaatgtatcttaatagcatgtgaggtggtatacaacagaaaattctattttaataaccaaatggacataacaatcatttagttgagccagcctgatgcaaaaattcactgctttcccatttgctcatgtactgtcatgttaagtcctaagggctgagtgcacgctacagaaccctataaagattaaataatcaaataccctcaacctagctccacaactcgagaattgaagtttcctaaatgacggtggtgttggaaatttagtcataatttggcatattttaatccaaaatattaagacaataaatataacatttgcaatattagtagatatagtgacagtgctacatgtatacaacttgagtatgcttaatatagaataagcatcagcatagacaagagaacacaataatattgcgaccgacagttgtaggaaacaaagaacgaacggtaagagtgaaacgttataccctgagaatggccctccgctggagtttgagacagtattgcctccgttggtgttgacgggaagctccttctccttgtctctagtgttgttgttgtcgccggttgtcaacatgttagtgaagatgatgcagagcagtcgcgcttgaagcgctacccaaaaacttgatcgcccacttacccgtgcaggttctcaagcggacggagtttcggaggcacctgctcattccgatcacccgtgcgcacgggatgaacagaaccggggaaacaaagagacagcgcaggaacagaacgagagtatcgctaaggaacaatacaggaggaagacacacactttgagagcctctgccttgcgttatatatagagagagatctccattaccgcaaaaataaatctaatttgttgtggatgttacaacacaatcaatctctcatttgttgtggaggttacaacacaatgaatctctcatttgttgtgaatttcattttttaatggtgacttcattctcgtttgttacaaaacggaaacggaagagcagcaggcaggctcggctcggtcggccgcctcgcctcgctacgtccatggccgaggccgactcagcgcgtgcgcatgcgtgtggcagtccaaccatcacctcaaccggtcaacagggaatctccaatatcaccctatttaagttgaggttcttccacctaatttttcaaggtagtattattctctctaacattacttgtgggctcttgagattttaattaaattaaattaggcctagcccatttatttcaacaatccccaccaaatttcatggctcacaagaaatgttctcaaaactgaacctgttagttataccagtgttttgatggagactgttaggttgaacttccacctaggaaaagagttacaccagatcataactgaacaatggattatgccttgtaattgtcagttttgtgcgattcaggtttcactcaaacccttaactggtattgggctgtcgtttgcatcccctctgtttggagcgtataagtcatactcctggccttttcatgagtatctagagatcacccagatctcatagactgtgactagcagtcggagtcatataggcgtgttccttctaagatgttctgtaggccaacatctctgctttatgaaaagccactcggatcacattaaggtgtataccatcctaccatacagattagaagagaagtgcatcatgaagataagctcatttttgggtctcttctctcagttacccaatagtttgtttcgccatccaaattcacgggatctccaatcacaatggacaggtttccaccattgtgcaactctaagtgggtcttaagcctatctccctcgatgcacagtctatcacattacgtggtagccccttggtaaactgatctgccaaatttttagccatctggacatagtccaatgctatcactccggagtttttctgctttctgacagacttcagtcttcttttaacatgcctggatgacttcatgttgtcctttgaactgttcactttaataatcactgtttgattatcacagttcatcaggattgctggtactagtttttcaaccaccggcaagtccatcaggagctcacgaagccatttggcctcaactgtggcagtatctaaagatgcgagttctgcttccattgttgacctcgttaagatggtctgcttgcaagacttccaggaaacggcgccccttccaagtgtgaacacatacccacttgtggcctttatctaatcagcatcagatatccagtttgaattactatagccctccagtacttttgggtacccagcgtagtgaactccaaagctcattgtcccttttagatagcacattactctttcaagagcatgccaatgatcatctcccggatttgaaacaaaccggctcaacttgctcacagcaaatgagatgcaggcctcgttgcactagctaagtacatcaatgaaccaataatctgggagtatctcaattgatcccttgctattcttcggtttttccttaatagcacactaggatcaaaaggagtaggagctgccttgcagtcactataaccaaagcgactcaggaccttgtccacatagtgagattgcacaagtgtaatcccaccctcatctcctctcagtagtttaatgtgaagaataacatcagccactcccaaatccttcatttcaaagcttttggatagaaagtccttgacctcctcaatcacattaaggctggacccaaagatcaatatgtcatcgacatataaacacaagatcactccctctcccccaccatagcgatagtacacacatttgtcagcttcgttcacaacaaagccaacatatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacattcatctgatggacaagtagaccatgagaggctgccagagcaagtagtactcgaatcgtggtcaagcgagcaaccggtgaataagtgtcgaaaaagtcctcgccttctttttgggtacaactgtcacgcccagaaattcacgaaccagaatttctaagctgaatgtgtattaaacccctatccaggaccagccagggtacacaaacgacaattgttgacatacagatccacgtcttacaaaaacataaaggattacaaatgcagcggaaaaggtaaaagcgagctaagcctgaagacttgactcctg

SEQ ID NO: 41213 - DNA, 3352 bp, Oryza sativa
tgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtatcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgagtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatggagttctttttccacatcgccgcgtgaccatcttcgctctctatatgctggcttccaggcccctttccgaacactactttaagatctttaaccatatcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacatggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttctagtcctaacgggcagactatcttcttagcctcgtacgttgtctcgggcaatttgtttccccccggaagaatgttcttgacgagtttcaataaatcgccaaatgccttgtcactaaccccattttttgccttccattgcaccaactccagagtggtatccaactttttgtgcccccgctcgcaacctgggtacaacgaagttctgtggtcctccaacatcctgaccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccactttatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacatacattttctctctcatcaacttacaactaaattttggagacaaaaaaagtgtgcaaaacataggtgcaaatgtagtatgacaaaaaaaaacattggaggatgaagttgcaaaccttttaggcacctcgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgagatcattagtcccggttggtattaccaaccgggactaaagttaagatctttagtcccggttggtgctaccaaccgggactaatgatcccggtgagccttagccccggctggcgctaccagccgggactatcgtcccacccctatgtatatgtcttcttcctctaccagctgcccgagcacgcttcaatatttcttcaaaacagaggggaggtcatgcc

SEQ ID NO: 41214 - DNA, 20774 bp, Oryza sativa
  unsure (1)..(20774): unsure at all n locations
ccgggactaaagatcccgggggggcctgacagggcctgacagcattcgaaccgatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgatattaccaaatttggttgttaacacaaccaaacagaataattaatagcatcatccctctaaactctcaatctctcctaaaaactcccccaaccaaatgacccgagaggggttgctgaatttttttatatataatagtccctccgtcacagaatatagacagttttagagttggacacggttattaaaaaaatagatagcattaaatagaaagagattgtgattggttgagcagtggaggtaggtgggaaaagtgaagggttgtgattggttaggaaggaaatgctgatgaagaagttatattttgggacaaatcctaagagcatgtacaatagcaggctataagtcaactataaacatattttaaagagataaaggaagagagagaaaagtagcgggctacagatctgtagccagctgcagcacggactacaagacataatgtgtgtatgacaggtgggaccaggtattaatagtatagtaagcaactattgtatgaattggctgttacattggctatagatgattttgagctaacggtgggctatactattaaaattgctctaagtgctaaaaattgttatattttgggacgaggagtaattaactagcataatgcctgtgggttgcaacggtttctaaataatatttattgacataaattaaaatccaaaatcatatattatagttgggataaacgacgaaggaaatacaaacatacaaataacttttgtccggaacgataattcaatatcatgaaaattacataacttaatccctattttttcatttacctataaagaattcaatacaaagaaaaatataaattatgataatttttaatggatcaaatagtgctaaaactaatactgtgaaaaaacaacttaaattagttagaaattgaaaaaacttattttagcccacaaatgaaaaatccaatacattaattctaaaacggtgcatgtttcattgacataaattagaattttattgttctattcatagtcctatggtctgtgagtgttccatgagcatctttgggctagaccaagaaggaattgtgtcaaaaaaaaacattgttcattgccttccctagctgaagacgagaaacaaaagaggaggggaaatgggtgtcggtgctcctatgaccaaacagtggcgaggaagatggtaggatgtgtctcacgatgtgactcgtccatagatggtggtggtcggcaatgaagaaaaccaaaacagcaggaattgggcaagcaatgtcatggtcttggtagagggagaaacgataatgacgagctctggtggcgaacacgaccggataagtgcgtcaaaacacattcctgaacgagaggattctgttttccttgaactcgcggaaagaatgaaagatggagatgtgtattggtcgctaaggtacaacgtaacgtcttgtacggttgtagtcgggtcatcaacgtttcttctaaatcgtagttatctaaactcatcgaaagattgggccaacaacagtcttgagtgtcgagtggaactcagggttcatcagtgccatgagggagagagggaggcgggagaggagaggcgcaagggagaagagggccgcgagggtgggggagcgtgcagcaacgaagagatgggggcgtcggaaggaagggagagaggcggaagcggagatgcatgggagggctggcggcgtgggggcagggggggtggggggacggactaaagcggagggaggaagccttccgtattttttaattaggtatatagataaccatgaaattgtttcctatatataataattaataaccatgaaattaaatcattagtaattcattggcattatttagcaaaatagtaaggacgctatttggaagatcgtccaggtgtggtcactgttacgagcagcgtctgggtatagacgtagcaaaacggcgtccaccaggcaaatgctgcccgataagctcccgcccaacttagaaggtttctaggtttctcgacaaaaggataccagcgctgctctgctttcttttcctcaattgttgcagcggtgtagccgcgattgcctgttgtagcggcgaagcttgatgtcgtcttggttgcttgttagctgcgctgcggcggagtagcctcctccagagtttgtaaactccacaccacctcttctatttgcggcgcgcaccatccaccccggtcgatgtttgactccaaaccacgaggcgaggtgacgtcgtctagctccacgactccacacgcaggtagacaaggtcgcctttgaccggccgcctccacagaatttgcaccacagcccacaaggctatggccaaagcctctgcctactatggatccttttttttttgggaaaattggaactatgccattataattttgcaaaatttgagatatgccatcctgacccacatgtcattgactcatgtgggtcctacatgttattgagataccgatggcatatctcaaacttgcaaaattataatggcatggttctaaattacccgttttttttctagttctatgggtccacatgtcaaagaatttaatgtcatctgacttaaggaagaggatctcaatccaaaagagagtggccccagaccatgcacgcggcatgattccttcacttattttttagataatggaatagataacatcccggcctttgctaaacagagctgcagccaattattacaatctaacactcgaacaagagtgtagttcaaatagaattaaacacacctaaacattataaaagtgaccagaccaagataaggaatacacaattattcaagtctatttttaaacctccatccatggttggtaaaaagttgcataaccgtcgtctcaatccaaaagagagtggccccacaccatacatgcggcctgattccttcacacgtgacgagtaggggttgggcacaaatttccccaaaaatcagccatagaaccaaacaagcattcactcctggggaagggagctttactcccggttgccaacccttcgtagtcctagttgaaataagcgggactaaagatgcataccacgtcaaaaaaacgcgtcggatgtgggattcaaactcaagatctctccctcaaccctcacgcgtgttacgaaaacggtatgaaaatttcccgacggtattgataccgtttccacaaaactaatataataatactatttttaccgatggttaccgttttcaaaatttagttttttttaatttctgtcagcatggcattgaagttgacactaaggccttgtttgtttcagcttaaagattattgtaatctagattattaaattagattactctaagctgaattataataatgacataaaataagctacgagttgtttatttctctggattattagagccatccaagggtagtaggtctttagccactcaatatttgaaaaaaagctctctagagaggattaatggattatagtaatccgggcttatagattataatattctagcataataatctacttgtttgtttcagcttactcntataatctagattataataatcctaagctgaatcaaacagggtctaaatagatgaattcataaatatggaaatttttcgaccgtttccgttcgttttcgaaaaataataaaataatgataccgtttccgaccgttttcatctctagtatacacatctgacttggatagagatgctttatttttaaactaaccctggaggcatctttactccgggttggtaacaccaagtggagctaaaaatatctttagtctgggttggtttatgaaccgggactaatgatcaatgtttagtccggattggtgttaccagccaggatgaaagatcctcctattttagtctgggttggtaacagcaactgggactaaagtgatgatctttagtccttgttgggggcctgacacggcctgacaattattgaaccgtggctaaaaatgatcttaaatcccagttagtgttcgaaccgggataactgtgatttttgtcgtggctaaagatattctttagtctcggatcctattcgaacttgggcaactgtgatttttgccgtccaagcaaagattagtgttgatatttcttaaacggcattactagaaatataattcccagcaatgacgaagaaatattcatggtatatttatggtcacaaatatgatccgtaagcgcacggatataccattttagcatttcaccccggagtattccaagtatcatatttgtttaatcccaagggaagatatgataagagagtactatgctaatagtttatatattacttgtatacatcaaggtctatgttggggttaagtaatttaaagggtaggtgacacacagaagaaagaactatgatactctcgctaaatataatctaagctaagtggaggaagaataagaaaagaattcattcttgtacttctaatatacaaacatctttagtctaccacttgttagtatacagtcgtacaaccaatactccctaatagtgccctcctggtgtttcgagagaccaccctgtattgtcgagttccttacgacaacctgtcatggccgtctaaccggggctaaatacggaggagtatcctccccaggaatttgtcttaggaatatatactaacatggaggaatacatgtactgagttgtcaccatcagcggcccacctctactgtcccgcagcatatatgcccagatagtgatacttaataatttagacaccacatctacattattaaatactactatatatcccccgagatgacatagatcaactgagtaatcggacactaaacccacaccattgcacctctctggtaggctagctacacaactatattgatacaagtataaaatgaagccggcactcagataatataaatggaataaaataccgaagatgtataaagaagaatattctattaattccataagtcttacaaaagaagagaggaaagctactagagacataccaaaattctcctgaagacccgaggactaagaatacttttataatttctactccactagcactaggatactactaaacttgagagagggagagagctcttcttcttgagtgtgtgcagagagtgaggatgtgaggtccttacatagggcagttatgacggttaggtgatgcaaaatgttcattctgccctccaactgtcgttgagggaggcatcctggacatccacaccccaaaacctgggatcaacggcggagatggggaggctggcccaaacagcccaattttcggcaggccgtctccctgttgtctcgtcagtccagaaggcctagtggatcgtgtgaattctgtgttctttgcgcattcatccataagtctggatctcgacagcgtatgattgattgaccatttactttctgtcgattcttctccatttatatgtgcttctcctacatctatgttagtagtatagtatatagtggaagttgatattttatttgcaaattatgcattgcaagcatagctagtctttattaattgagtaatattgatggtcgaaattggtcgataacgaccgtcaacaatcagttctctagtagtgattcttttcggtgttcgcctgcacgcagtaagctcgggttatcttttgggtattactttctccgtccaagaaaaatattaatcctatctatcaatccgaatgcatgcgtatctaggtcggtagttaggattaagtttttttttataggatggaaggtgtagatcagtgtttggcaatcagctcggtttttgtttcttgttgttttaacactttttctgttactagctaattaaatgaggatagtgttggagacctaatgaaggccgacgggttaggggtgaagaagggatactgtcacataagatttatccgtgtactccctccatgctaaaataagttaatgtaggtgtgttaacttattttgcacagaaaattccctgtgtacccctgaaagttcgcccaatcccttctatgcctctgagatttgctcattctctttcatacccctaaatttcagtttgaatcccttctataccccttttgttagttgaccattaaattcctatcataaagttcattttgccctttggtattattggtatttcttaacgacattactagaaatattcattcctagcaatgacgcagaaatggtcctggtatattttctggttacagatgttatccacaagcgcaccgatataccattgtagtatttcacccaaaaatattccaaggtatcgtatttttgatcccaagggaagataatatgagtagactatgctaatactctttatacatatattacttgtatttatcaaagtctaagcaggggttaagtttaatatacgggcacagtgacacgaagctaagctatagtttaacatctaccctatagttgaacaaatggttttactcattacacattcatcatgtcacacatccaacagcctaaaatcatctgagttacatccaacgtctcccagatcgcgccctccctcccagatccctccctctctcgcgcacctccctctcccttctacaactgccgcatccccccaacgcatcgccccacaaatcacgccgccgtcgccaccccttcctttccaatagcattccctttgcctcgccatcctgctgctcgtgcccctccgcccatcacactgatccgcaccggagtcgcagtcgccacccccgagcctctgcccatcgcatcgatccccgccgtccctccacccattgcacctatccgtgccgccaccgatgacgatctcgtccgcaccgcccctccgcccatcgcaccgatccgcgctgccaggccagtttgccctcgccgcccccgatgtacgccagggcgcccgcctccacgcccccatatcaccgtcggccggagtcgccgggctcgtcctcaccaagccgatcccctccgccaccgatagaaggtacaaaaatcctcctcccctaccagatgatttgtcttgctttgtattaatgggtgcatggactggtggtggtgcggctgtcaggctcttctattagttgcttgcaaatcagctattaagtttgaagatgtacacattttgtgattagtctcttgtgattaagagaaaattatggtgatttgccactgacactttaacagaaaattatggaggggattcttttgcagtaccagtgacatgagaaacttcagttggttcatgagatggagctgcctgactcccttctgctgggctggttttgaccctgaacctgttgtttctctgaaaaatgtgtcattttatttttagaatgaggggttgccatatttgcttgttatgccgatgtggacaagcttgtcctgttttatgcacaggaattattggtttatatactaagagcaaaattaaaatattttctacaattatatatacatagagaggctcgatttatgggcacaaacgtcctaataggtcaatttaatctctttttgggttaagcaagaactttgtattgatgggtgcatggactggtggtggtgcagccgtcagctcgctctgaactctgaggtggtttgtttttttttctcaggcgcttgcaacactacatcatttccagaacgccttcaccaaaattcactgcatgcaatcaggcgcaagggttgtgttagtgatatgccctaggggcaatcatagagatgattgtattacatactatgtttacatatttatccaactttgttccttgaaatagataactcattattagttaatgaatatgtgattctttcatgagactctttatgttgtttgttactatttctaaaagatccctgatcaaacatcatatatggaacaaatatggttaaatgatcagcacatatattaattgatgatcatgtctcatagatcatagtatctttactacttaaaaaatacgtggtggtgttggtgagtcctgtataatccaagggccgatattcctcgcaggatcctcccacagatcgaagggatcaaataacctcctgctgtcccgcaccacccccacctccgtatcgcactgtcctcacactgccccctccatcgcacgcccccgtcactcctccttcgtaccgccttcgccgctttcccagcgccgccgtcgcgccctcggcggctcctccgccgcgctgccgccacatcagtcgcgaccccggcagctcctccgccgcactgccgccacctcggtcgtgaaccccggcgcctcatccgccgcgctgctgccacctccgtcgtgaaccccggcgcctactccattgcctcatagcccctctcctcctccaaccctacggctttctcctccgtccggtgcaccgcctcttccatccccatatcctattcctacttcatctctccctaccgctgtcactgctcaaaccctaagatccgaagggagggaagagaacctaagatcggaaggggagggaagagaagagcgcataggcggtggcaacggcaacctcagcaggcatgctgtcgacttccatcatccctgtcatcctccaggtaattgattctatttttatttgatttgttggattgtctgtagaagatcgagctgctgctaactcaggatacatacacaaaaaaaacttatgccccaatcaagcatttgggtgcttggctgctattgtgctattgacggaattgaccattcttttttctcgctttgctgttcaaggatccaaacatatgttgatgaaaccggcatcacaggccaagcccaaggcaacagtggggtttgaacttcgaagacgatttaatccctgtctttggtgaaaacacaaatcatcatgattcaccatggtattaggaggtcttgattctgaaatttccaattttgcttttgttactactttatttacatagtttctgtgtagcttaccttatcgttgttaagtatggttgaactagccattttagatgctaaaattctagaagttggaggcttatccatgcagttttagatttggttggatggaatttggattcttcgaacattcttaaactatggctctttttccattaaaactttacattttccatattgtcttcgactgcttgtagacgaacaactacaggggaatatctcatgcttttatggaaccagctaatgtgagagtatcaaggggagtcttggccgaatccgttgctcatggctggtaggagtgaggagtacataggattccacactacgaggtaatctacatgcatgattcatgtgcctgttggtctctttgtctaaaatgatagttcattttggtataccacctgttggaataaatgggctaagcccaatttaattcaattaaaatctcaagaacccacaagtaatgttagagagaataatactaccttgaaaaattaggtgaaagaacctcaacttaaatatggtgatattggagattccctgttgaccggttgaggtgatggttggactgccacacacatgcgcgcgcgccgagtcggcctcggccgtaggcgtagcgaggcgaggcggccgaccgagccgagcctgcctgctgctcttccgttttgtaacagatgagaataaagtcaccattaacaaatgaaattcattgtgttgtagcctccacaacaaatgagagattcattgtgttgtaacctccacaacaaatgagagattcattgtgttgtaacatccacaacaaatgagatttatttgtgtggtaatggagatctctctctctatatatataaggatgtgactacacagctagtggtagctgtattgtctaaaccagctgagaccctatccacctatgcttcaaataaaaatttatcttaaactacttatccgatctacgatccgattacaccgttgtgttcgtaacaattaaatctttataacaagatctcacatgattatattttgatgaaaaaacataaattacttttatagtatatctaaattacttttaaatttcactaaattacttcttagacatataaaaataaattcaataaaacctaaaattaatttgcatatattatagaagtaacttataacaaaaaagagtgtaactttaatgtatgtcttttttcattggacgtgactacacagctagtggtagctggtttgtactccatctagtctctcctttgaacttgaaaaatgcaatagtatgtatccttttttaatctctttaataacttatatcttttaaaaaaggtacactgtgggcaaatgtctggtagtattcatttcaaaaaaaagcttatatcttttagatcacatattacttctaatgtcgtgacaaagttacttccattttgttttaagttacttttataatatatgtaaattacttttagaccttattgaatttacttttatatgactaagaaataatttagtcatatctaaaagtaacttatatatatatgataaaagtaacttacatatataataaaagtaatttataaatataaatattttttcatcgtaatataatcatgtaagatcttgttgtgaagatttaattgtaacgaacacaatggtgtaatcggattatagatcggataagtaatttaagagaaaactttatttgaataggaaaaagatatacatgtctattgagaaacaaggcacacactgtgtcaatccttctcattgtgccattacagcgcggccacgtggatggacgataggcgcgatcgatcggctatgagatgcgtcgcgtgatacgactaaagcgagaagcctctcagtttagattttacgtatatataacgcaaggcagaggctctcaaagtgtgtgtcttcctcctgcattgttccttggcgatactctccttctgttcctgcgctgtctctctgtttccccggttctgttcatcccgcgcacatgggtgattggaacgagcaggtgcctccgaaactccgtccgcttgagaacctgcacgggtaggcgggcgatcaagtttttgagtagcgcttcaagcgcgactactctgcatcatcttcaccaacatgtcgacaaccggcgacaacaacaacactagagacaaggaggagcctcccgtcaacaccaacggaggcaatactgtctcaaactccagcggagggccattttcggggtataacgtttcactcttaccgttcgttcttcgtttcctacaactgtcggtcgcaatattattgcgttctcttgtctatgttgatgcttattctatattaagcacactcaagttgtatacatctagcactgtcactagatctactcatattgcaaatgtcatgtttattgtcttaatattttggattaaaatatgtcgaattatgaccaaatttccaacaatccaaaaacttgataggtctttttcggtagttggctttgctgcatcactaaaaccacatgctttcgatggttcaaattataaaagatggaaagcacgtgcacttttgtggttgacggcgatgcaatgtttctttgcttcacgaggcaaaccgagtgaaccgcctctctccctgaggaggaggctaagttcgaggctgcggattgcttgttccgtggagcattgatcagtgtgcacgccgacagtattgtggacgtttatatgcacatgccttcagggaaggacatgtgggattctcttgaggccaagttcggggtttccgacgccgacagcgagctgtatgtcatggagcagttctatgactacaacatggtcgatgaccgttctgtagtggaacatgctcatgaaattcagatgctggcaaaggaacttgagaacaacaactgcgagttgccggacaagtttgtggcgggtggcattattgccaaattgccaccttcttggtcagactttggtacttctctaaaacacaagaggcaagagttcagcgttactgatctcattggctctttgggtgttgaggagaagacgagggcaaaggacaaccgggacaaaaagatcgagggaggttctagcgctaatttggtacagaagaagaaccctcacgcatcccacaacaagaacaagaaagtcaaacctgacgtcaaacccaaggctacaatcaattttaagaataaagacaagggaaaggcaaaaggagattgctttgtgtgtggcaagcctaggcattgggccaaggactgtcctgagtgcatggacaagaagtctgcaaacatggttattagtgagggcggaggaacatcggggtatggtaaattttatctacagttctctctgtctgtcactcccctgattggtgggttgatactggtgctaatattcatgtgtgtgctgacatttccctgttttcttcttatcaggtcgggagaggttcctccttgttgatgggaaacggatcgtttgcggttgttcatggtgtaggtacgatcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggcacgtttattggaaaaggttatgacagcggaggcttgttccgctttatcttggatgatatgtgtaataaagttgtgaaccatgtaagcgatgatgatgatgagtccaatgtgtggcattcgcgactttgtcatgtgaactttggttgtatgacacgcttagccaacatgagtttaattccaaaattcactttagtcaaaggctctaagtgccatacttgtgttcaatcgaaacaacctcgcaagcctcacaaggcatctgaggtgaggaatttggtaccactagaacttgttcattccgatctgtgcgaaatgaacaacgtgttgactaagggggaaagaaatatttcatgacactgatatatgattgcactagattctgctatgtgtacctattgaaaacaaaggacgaagcattacattactttaagatctataaggctgaggtagaaaaccaactagaaaggaaaatcaaacggttgaggtctggtaggggtggagagtatttttccaatgagtttacttctttatgcgaagagtatggaattattcatgagaggacgcctccctattcaccccagtcaaacggggtagccgaaaagaagaaccgcactctaactgaaatggtgaatgccatgttagacactgcaagactttccaaggaatggtggggtgaggcaatattgactgcgtgtcatgtcctgaatagaattcctactatgcataaagaactaacaccattcgaggaatgggaaaggaagaaattaaatctccctcacctgcgcacatggggctgtttggccaaggtaaatgtatctatagccaaaaagcgtaaacttggaccaaagaccgtagattgtgtgttccttggttatgctatccatagtgtgggatataggttcttaacagtaaattctggagtacccgacatgcgtgttggtataattactgagtccagagatgccacattttttgagaatgaatttcctatgaaaaatgcacctagcacttctagtcaagaacctattttatcccctgagcactttgtgccgatagaacacattgatcaaatgcttgaggaaaattctgaggaggataacattgtagcaactcaaaagagtaagagacaaaggactgcaaagtcttttggagatgactacgttgtatatcttgtggatgatactccaagaaccattgaagaggcatattcatctcctgacactgactattggaaggaagcggtatgaagtgagatggactcaattatgtctaatggtacttgggaagtcatcgagcattcatatcggtgcaagcctgtaggatgcaaatgagttttcaagaaaaagcttaggcctgatggtacaattgaaaagtacaaggcaaggcttgtggccaagggttgttgtcacaccctgaagttttcccccttttgcttgctttaaaaattggttaaataaattgcttgaagaaattatcttaattaacctagagctaaatccctagttaataaatgcacttaataatcggaaatagtgtggtggaatttttcttgagttccccatgctccaatgcattaacaggatttttagtggaattttcagagccttggaaataattttaaccaattaaaaatcactaaagtgcaattttaaatcccaggaaaaatcctttcttctttttcttttttttcttttccctccttttcctttcttgggccgtcggcccatccctctcccgctcggccttcctcttgttgggccggcccatgcgcccctccctcctctctctgggatgccgacaggtgggccccacctgtcggtcgtctcccacctccagccgttggagctggagctctaactgctgccgtcgaaaccgcccatgccgccgccgccgtttcccgccgttctccacgccccactccgcccgtgccgcgcgcccacgtcgccgccccactcctccgcccttcccgcccgcgcgcatgcacgaagtgggcgggattcattttgaatcccacctcaccgtctctctctcctccccatgtcgccggcggtttcggccatctccccggccacgtccgcccctctctcgcccataaaaaccctcccccgagtcccctccctcgtttcccccatttgccgtcctctcccacgccccctaccgcgcccgcgccgtcacacccgagctccgccgcttgccgccgccttcggccatgagccgccgccgctagagtcgccgccgcgccaaaccgccgccgccgttagcttcgccgccgcaagagctttcccggccgccgcctcgcgtcgccggaatcccactggagcgcctctcccctcgcgagccggtgagtttttccctcccctccatctccggccggcaattcaagctgccgtggtcgtcgtctcctctcctaacgcctctccatcttctcctagggtgtcgccgccgcccgtccgtgcctccgcgtcgccggtcatcgccgccgtcttcatccttcgcgccggccgccgtgctcacagtgaggagctcctctcctccctccttccctctgtcccgcacgcgctgccgctccctgcgctcgccatcgccttcgtccgccgccgccggtctgtgcgccgcccgccgccgcctcccacgccgctggttgccgtcaccggcgaccgcatgccgccgccgttcgccatgcttgccggccggcttgaagccgaggccgagcccggtggctgctcccttcaccgtccgatcggcttgggccgatccggacccttggtcccgtggaccggccgccttgagccgctgacatgcgggccccgcttgccggcgcccccttcctctcccctttaagccgctgacccgtgggccccacctgtcggcgccgccccccccttcgctgacgtcagccctgggctttattgcgcaataattaattaaggactttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgcgtgctttgtttgtcgcgtaggtttcggccgtttcgtcgatccgcggtctctcgaagacgttgctgaggtctcatcagttcgagagcaaggcaagtcatgcaatacgtttgatcatattgtacccaatttacaaatatcccgcatttctatgtaatgttgcattcttttacaatgtaatgtgggatgggtcctattcctcagccacatattggttaccctatgccattaataacttgggtatcaaaatgactagatgttggctaaggaaatgcttagccatgcttagttcaactagtacacaaatggggatcacattattacatagactttgtcttttggcatagctttagattggtgccaccgcaatggtattagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgtggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactacttttgaatgctagctttatgcaaaagaacctctagcctcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatctgtatgtcaacaattatcgtttgtgtaccctggctggtcctggacaggggtttaatacacattcagcttagaaattctggttcgtgaatttctgggcgtgacaagttggtatcagagccgaccttgaccgtaggacaagccaactggaaacctaagagccctctgaacccctttttttttcatatgcatatgcccttttgcgcttggatttgtttcaggaaaatttggggttttgcctctttggcttgtgggaaaaatcttggtcgttcattcggatcggttttttttagctcagtgtagggttttagaaaaaaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcagatggagacaaggaatggttcacgcgactccaacaatgccagtggcagcgaagagccgatcgatggagcacgtgccaacggtgcatctgacaacaatccgtccccaccgcctaagaacccaacaattgctcaggtgttggacaatcagactcagatgatgacaatgatgatgcaacagatgcagcaacagtaccatcaggtgttgcaacaggtgcagcagcaagcacagcagcagcaacagaacctgcagtttggtcctccacctcctcagtccaaactattagaatttcttcgtgtcaagccgcccactttctcaagcaccaccaacccaatcgaggcccatgactggcttcatgccattgagaagaagctgaatcttttgcaatgcaatgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccaagaggcaggagaagtttctgtctggtcttgatgatgaattgattaaccagttgatctctagagattatgaggactttgagaagctggtggataaggctatccgtcaggaggagcactgtaacaaagtaaaccgtaagaggaaggcagctcagttcaggactccccaggggaagagtcagaagcctcgttccacgatgggacatcacggtggaccttccaccatgattatccggcagtaccgtccctaccacccgggtagcttcaacaagaaccaccatagtggcagtcacaacaaccgtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgctcgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttgacaagacacagaggagtgattgattgcgccagccgcaccatcaagttgaccaatgcaaaaggagaggtggtaaccttccagtctccagtgccgcagaagtcagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccaacgagttggcggaagtcaagaagcaagtcgatgaacagttacagaagggatacatccgcccgagcacatcgccttggggtgctccggttatctttgtggagaagaaagacaaaaccaagaggatgtgcgttgactaccgcgcactcaatgaggtcaccatcaagaacaaatatcctttgccaaggattgatgatctgtttgatcagttgaaaggagctactgtgttctctaagatagacctgcgatcagactatcaccagttgaggatccgcgaggaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaagttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtccgcaccagtcttaatcctgcctgatcagacgaaagatttccaggtctattgtgatgcatctcgccaggggct

SEQ ID NO: 41215 - DNA, 2031 bp, Oryza sativa
tgttcatgctttaaagatttggcggcactatctcatcggtaaccgttgtgaggtatatacagatcacaaaagtctaaagtacatcttcacccaacctgatctgaatctcagacagcgaagatggttggagctgatcaaggattatgatatgggaatacattatcatcccggcaaggctaatgtggttgcagatgccttgagcaggaagagctagtgcaatgttgcatgggtagagcaactatgttgtgaggttcaacgtgatttggaacatctgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggataaagattgtgtgtacccgaaaacaaggaattaaaagacctgatactaaccgaggctcatcaaactcaatattccattcatcccggcagtaccaaaatgtaccaagacctcaaagaaaagttctggtgggtcagcatgagaagggaaatagctgaattcgtagcactctgtgacgtctgtcaacgagtaaaggcagaacaccaaaggccagcaggtttgctacagacacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcactgcttaccatccacaaacagacggccagaccgagcgagtcaatcaaatcctagaggatatgttgagagcctgtgcgcttgactttggtggagcatgggacaaaagcttaccgtatgctgagttctcgtacaacaacagttaccaagctagtttgcagatggcaccatttgaagcactgtatggacgaaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagcaggggattatgtgtatctccgtgtcactccgctcaggggagtacaccgcttccaaaccaaaggaaagttggcaccacgctttgtgggaccatatcgaattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccgactcgtatccttgaaaccagcgagagaaggaccagaaacaaagcaatcagattctgcaaggttcagtggagccatcactcagaagaagaggccacttgggaaagagaagatgagttgaaggccacccacccgcacctcttcgccagctcttccgaatctcggggttgagattccgtttaaggggggtaggtttgtcacaccctgaagttttcccccttttgcttgctttaaaaattggttaaataaattgcccgaagaaattatcttaattaacctagagctaaatccctagttaataaatgcacttaataatcagaaatagtgtggtggaatttttcttgagttccccatgctccaatgcattaacaggatttttagtgaaattttcagagccttggaaataattttaaccaattaaaaat

SEQ ID NO: 41216 - DNA, 20970 bp, Oryza sativa
  unsure (1)..(20970): unsure at all n locations
nnnnnnnnnnnnnnnnnnnnnnnnnnnnnnnnnnnnnnnnnnnnnnncaggttaatatcggaccaaacggattcagttcatgatcagttagaaaaattcaacaaatataattgaaacaggtccgacatttccaatcagctaaatccactgaataacaacctggattatcaactttgcagctggaaaacgcgtaatccaatctgagtttgattatagcgtaatggattaggtaggaaaaggtcaagtttcatctagttctccactcctagcttcttgcatcttgaatacaggttccctcagtaagacatccctataaaggcacagacttagtgacttatcgcaagttcacgtaaaggcacagactgcagcaatcaactggaatattgaactgccaggaaaatgtaacttctagtgcctactaaattattcatgagtatttttctttgacagacagagtgtattctattggaacaattcaattcatttgtctctgcaggaatcatacagaagttggcgcactactcctatgccttcatggggtttgattctgaaatatgaccatgaatggtgagaagttatatccagaaaggttctaatctaactaggctaactctttcaaaacaacaagctacgatgatgagacaatggaataatttaccacgagttctaactacccctgcaagttgtacgatgatacagtagaaatatatatatgtatgtatatatgaccaattaatttcactgccacaggatattgggatctaggaaatcattggtagctagcaagaccgagtggattcatatcttccttttcaatcaagcatcgtatgtcattccacgacgcttagaccataagatcttaaactaatgtccaggattttggggccgagtaagttcgatttctcaagcaatgactacataccgtgggtccaaaattagccaatcgccgttatcatctgaacttgttagtttgcttattagtagttcctatatgctgctacatcacgcctttgttgttgcctgttgggcgttcgaactaaaagaggatgatctaaacccagccaggtcagatctcactcataaaacacccaaaaccttacttggccctgtcctaaccaataatttggcttaaatgggacaccactatggctatcatccatgtcagtcaaattgtcaagttaattctacacgagccaattaatcgggttggtccagcttgctccgcctacaagagaccagactgcgtcaggcaggttgcaagcttgcaaccacagtagaggacgcaacaacactgacacaatctgaaagaagtcaagaacagcaaggccagagaagatgtaccttggtgaggaacagaactgaccagcagcggatgtctccatgacgacgacctcgcatcaggggattcccccgtggccaccagcgagcgaccttccacgcggctgctgcgcctgaaggggggaacagcatggggatggacgcgacagtgaacccaaaatgctgccccgcgcacgagcgccccccgattgcaacctgtgattccaaccgcgaacgtgaggtgagatgcatccttccagatcgcgaaatcgcgaggcaacgcgagggatcgagtgcgggggaagggttcttcaggttacctcaacctgtgacctgtcccctccccgatgcgtccctcccggatgagaattttgctctcgtcttggcgctgtgatcaccgaccccgtgggggcaagggacgcgaggtgagtgaggaggaagacgggagggcactgttgctcacgtctccaccgtgccttccacggcgccgccgccacgcgtttggtctggtcgtctggaggagaggcactgccgcgagtccccccgcgtcggcggcgctatggcacgccgtagaagcgggaatggtgagtgcggaggcgaaggggctgtcgccggagcggcggcgatggctggaaggcgagacggcgagccggcgagcggtgagaccggcggcggtggctcggtggcgctggcccatgggtccaactgcagtttgtacttttgtggaatctggaccgtacgatgggcaaggattcgatggtctggataaatgatttgaaatttgttttgtttggctatgcactccaaactagagttactcataattcaaacttatctggaaatacaactacttttccactcatctcttaatcctattttctcatctcaatcaatcacaacaattcttatcgtaactttaatctcttaaataaaatgaatataaatagttgtactttgggacgggaaagtatttgtctataatcaacgctgacataaactccctcgaggcatgtttggtttgttgttcttcttagctataaaaacagaggcaataccaatgtgttaagttttcatctaatttggtacccaaaatttggcatgtttaaaatgttagtgagaaaaacaaataagatatatacataactaaaacgttataacaatgtgcaaaacaactattctttgccaaagttttggtatgttagatcttgtcgttgccaaataatttggtaacgtttggattggcaatgatccaaacaagcacataatacttgagtttaacccatatcttctttgcgccttcatttttaagttttgcaaaagctgcaattaatttgtgtggtcaatatctatatctggataattaaagtaggatgagttgagatagttcggttcagttcaatggatgaccggccttatgtttagttgaacggatgtgacaagagaattcacgaccgtgcgacacaaataatgttgtaagatcatgtactatcaccttcagcctaatccactaatcatgttgtacgatcttgtactatcaaccaaatgaatgcatgcatctttctatacacctaagtaaatgaattgacatgataacctttgtgatttgattttgttcttgacattttgaaacggtaagaaataaaatatgtcatatgctcttagtgacaaactattattgttccatcagtgcaaagtgcaagctaaaatgttcataatctgactataccctttcaactagagaatcataaatggattgttcctcgctcgtatcaatggtccgacattgctcttttgcacaggaatgtttttctaaaccatagacttcatttctcggaggcaatggattaaaatttaatctttggtcttgggggtcactgaaaagaaataatatagctatgtttaagggggcttgagattataaaaagcagttggtgaaaatttagaaaaagttgtgattctcaacttttggcaatctagctttccattcactatttagattccacaactaccaaacctcaaaagttgggtgagaagttagataatttcagtctcagagggttaaagatttgtagagaaactgtaattgtcaaagttctccaaaagctcaaaatttgggtgaaaagatatattgtataggagaggtaggccctgtttctttcagcttgatattattataatccagattattgagagtaagctgaaataaacagacaaattattaaagtagcttattataatctgaagcccagcttattataatctgataagctcatttaggtaacaatctagcttatagtaatctggcttaataatctaaattataataatcttaagctgaaagaaatagggcgttaaagattttgagaaaaggggtaactgtcataatctcttcaaagaagatcagatatctataaaaaaaatcttgatttataacattcaaacgttatagaaattagttgatttctagcctcttacttactcttgggttacaagtcgtgaaaatttatccatttagtatcacttattcatcacgtaacaatactatttttctattaataagaatcacattgttctttttttaccaccgataaattttattagaaacctagaatgaatagggatcaagtggattgaaatactatgcagtcgactgcatcatgcttttatcactgacatatgggtccaatgatatccgagcacacatattagtgataaaggcgcggtacaattgactacaggggatcctggtctggatcaagtctttgtgggacttacgagcaattacaagctcaatgcttacacgtattcagatcttacgggatcaggagaggagaatatttacgatccacatgaaacgagaaaagctcattagcatatgattaattagatattaattattgtaaacatgaaaaattgatttatttaattcttttaaacaacttctatatacaaattttctgtaaaaaattgtagaaacgtagtaacggaaaacaacaaaattgaattttagatttggagtatagaactgaaccttagactttgactacacagtgagcaaccactgcagtcggggcccacctgatacactaaaggccaaaaaggtcaaaatttgacttttccacccatcgtctccaggctccagccgttcagcgagagaggagaggcaccgaaagagagagaaaaaaatcccaacctcccaaaaggccaaaaccataagccacaaatcccctcatcggctcatccccgccgcccacccaccccccgggatcgagctccatccgcccaacgattccgccgcgcgcgccaccggattccgattttgttctcgcgtttttggcgcttttcgatctcccccgaggcggtagccgcctagccgcccgccaccatcaccacgcgcgcggtcgcggcggcagaggcgcgggcaggtgggcggttggtggcggctccaccgcattcacttgaccgaaaatggcggccaacaataatagcgacccgatcctggacgagggagggggagggggcgtgaagcacgaggcggtgggggaggcgggagaggggaagggtggtggtggtggtgcggcggcgacgcaggcgcccgcggcgatgctgccccgatcgggctcgcggccgcagctggacctcagcggcgcggcgatccacggcaacctggaggaccgcaacccgaccatcctgctgcctaaccagtccgacgacatctcccacctcgccctcgacatcggtggtacgtacgttcgtggcggagctagctcacactccccccgtttccgactgatttcgggttggcaccttccgttcctcgttcgaatcagctcagtagcatcaagtcatctggcggaagtagttagtgtagagtgcacgggagatagttaagtgcatggaagcttagaatcaaatgcttgatggattctctctctaatatcagtgtgaacaagctagcagttggtcgtaatgctgttgtacttgcatttgcatgctgtgttgctcgctactaaacgttatggacaccttatgtgtgctgttgctagttgatctcaccaataactttggattattaagtaaactctggatttgtgacgttggtttctgaactagtaatgacgaatgtggtgattagttttattgttcagaagctccatttttggctagcaatccaaaatgagagctacaatctcttattctcttcttggttcccaaatttcatgcaaatttgtttactaagtactgaactgtatattttctctaggttctcttataaaactggtatatttttctcggcatgcggagcactccagtgaggacaagcgtaagctatctacgaagaggagacttgggatgttaaatggtggcaggaggagctatcctgttcttggagggaggctccactttgtcaagtttgagactgggaagctaaatgaatgtttagacttcatttcttccaaacaactacatcgtggcggtatgcaaccatttctttgtattgttaaaaatcgaaatcatttatgttttggggtttggattgtccacaaattttgtgtactaatgttattttaatactgcaaattgctttggtggtcatagattgatgtttaccacattatgaacagggatttgagaatatgtagatagttgctagagttactaatttacttttatcacatgcatttatattagcaatttcaagttggccattatcttctgtgtttggctgaattgtgccctgaatatctttattatgatggcatacttgagtttgttcatttcatgttttttcacattcttcattgtcctgtccattctggaagtttaccagctgtctaatttgctagagtttggctgaatttgatacttaaactgtgatcatcacatttttgtccacatggtttcctaaggttttgttagtctaggccgttggcctgcactttcttagcattgagtagaacttttttgctgcaggggttgattcaccttcgtggcgctcaggagctcagcctgacaacattgtaatcaaggtgacaaataatgagacagcaccctttaggtttatgaaagtttgtttggtcaatgtttcgattaatgtttgttattgttcattagcacttgaatatttggatagcaatccattattctcaatctaccttgtgttgttggtgtagatgatttcaacctatggttttggtgaataacaatcataacgctgtagaacaacttgtagtaaaccatgacaagaataccttccttcccatttccccaagattagctcttgtatagcacttgaatatttggctagcaatccattattctcaatcctaccttgtaggtgttgttgtagatggtttccacctatgattttggtgaataacagtcattacactatagaccaacctgtagtaaacagacaagaatgtcttccttcccatttcccaagattaactcttgtgtcataatgactgtatctcatagaagcaaagtctttttcccccacttatcaggaacagactgcgtactgatgttttcatgtacaaaatactgactgagttatcattatcttgatggcattaaagttatatattttagttgactatgatattttgtggaaaggcaacaggtggtggagcattcaaatatgctgatctcttcaaggagagattgggagtcagtcttgaaaaggaagatgaaatggactgccttgtagctggagcaaattttttgctgaaggtttctatctctgagttaccctaccctatttaggttgagactattcagttttatattctatatgatctatgtaatggactaaggcagtaagtcatatttcaaatttatctgaagattgttcacattcaaaaaattaaattacattagtaagacttatgtgttttcagtctatacgccatgaagcctttacgcacatggatggccaaaaggaatacgtgcagattgaccagaatgatctgtttccattccttcttgttaatgtggggtctggtgttagcataatcaaggtaccttgcagtttttttttttaaatatcttttttggattggacttctttttttggtttgctggattttgttggtcgtcgtttttgaaggttgatgggcatggaaagtttcaacgagtaagtggaacaaatgttggtggtggtacatactggggtttggggaggttaatgacaaagtgcaagaggtatttcttcttctgctcatggacatcatacatttctgttgagatctgagaagtttgagaactcctaaaagtatgattttctttcagtttcgatgagttactagagctgagccagcgtggagacaacagcacaatcgacatgcttgttggagatatatatggtggtctggactactccaaggtaatagcaccgatgatggaaaccgtcttgttaacatttcatgttccataaagttatcacacaatgtagacctatgtttgaaactataaattgttaaaatctgctagtcagacttggtacttgcacaactcacgatgtgtcagaaacttcagaatagaggtccttcaagtgcccaattcttctttcttactaattgctgcgtgcttcttctttatggcagattggcctttcagcatcaacaattgcctctagttttgggaagacaatttcagatgacaaggaactgtcagattatagaccagaggatatttcactctctctgctgcggatgatttcttataacattggtcaggtatgacaaataatgataactatttgatacaagtggcccaatcttcatcagaatttttccatagagatgcacatttaccatttcttttataaatttggaagtttgaaaaagtggtccaaatattgtagcggtgagtctaattccacacaaacaacagtaatcttatctgaaaaagaaaatcaatagaagaacataatttttttacttgtattttgttatgttgtgttctttaatggaaaaaaaaggtggtataggtgtcagtagggttggaaaaaatgagtctgggtagtaatactgccaaagatgatattagatgacaattctaaacaatgggttttggtgttaagggtctattatcacttcctatggctcaaggtagtgatttaggataatgtgtgttgttacctattgtaggatgtaggctaatagcataatgtgctcaaagctggtgttaatttgtcttccatgttccgggttgagtttatggtgtactgatttttcaaaaatatatttagccaaaggatttacaggcccattgaattttatcagtggctgtatcaattgtgatgttaattctctcgtttattttactgctttttccaacttttttgcctctttccattgaagctaattcaattgttttggtttgtagatttcctatcttaacgcactccgatatggacttaagaggatattttttggtggattcttcattcgtggtcatgcctacactatggacacaatttctttcgctgtaaatttttggtaaaacttccatataggttcttgtttttatgttgctcgacagtagcttagcttattttgaaaacagtttcctccacaagttctgttcaagaaaccaacgtatgctatatatttgtaaaggtcaaaaggagaggcaaaagccatgtttctgcgtcacgagggttttctaggagcacttggtgcatttatgagttatgagaagcatggtcttgatgacttgagaatacatcacttggttgaacgcttcccaatgggtgctccatatgttggtggaaaaattcatgggcctcctcttggggatctcaatgagaaggcaagtacatctactcttgatcatggtaaccttaatggttttgttggtcattggggttttagttgttttagaacaaatttattgcttgaaagaagtccacattgaaatggaaaccacactcatccaactaaaatgaacacatgaactgaaacgcacactcttggacttctttttcccccctataaacagctgctgggatgagttgaaatcttttccacctgttgttactcttggctcgtggttaacattctctggctccctgttattctgtttgatctattcatcatgtatggctgctagattaataatcatgtggaactgtacttcttcccagatatcatggatggagaagtttgtgcagaagggtactcagattacagcacccgtacctgttggatttcctgtgacaacaggtatgggaggttttgagaggcctaccgccaagggagacattttgcggtcagatgcaagtgcagctctgaatgttggtgttctccatcttgtacccacattggatgtatttccgctgttagaagatccaaagatgtaagccacagtcatccagttctctataacaattattgcaattttgaaatataagggtacctgcagtaaattcattatggaagctggaggcacacttttggtactgtaaaaggtccaaaaggttgggtgaataatgggtaatttgcctcaaaaagctaaagaaagcatcaaagtcatcacttctcaaaacatttttaggcagaagtaattgagatactttagcatattatctaaatatttgaaattgcagtctccattttttttaatataaagagctgcactgcaccccagccaaacagaggtcttgatttgaacttaagaatcatcttgtgttagctcagggttaagaaatatgagctctttcaccgaatcacctaagcagctcttactgtatttaccaattaaaacaatagtagtctatctatagttctataccttttttctgacattgtggatcaacttatttaaagcatttttatcctacatatacatgccaaaattgcttgaggacaagtggttttattgtgcataagcttgctgatggtctgatggaacaattgccatgtgcagctcaattttagatcatgcgtaagttgtaatatattatctgtattgcaggtatgaaccaaacacgattgatctcgacctgaatgagtacaagtattatttctgcttcccctatttctagatatcttgtaggaattgaatcatttgatgatatctgagatgtacaatgccaggtactggttcaagattttgtcagaccatttgcctgaccttgtggacaaggtatggtgtacttcttgcaataaccttgtataacttacgagataagacaccagagttttctttgacaatatggcttagtgataattatttttttcatgctcccctccctccatatgagtgtgcatgtgtgctgctacctatctcatcctgttcctaaaacaatgtcccattgggtcctcataagttatagctaaatacaagccccaataacatgccaccagtttgcagtattttttttattgcttttgttggtttacacctaagaatgattatactcactcaaatgttcccacaaactcaacatttcttattaagaaaatttggcattataactagtaacaggtcaatcaatattatacgttataatttatttgttagcaatttatgaatacacaagtaactgtttatgttggaatctccacctcaattcctcttgtgaatgtgtgaaaaatgttcttttttgtactaatgtgcgcatgttattgttggtaggcggttgctagtgaaggtgggactgatgatgccaaaaggaggggtgacgcattcgcacatgctttttctgctcatttggcaaggtacgcagttgccattacatgacattagttagtacggagtatatttcagttttcttcattcaaaatcgagcattgataatctgttagtctgtaaagattgatattgtaaaactcattacactatgtcacttagcttcctaactcttttggttaagtttaggttgatggaggagcctgctgcttatgggaagtttggtttagccaacctgttggagctgagagaagaatgcctgagagaattccagtttgtcgatgcatatgttagcattaagcaaaggttagttcctgtctttctcgctctttatgtgtgtacgttcatgtgttcatgtgcttttatctaatcttacggttttaattgtgtgtgaagggaaaatgaagcttcactggctgttttacctgatcttctgatggaacttgatagtatgaatgaggtaggagatagcagggcttgtcattcaggcgtcattctgcttagctcagcacccaacagaattgatctgaatatttgttgttgtgcaactatgttttcaggaagctagattgcttgcactaatcgagggtgtccttgctgcaaacatatttgattggggctctcgagcttgtgtggacctttatcacaagggaactataatagaaatttatcgcatgagccgcaagaagatgcaacgtccttggcgggcaagtattccaattctgaccttttaaatgttatatttgtactgcaagatttacccaaagtttcaaattacttgcaaacttcttttttataattgctttgctgtgtttatatttttgtctcttatttcagattgatgactttgatatgtttaaaaagagaatgcttgctgataagaagggccaaccatacaaaagagcactgctttttgttgataactcgggtgctgatgtggtccttggaatgattcctttagcacgggaattattacgcaatggaactgaggtataagttaagaaaaacaataagctaaagacaagtcgcccttttgttatctttatgcacatttgtgttcaaattataggtaacagacatgatgctgtttcaagagatttaatcatggaaacaggaaagtttggatattaacaatgtatttaattaacattcctgtgttcctgcacatcaaagtacagtgaatgatagattgggagattgtcctttataacctagaattgagatgacttataaattttaccggccctgtgaaatattccttccgtttataaacatgtcgttttagacattgacatggtttccaagatgcaaagttgaccactaatttctattttagtatatttgtataacccaataaaattgtaatattatgaaagtggttttcgagacaaatgtacatatcattttcacgcatccaactattaaatgtaaaaaaaaaatcacacacctttattatagtccattttaatattatttgagtttaattgtatcagatctgatatccatacagttgacttgagctggtaacaaaatgttgattttgtaggtggttttggttgcaaattcattgcctgctttgaatgatgttaccgctaatgagcttccaggaattgtggctgaagctgcgaaggtacaaatgaatataaattctattttcttgtccatcctattgttatcttaagttctgttgttgcttgtaatgtactacagcattgtggtatacttcggaaagctgcagaggcaggtggattgatctttgatgccatggctggcatccaagatgatctgaaagatgaaccagtatcagttccccttatggttgttgagaatggatgtggcagtccgtgtattgatttccggcaggttagctcagaacttgctgctgcagcgaaagatgcagatttggtaagatagactgtagctctttgaactgaatgcattttctcatgtaaaataaattggaaagttatgtggtttgatatatcggttgttgttttaaatgttgtgcagttaatcttagagggcatggggcgatctctgcataccaacctcaatgcccgttttaagtgcgatactctgaaggtacttgtttctgcaaacagctgatttattgatgcgcacaattacaaacttgtcattcccttggctaaataccagtacaaagtaactctgctgtaattattgtactgaatatcttggaaaaaaatgttgaatcaacagtgtgaccagtatcggatctagaattattttagagcccgggcaaacttcactatagctagtatttattaccgaaattatatctcaatttttcctaattacatggaattttagtggattatccgctgacgagcctgggcagctgcctggggtcgccaggtggtacatccaccactgagtgtgaccatggtagggatgtacttacgatagagacaattctcaaatgcaaccatcagaggaaaaatacaataaccttgaatgaaatatgcaccatttggtcaacagccactgcgttgctgaatgctgacactttgctagcgaccactgcactgccagagccctgcttgcacgcctcagtcctcaatcgacctcccagcatgccagcaccaatctctgcccagatttgggtagagagtggtggtggtggagcaacaccaatggtgtgggagtggaggtataagagtaagaaagtccggaagtggacaatatgggggaaggggagtgcttagtaggaggaaaaggaaaaatattttaaaacagaacttttaaggtctaacagcgtagttgctttttgaagtaatggttctggcatctatgggttgaacccaactggaaatttattgccttacttgtcagtatgttcgggattgataagaaggctacattaaatctttgaataattgaattgtggtgtcatacttaaatcttgtgtgtttttacaaggttaacaaaatgactttatttgcagctggcgatggtcaagaatcagagattggcagaaaaacttttcaatggaaatatatatgactgcatctgtaaatttgaacctgttccttgaacaatgcggaagaatgtgccgtggatttggtttgctctagcacagaagcagctaataacaggtactgtgacactgtcagcacatcactttatcttatatggcactaaaattgtttgctgaaatgacgacttcgatttgtgcagaacctagataataatttgttcttaccagttttatcattttactgtaatttgcaggtacatctcacttaatctgtaaccagtggggtcatggtattagcagtgtcacatatccaagcaaaaagccataagaacaaatttcttatataagaactaaaagatcctctcaatgtactaaatgctcctttagatggtaaagaatcaaagaagtgttgttgacttgttgtgaatattgttatcaaaacaatttttctgaacatggagtagcgacataataaaggtttttaaagaatttgtagaaagcatacaagaggattcagcatttggaagaacatggattcaatatgcttgcaagttgcatcctcgaagtttgagaaataacaatcaacagatgcaatattgaagtttcatatgttgaggaataacagagagaaacacaaggggcaaaaaaaatgtaatgggggcaatatatagcaagttgattcgcaaatcaacaccattacaaatacaggcaagttctaagcaaagttgatgttataagccttgctcccgtccgccctgaagatgccgaagtgcctctcgaactcggcgccgggcttgccgtcctcgtcgtacaggtcgaacaggaacacctccacgggcacgcctggccgccgcggcgtgccggcgccgcgcgccacccgctccacgatcttggcgttgtaggcggcggcgttctgcggtgtcgccgccgggtgccccgccgtcggccacccggtctccgtcaccgcgatcggcacggcgccgaacccctccctgtcgagcgcggccgccagcgcgtccaccgtcgcgtcgaacatgttggtgtagacgagcgcgccgtcgctcaccgccggcgcgcccgcgccgaacagcgcgtagccgagctgcacgttgacggggtcgttgacgtagctgatgaacgggtaggtgttcaccatgaagggcgcgccggtgtcggcgaggaagcgcagcatggggcggaggacgtcgagggaggcggcgtcgaacgcgccggcggatggcgggtacgacgaggcgagcaccgacgaggcgtgcgcggacgagaccttgaccttgtcgccgaggccgagggagacgagcgcggcgtgcaggttgtgcatggcgggcaccaggtgcggcgcgtagaactggttgttgtacagcacctcgttgccgacggcgaggtagcggacgcggtcagcgggggcgtgggcgagcacggcggactgcagccaccggagcgcgccgtcgggccccgcggcggagaggaaggtgaggttctcgttgggcacgccgaccatgaggtcgatcccggcggcggcgaacgccgggagcaccgccgggtcggggaggaagagccgcgccttggtgatcccgttctgcctcagcaacgccgccgcggccgccggaggtggaaggttgctgccgacgcggccgtggcaaatgccgatcttgcccgggtcgccggccaccaccacggccgccgccgcgagcagcgcggcagcgaacacggcgacgtggcgccaacacaacgctgctcttgtcgccatcggaattgacgttgccaaggcaagacgcaagactgcgttattgttgctgtttttatttttatttatttatggtgcgttagatttggttgtcgctgtcgctgtttatatagatgttgctaagaataggagaggaggaggagacgttgagattgttggtgagaatctaaaagagagtgtggatctgttgctttatggttgccgaggctggacgacaggacgggtaaccgttggcatagccgttggttttcgaacaatgtcgtggtgcatttggagggagtatgaccatgagtatacacggccacgggtgggtcacacagccttgttgctctaatcatgtcgaataatccttgtgtcgttcaagaatcggtagaaaaaatccttgggtcattcgttagtaacgtcgcgtcttgtgagtgattaaagcgagcgtttttgtgcctgcgtcgcgtttactactgctgctactactaggacgttcctttttcgagttttcatcccacacggcaggactggttggtcggttggcagccgggacgagcgactgcgcgtcgtgcgccgcgcgagcacgttagcacgcacgcacgcacgcgaaccacgcctcccatccacccgatcaggtagacgcagggcatcagcgcgtgcgcgtcactgctcacatgcactgcagcattgtcgctggcttgctcctgctcccgatcagcccacggcgcacggggcctagcccaacccgtgcagctcctcggccaggcagagaggccgcggcccagccaggccgatgcgggtagtggactggtccaccgcggcgtccgcagcttccttgcacgacgaccatctcacgttggatttttccaccggtttcgcactttcgctcgcgctctgcctctctcgttgaaaacggtggcagcatcatcgtttttcacgtttccatcttactgtataaaattcttaatttttctaatttctttcggaattatagtgcaatcatcactacctagttaaattgataaatatataaagagctccgatcgatccacaatcattttcgtagaaataatatcgttttcatcatttaaggccccgttcttttcttgttttgctgttgcaagattattatttcctatcagcatgcttctcagattattaaatgtggtgttatttgaaaaactttttatataagagtttctttagataatctaaataaatctatttttttagtttgtaataattaatactcaattaatcatactctaatggcttgtctcgttttatggactaccgagcacatttgaactaagtctaagtcattaacttgcaatcaaggggtcaaacctattgagaacagggaacactctacttcgcatcggggaatccgagccgtccaaagcccagttatactataaacaaagtcgcatccacctcaccagtgattcctggattcctcctcactccactcaacgcccatcaacatggcctcggcgcctcgctcgccctccaacatatcctcttcctgctgctgttgctcatcgccgtggcagcatcttgtttttacttgcatgcttatagggacagcaaaaataaccacaaataaaatatcgaaccgaactgatcgagactgaaacagcttcaaacatagggttgttttggtttgaagccctacaaaaattttggtaatgccaaatcttgagcaagtttggcactaccaaaattttggtaaagttgtgttatttctaactctattgaattagtaagatttggccttaatccaaatagctaacaaatactattcaaaactaccaaataattggtagggtaataattggcttcaatccaaacatgcctataatcctaactcattcaattcaccccttcttcctggctttccttcctcctcgtcacaccgcatgccacccctccttccttgtgtggttgaaccacgccactccatgccccctttacttcaatggcaataggcgcccacatgtttctggcggcgacgctgcctccactccaatagcgacgggcgacaacggataccaacttggagcagaagcgtctacatacaataggattggggcctgcaaatccaacgccgccataaagaccactagcccaggtgccttcgacgagccgggtcggtctgccgctcttatggatcaacgtgccatgaattcttttagtttttttgaatggggataactaaagatttctatgatttgtttgtgattttttagtgaccagtgtgattatttccatctcagattttagttatgaccgaagatcaaaccaaaacggccgaaaccgaatagctcagtatttattactccctccatctacttttgatagtcatatttctaaatctgaaaaatttatttttgataggcatatttcaatccaacaacctattctcttaataactttcttagatttaatgcgtgattatccattcttccacacatgattggctacatgggcattgagaaatataaatattaataaattgtttgtttacgaggaatgactagtagcatgtttaaatggatgataaatagaattacttatcattggtctgtgtgccaagatgaagaaattttcaaaaaccacccctactcgcgcccacggctttcactcgctccgtcggttaaaaagtcgttagttaacctgcaattatcccattgtttctttaggagaagagataatggcgtcggtacataatacatatggattttccggtttcaaacccaccgaaaacaaggagcaccctgcatcgcatcgggaaatctgagccgtccaaaatccctcctcctataaacaaaaccgcatccacaccaccgtccattccggaattcctcccgagtccagtccactccgcgaccgcgccaacatgggcctcgcccaccggcgcctcctcctcctcctcctccacctgctgctgctcgtcgccgcggcggcggaggcggccgccgccggagcagggaggaaggagaagggtatcggcggcggtggggggctgcggttccggggcgggagcgggacgttcaaggtggtgcaggtggcggacatgcactacgcggacgggcggcggacggggtgcctcgacgtgctcccctccgaggccgccggctgctccgacctcaacaccaccgccttcctctaccgcctcttccgcgacgaggaccccgacctcgtcgtcttcaccggttggattcctctgccccgcccacccaatctcctcctcctccacccattccttgttagtgcttcgattaattaattaattattcaactatgagtagtttattctgatcaattttcgtatatcccacctaacttctttgtcgccttttcctacgaatcttggttaacaaatccatttctgataccgattactcagcagtttgtttgccactctagcaaagtaacccgcgtgacccaacgatcttacgagttttttttttttgcagcagtaattttaggtacgtaatattgcatgtaacataggtttaatgattctcgaacagtaaatgattggtgaaccggcgaatccgtttgcaacttctctgaaaatattacccgagtagtactttttctctgaaaatattctcgtaatggtttattgacagtacaataaattcgtattatatgtgctagtgaggtcattagcgagctgaatttgctgtacactggttcatacctcctctgacatttttgcagaggaagtgtagtttctgtgaacttgatacgtactcgtactagtagtactaaagtacaacaagaatgtcacgggtttccctttccgaagtgataaagatgtgtgggccgggccactgaagctcattcttggattggatttcaagaattctcatctgtagggtgggggttgccattcccaatcatgcagtgaggtctaggtctagattgttgattggtccattagatcactaccacgatgggatgaactggtctcgtgatggctacatccatgatacacttggacaattactgcacacctccatctgatcgagctagcagccgtactccctccatcctaaaaaaaactcaattcctgagttttcgcgtctaacatttgaccgttcgtcttatttgaaaaaaatatgaaaaaatttaaaaagataaatcatgcataaagtattgttcatgttttatcatctaacaataatgaaaatagtaatcataaaaaaaatttatataagacggacgatcaaacgttagacacgaaaatcgaagaattcggtctttttgggacagagggagtagagaagaacaacagtacaaatgttgcagcccttgtgatctgatcagctcttgatcactgtcctgttttcgtcgctttgtttcacgggtaaccttggttgatgttccaaagctgctacttttgcagcgtttggatgcagccactgctagctgttttttttttgtctgtttttccctttttgggtgcagacaatacatcaatttagtagcatttacataattacgtttttttcatataaaaatggcttgttcagttactcgtattcagaacgatgatggccatagttcatatacttcactgattattgttactttatttccctgttttaaagactatgtattgtttggtgatgctatttggcaggtgataatatctatggctttgatgcaaccgatgcggccaagtctatggatgcagcaatcgccccagccattaacatgaaccttccttgggctgcggtgatcggaaaccatgaccaagaaggtacgctgtcacgcgagggtgtgatgcgtcaccttgtgggcatgaagaacaccctttctcgcttcaacccagaaggaatagaaattgatggttacggaaattacaatttggaagttggtggggttgaaggaacattgctggctaacaaatcagtgctcaacctctattttcttgacagtggtgactattctacggtgccttccatcggtggatatggttggatcaaagcttcacagcaattctggttccagcaaacctcttcgaatctccaggtgaactttaagttgcacattgtacacacacaaaaaaagaatcaccaggtggaataagttgacataatgacaatgttgtgaaatgcagacaaaatacatgaaggaggaaccgaagcagaaggcggcagcgcctggtcttgtgtacttccacatcccattg

SEQ ID NO: 41217 - DNA, 38149 bp, Oryza sativa
cagaggctccaatggtatgacattctcctgtagagtctgcatgactgtgaatccatgatggtttttccaagctagataattatatctgattaaaaatgagtaaattttggtggatgtggtctttcatagtagtgtaccatcattgtttgttaaactactttttgaacaggactacaacagtttttagacttcaatggtatggcattcttctacatgactataaatctatgatgcttattcaagcttatgattatatctgattaaaaaatgagtaatcatagtgaattgtaatatttcatagtagtgtaccatcaatttttattgacctacttttcgttttcggcactactacaattaatcttaaagagttaccaattgacattttgaatatttggcaggaaggcgcaagaagaatcctgatggaaagatgagatagtgatatagatgggaagacggggatagtgaaatgttgcaacgtactacacgttatgatgtgctgtttgccaatttgttttacaaaattttcgatttatgtaaatgaacaaaaacatggtacacgacacggcatgcacccttttcgcggttgtaattctcaccgagaaaacagtgaattttagtaaaaacagttactgtagttttagtaaaaatgtcgcaatttgccaatgggatcaaataaacggcagctggaataaaaagagagccaaactggtggacacaatacactgaaaacaaaacatttattcaactataatcttattcgtgagccagtgggacaagataggtcaacgacattttgaggaacagcctcgagggctctttgatgattccttcttgtggtatgatatgacatattgatttttccctaaatagattacatatacagccaaatcaacaacagatgcgtgtacatcagacagtatccctctataaatatatgcagttgggaacgcaggcacaaacagaagtgcagaactcacatctgttttgtataactcgtatacagattccgaatgttgctcaaccgagatggattggcagcagcgctgcaagcctgcgtttggcgtgagattctacctcgtggaatagttgctctttcatggaaatctgaaccttgttttatggatgaatctccaaaataggtacataaccagcaggaaagtataccagatcaaacgccatcttcagattggttgatgctatagcttggagtgtggtctcagagggcatccaccttcaaaagcatggtcaagtacttcctcgatgcgcttcacaagcagaatctacagtagcaggtcgaagtaaagtcagcaatagacattttttagacagctacattgcacccaaaagggaaaactctatttactggtcatctacgattcaaaacatacgtctactatatggtatcggaaatttcttccaatgctactttatctatgatatattttttaactccgaaacaatttgtgcaccatacatatcaactatatgctcagggccttagagcatctctgactgtcgaaatacatagagcaaagctctcaatacatacctccaagccagagagaatgggtgctggaacctcagccaagtccttcatgtttctttctggcaatattactctcttgatgccatatctatgtgctgcaagtacctgaattccagaaaaaaacatttcaagttagtcaaagagcagagcagagaaaatggttaagctttcatccttctgaagtcaattaaataacatgtcaggaacctatagggcagtaccttatccttaacaccgccaactggcaacacaaggcccctaagagtcatctctcccgtcatagcagtgtcagctctgacttttcggtggctaaatagtgacactaatgatgttaccaatgtcactccagcagaaggaccatcctttggcaccgcgccagcaggaaaatgtatgtgaatatcacgactctccaataagttaatatcagaagtaggtgacagattaaggtcagcagctcttgctctcacctgtcaaaaccaaggaaatgatgagtaccactatgcaaaactaggcaccaaaacattgtgttttcttcttatgtaatattggagtttcattccagtaacaataattggagaaaaataacttcaaagggcgatatcagagaaccagcagaaaataaacaaagcagcatgatgcaaccaatgcatagataggtgaaagttaaagaagatgcttacccatgtcagagctaactgtgctgactccttaattacgtcaccaagttgccctgtcagatgcaaatcacccttacccaccatcgctgtagcctcgacaaattgtacctccccaccaaatgaagtccaaacaagcccaactgacactcctgggctcgccacacgatctgcagcttcgctatcatcaaatcttggaggctgtagcacaaatatagcatattaccataagtaagacaaacaaaaagaaagaactctgtagcttctcataaggctatactcaatactcaaatgtttaatagcataccccaagcactttttctagcatagcctcatcaacaatcatgggtgatggattctcataagtatttgatatgtcctggcccataggaataacttccatttcaacttcaccaccatcagcaagcctagaatccagtagagttgtagtaattggttgtatttccttgccaagtctaagcgcactatcttgctccgcaaccttgactgcagctgcacgggccaatgcagctaggttccgctcaagattacgtacaccagcttctcgcgtgtatctctcaatgatgagtctgaccatagcctggagaaatggcaagcatgacgaaatactcaggagtcaagaacttaacccaaaaatgtagcagttcatcaaagtactgctgttagcaaaatatcggaatgatgagatcaactctattatttagcagagcacaatcaggcagtgcctactgtttcatcaaaggtgcaaaagcatggtaaatagtatgcatctccagctctccacattcactaatcttgcattgattctagatcaaactaaactatttttaatcaaacaatatgccgaatttctttataggcaacaaaggatgcagcagaaaactgcatatcttacctcaggaatctgaagatatgtggagctcaagccatgctgttccagtacccttggtatgagatgtttcatggctatttttagcttctcttcaggtgtgtaacctggtagctcaataacttccatcctatctaacagaggaggggggatgggttgcatcctgttggcagttgcaacaaatatgaccttcgacaggtcaaatggaacattcaaatagctggtgaaaacatgttaaggaattctaaatgtatgataatatagatcatatatcaagtaaagaaatctcttctctaagcattgtgtagtgtacgcaagttataggcaacccagaacatagcattgcagataatgggggaaataaactgtaactatccaactaaatatgaaaattgagcggtacatgaaaaacacaatagaaagatgtccacaggtagtgatcccccccaactccattaagaaagtaaccaattaatcagaaaatgctgttcattatctgaataatttgaaaggatactgatcgttgaacgttttattctgctcagggtcaagaacttctagcagcgctgatgctgggtccccacgtacatcagaaccagttttgtcaatttcatcaagaagcatcactgggttgctgaccgatactctctgcatttttttaatgggcagaatatgaatatagcacaagagatttcactattaatccaagacttaagtatattagaaacacaaaatggtttgtcaggtggaaatacgacattaataagcaaaagtaaaacaagattggtctggtcaaagaaattgtaaggtcataagttactcctgaaataagaaaaacaagtgattaaacctttagtccatcaatgagacgtcctggcatgcttccaatgtatgttcttcggtgacccctaatatcagcctcatcctttacaccaccaagagagattcttatgaacttcctatttagtgcctttgctatcgacgatgctaatgatgtctttccaacaccaggtggtcccacaaaacacaggactggacctctggcatcaggcttaagctgccagtattaacgtgcacccatgagagagaaaatacatgatatcataagcacataaatttatgcatgtgtaccaaccttacgacagccaaatattcaataatccgttgcttaaccttggtcagcccataatgatcacggtcaagactctcctttgcagctctaaggtcaagctccctctcctcactgactttttgccaaggaagttcagcaagaagttccaagtaggttcgagagctgctatatccaggttgctgaggttgcatctttcttagacgcctgcaagaaaaaacaactagatataggaaccggcggtaccacatgcctgtacaattgtacattgagaatgagatgataagttaccttaactccctttgagcatgcttccaaatattagcaggcattccagcattctgcatcttcctttccaatgccgctacatcatcctcatcatcatcattatcgccaagttcctctttgatagcccgcatctgtgcattaaaagggttgatatcatattggaaacaaaacaatgtggcacaaaagaagcaatggaaacaaagcaaataaactccaacaagatgtgaatcgtaaaaaaagggttgtgctcatcatgtatactttcaaactttcaaaaaacatgtaagtatgatgaaatgtaacttatactgacataattgttgagagcaaaaacatcagcagcccgaaaatcctgaatcttcaagaacagaaaataacatgatgggcaaacaaacctgctggcgaagcaaaaactctttctgagactttgatagctgaccctcaaccttttgagttattttctcagctacaagaattgactgttcatcacaaggaaaggaaataagttaaaaactacccaatgtttaaacctttgatgatgaagttattaaaattaaggaaaactaattcactaatcataaatgtcttcacctgcaggtgcctgtcaacaagttcggttgccttggaaagtctaacttttaagtcaactgaatccagcattgacaactgctcctcaaaacctatttcaaagctagccacaaaaatatcagctagtctgtacacaggaactgtctcaagaagcaccttagtcctaccaactgtcttctgcttctgcaattagaaacaacatcattgccgtaagtcatacataaccttgaaagaaaaatgtcatggataacagaaagatgagactgcagatctgatagtcacattgggaatatctatttagggtatagcgctctgttaaatttcttcacctgttcaagaacggaaattagttccattgcagtagctttgaactgcctagaaagagcaatgagatctgggtcctgctctgcgtgctccaactctagcaaattgcacaaacattaataatgtaagtgttagaatttgatattaggtgaattcaaaaggcacttaacaaagaaggtacaagaataaactaatataccaccaaactatcggcataactacaatggaaagtggaagaaaagggtggagctgtacaaaataacagctacaacagacttatgacaatgtagtgcaggaaaatagcaacaaaaataaactaatatttttaacaaacaagatcttacccgtttttgtcatatcaagacgtgagacacgagcgacatgatatgaacctcttgcactgagctcttgaacactgaacctacataaaccttcaaggacgacaatatatgtaacccttccacttggtttctccacacctctggaaaggtgcaaagccctagcagctactcccctatagatggacggaatgaaaaagtgttacacacctttttttggagaaagggagacaggtaggaaaacacaacaaaattgactaatttccaacagttctcaatcaaataattgtgtcaaagaagagttgaccactatcaaccaatcttaaccctcttgctttatctaagcccactgcaagttaatgcaatgtcacaccaacgcatagtgcgcccaacagaaagaaaattatttgcttctatcaacttatcaagtgttcatagaatgtaataagagcatgtgcccacactaacactagtttgtttacctttagtaatcgtatgctattgttttcccactattcccgacatattcaaaggaatttcttctttaaatcttgttcagagatatgaccatatggaaaaacacatattagcaaagatggcaatgttacacaccggctgtgccagtgaatggtctccttcccattcttagtatcctgcttcgttgattctcctgcagaaccaccaggcgccttgctcccaccctcacctgaatcgctgcctacacctatatgcgagcaacagcaataacagtaagaaaccaccatacaacaatgcccacaaatggctcacagaaccaaattaaaaaaaaaacagcagcagcagcagcctttatctcaccaggagacagcaatgagccagcagcttcggagtcatgcacagggagcaccccgatcagacccttctcctcccgttgccagagttcctgctccacaagcttcacactgcaggagaaacaagtacattgatgaagtcaaaatccaaaccaaaaggcagaattttcccttcccaccaagtcaacacacactagcaaagccatcgtacgcatacacagaggaaaaatctcaatactaatctgaaccacaagtaagtacaacacgcctagaaggtttgaacaccaaacagatataattaggagctgaattagtcaaccataaagcaaccaaagccgctctaaaccactttggattcagcgagttcatcaaactgcgctggaaactttttaactgttcacatcacagacgagatcatcccatcgagaaaacaacaagtgacgactacaatacaaaaaagcagaaaaagaaaaagaagaaaaagcaatttctacttgctccacacaaattcacaaaaccacagacgaaatcgaagaaaaaggcctcacgaatcatgagctaagctgactaagccaatacaatagcatcaaacaaagctaagctactgcgattttaccaaccacacgctgattaaacctaacttggactaataatccatccaccacccaaacccccgcgcgcccaatcagcccatcggccaccacccaaaattccaccctagaaaacccacacaacccgagaccgtgaaaccccccaatctcgcggtgcgcggaatccgctcgaggggcgccgacgacgacgccgcccccactacttacctgctggggttggtgcagcggatccgcacgatggcccccgggaggagcaccttgttgcggaacggcagtatcgcgagccgtccaggcagctccaccgccgcgtccgccatggccacgcacctcgcccaccccaccgcgctggaatcgtacggaagtggaggggattacggctcccgcgctggaattgaaatcggaggttggagacgatgacgaagacgacgaaggggatatttatggggtggaggtggaggagagcacacacgagccggagccaaactgaacacagagagagagagagcgggggaagtcaaggaaggttgctgcaggtggggcccgcatgtcagtgagtggtgtgtgggtgggtgtggacgtggcgctctggtgggataagggaaagggggggaaaggtgggatgggatccggtgcgggggcaaggaggaaagctgattctgattggctgcggggttcgggttgttgtgccacgctggcggtcagggggtgggcgggtttcggtgtccgctgtttcggatttcggagctcaggctgcgggatggggggatgtcgaccgtccgagatgggatggcggacggtgtggatggtgatcttccgcgagtccatgctgccatgccggccgtaagatcgggatccaacggatgggagtggtttagcgagtcatctaggccctatcttggagagtttttagtcactacagtttcttgaaaaatctttagcttccctgcacctaggttttgattttcgtgaaaccgttaaatgtcggtttgtaaaaaccggtcgtgattagctggttttcgtacagcgttaaccaaaagtcatcggttttggaaaatgaaaaggcaaaccctacctacatcgtcacatttttactcagatcctaataaattgtaatataaaaatcagaagttgaaaaacttgtttattagattctcatctatttacaagttactactacctccgtctcaaaataagtgcagccatgagtttccacgcccaactttgatcgtccgtcttatttgaaatttttttataattagtatttttgttgttataagatgataaaacatgaataatactttactcgcgacttatgtttttaatttttttcaaaaaattttcaaataagacgaatgatcaaaattagacgtggaaaactatagctgtacttattttgggacggagggagtagtacatattcctcgaaatcttgagctctaatcttagcttccaaacaagacattatccaatccccataaaatcatgtgaaaggaaaaaccattcctaatcagatttgcacatcggaattcataaaattttttattagggttccgaaggagttgaccccataaacttgacctgtgaggtggagaattcttgcaatctcacgcgtattaaactagtgttaatttggatacgaagtactcgtacttaagttagcagagacgcttattaatcaattaagtccgtgcagaagaagcaattcttctactacgattatattgcaatttctgttgctaccaactgctatgatatgttcaataaaaaaaaaggaatcagccttccgccattaccggtataatgggtgtgtttagttcacgtcaaaattaaaagtttggttgaaattgaaacgatataatacaaaagttgaaagtctgtgtgtagaaaaattttgatgtgatgaaaaaattaaaagtttaaagaaaaagtatcaaactaaactcggtctaaatgaaagctcggattagtggagccatgtcggcagccgtttttatttattcgtctgttggcaaacctagatttgataacctaaaattcttgctgagcttttcccaaaagctgagctaggcacgtggaaatattagcatgtgaaatccatggctcattctaccgtacatgacgaatttatgaggcttccagtcaacttcagagcttactccaatagtactatatactacagtaggtaggcttgtccaatagtactctcttcgtcataatataaggtctcgttgagttgacgaaaaaaaaattttggatattacatcggacgtttgattagatattggaagggttttcggacacgaatgaaaaaactaatttcataaatcatctgaaaaccacaagatgatttattaagtctaattaattcatcattagcacatatgagttactgtagcatttatggctaactcaaaagatttgtctcactattttcatgcaaactgtgtaattagtttttcattttatctatatttaatgctccatgtatttgtcaaaaattcgatgtgacgtttttgggaaaaaaaatttgaaactaatcaaggcctaagtagtactccctccgtcccaaaatataaaggattttggagggatatgatttctagtacgcaggtactttgtccagatttacagtactaggaagtgtcacatccctctaaaaatccttatattatgagagagaggaagtataatttagggtagttgtccatattcgtaattttaggatatattgcatctatactatttatattgggatggagagagtactattgatcagtctaggattgattgctcacgtaactgtctaagagtttgaattgaaatataaaattcaaagtaatggaattacataatgcacaagatactatttagcaatgcgattaaacaccgcgtgaagcaacttcagttattacattcaggatatgatgtagacagggcaactagcatttctttatttctctcatttagtgattatgatttatgtgtgggatactgggattcgtggaaggaaagcagcaacctcccaaatatatagtagagttgcctcgtaacaaaatgatcagagtttgatactggcaccaacaatttatatatatgctacagtaactaaagtgataactgagtcatacggaccctgacgaattaattatacttcatcggtcccaaattataggacgtccttttttaaaaaaaaatatcaaaatcgataattttttaattaataattatattaaccatatagtatatgctaagtactatacacgttatatcactatatttatatttaaagtactttgatatgatgttaattttatatttgttggaagcataacataaaataaattaacagcaaaagtatattatagaagatcatataaaaaatatagtgcttataatttgagatagcacaaagcaaagtcgttagatcatactgtgttcccacgtgcaaggccggataactagacttggtcacgttcttttaagtttttccctagatttttaccgtggattacttgctccacattttcaaaaaaaaaagaagatttgttaaaaaaaaatcgtcttctgctctagagtttaagtcacttgttataagctacttcctccattttatattataagacttttttagcattgtccacattcatatatatgttaatcaatctaaatatatatgtgtgaatagattcattaccatctatatgaatgtgagcaatgctagaaagttttataacctgaaactgaaacagaggtagtatttcaaagttttttcttaaaatattacaattaatcgtgttaatcaggtaaacaatcagccacgataaaaagaagcaactagcaggagacttgggagtctacgagatactcacaggtcaccgccggcatgtgtcaaacaaacagtgcaccagattgcacgccgaggtaagcaaacggcaaggaaatttggcgacggttcagacctggattgcattaagatactcgatgtttagatggcaacacatgggtaactacctgtacgtcgaaggctttacctgacaggcagctctaaaatatacagcacgagctccatggctccacggcagcatctccaagacctgagcccaagtccacggctgatggagatgcatcccattgcttatccagaaaccctgaaagaattcacatatagttaaagatcagaatgcaaacaaatgcagatccaaaaatgatagatagatgtgaagtcatcgttctggatgtcgccgtcgtcatcacgacgacggtgtgggaaatttcacccaaatttcaggaatgggattaaaaaaaatagacaagtttgtttgaaatgctgaatatgatgcacgcacgccgtggctgtttattcacgtttctgaaacgctggatccaaatgggcaagtgaaggcgatggctggcttcaaccacttgccaaatcggaaagcgaggttcatcaaccagtacagcgaagtgactagtagagcaacaattattttgataaagacgctgaacaaaaaaaaatcatttttggaggcatggcactagtgttcatactatctttgtctctaataggggtaggccctttgatggttgattggcagcattgatcatctcatcatggtctcttgtcctgattcctgatcagtttcttgccttcacgggcttagggtgtgtttagttgacgtcaaaattgaaagtttggtcaaaattgaaaagttgtaagtttatgtgtgtaggaaagttttgatgtgatggaaaagttgaaagtttgaagaaaaaatttggaactaaacacgacaggtagttttgaaacttttcctgcaaacaatagtccctttatgagaagaatcgttatgagaaggtgaaaaatacagaactgtaactgattttctgaagcaagaaaataccaaaagatttttactatgcatcaaaatgagaaggaacttgtatatgagtatctgagattgttaggctttctaatctacaatttgtgaattaagtctagctaaatggtccttgcattcataaatgataaaggatgcatttatatgttgtaacaggaatgaggccttttgagtaccttcagcatcaagttggagtaagttaccagcctatgtgcactaggccataagggtagtggccctaagcctaggcccaaatttccatcgcagatttcacatttgcatctgctactcgaaatagaatttttttttccctgaagttgtggactgaaatttcaaggggtgcgaatcacatagcaagatcatcaaagcaaaaaactacatcgcccacgaaattcgaatcaggtcgtctttgccaaatcgtcagtgaaccgtaacacttggaagcacgctagtaagatcaccagtccataacgaattcaccggaagaaacatcatcacctcggattagagaattagaatagaacgaggcgacacgatgtatcgggtatattgtgaaatgaggaagatcatgtaaggttagagcaaggcgacggagatgggaggccacaccttaccgccggagaggacggaggccggagatcccggcggcggcgccccagatgaccgccgtcgtcgtcgacgacagcagcgaccagccgcggtagattggtaggcctcatagtctttcggcccactgatcaaccctatgagaagagacacaagttggccctctggtgcatgtgggcccaaatcacagcggttacgctccgtatcgcgttccggcccaagtcagctcagcaggattcttcctcggtttaatgtcctcgatttggaataagttcactttgactctcttaactactgacagaatcttattcgtcgtgcccttcaaccgcaatatcggatatctcgacccctaattattaaaaccggtacaatttgactcccttgctgcatgtttggttggagggagtttttaggagggattgggagtttagagggatgaggctatagacggccatatggcccgaggcccacggcccggcacgaagcccgcaattttggcccggcccaaccacagcccggcccgactagggtcgtgcccgtgtcggcccggcccgacagccgggccgtgcctgggctgcaccctcggcacggtgggccggcccggcacggcccgatcaaataaaaaaatacagggatgaaaaatagacttatataatcgtataaggcatggcccaagacaataggtatacaaaatagacttattatccagccatttaaacacagcccacagagttgagggaccaaaaatagacttatttccagccatttaaacacagccacagagttgagggaccaaatatagactttttctgtgaggcagcacaatagcccatcataccttcgggccagcccggcacggcccgagtagtattgggccgtgcctgggccgtgtatgccgcccgtgggctggcacggcacagcccggtgcgtcggtcgagccatgccggcccgacaagcctcggcccaggcacggccgggcttgggccgtgccgtgccaggcggcccagatggccatctatagatgaggctattaagtgttttgtttggttgggagacatgggaattttggtgggatggggatggggaattgagcaaggaactccctccttttcaatacctgggtaggggtaggtaattgggagggaattcctcctttactttttctaagcaaatctcagccatccgtttttattaatgacctaatctccaactaaactccctgtcaatttccatcacctctaccaaacaagatattgggattaaaaattaaattcccatcctaatctcatcatcaattccctcgtgtaaactcccaatccccttccctcgagttaccaaacaagccgatgattttggtcttttcgagagcagtttcgctaatgtgacatctacgtgatagtgttgacctgatctgtggcgttgacgtggcgcttagatagcattagaattaaaaacatatatgtgggcgccattcgtcattcacaaaaaaaattatgggaccgttcatgtgtctccccctctctgtccttccttctctctttctcttcctctctggtctctactttgacacgggatctggagcggtagggcgagggcggagcggcggcggcgccgaccaccttggtccccaatcccgactactacggcgcgctactctagcaccgcctgatgggccctgtggtcctcaaggtggcgaccaccgccggtagcggcatcggcgtcggctgcggaagccaccgatttgatcaaatcatcctcacccaccccacacaaagaagtgaggggagatggcgctcgcggtgttaacccgcattgctgcgttgtggaagccgtggttctcgccggcggctcccgttccacgactctcacggcggatggtggtgccgtccccggctcccgcggcgtggatgttgtcggctccgtcctctgctcctgcagttgcggcaccttctccacgtacgatttcctcgccgcgcgctgccgggtccagctaaggccccctcgtcgttgctgtctccctcgctacgctgtcgattttgaaatgtgagggtgatcatggaggatagcggttcgtgatcgatgatagaagagcgatgggtgaaggtgattagtgattcggaggagagtgttcgtgatcgacgcataaactagaagagcgcgctgcgtgggatgggtgagggtgatcacggaggatagcagggttcgtgatcaacgcatagattagtggtgggtgaaggtgattagcgattacggaggagagctttcgtgatcgacgcatagaacatataactagaagagcacgctgtgtggtggatgagggttatcacggaggagagcgggatgcgaaaagcggtgggtgatcaaggagaagagcagcggttagtgcgagcagaagctagacgcggtgaaggaccattatcttccttctgctcctcctcctcctcaatagaagtagaatcggcagtagctgcggccgccatggatgcttcgctgacctccgatattagttactccatccatttcaaattgatctacatatttcataggtacaccaagaccaaaaaaagctaataactctctcatactatatttactctagcaacaaactcgatgcatgcaccatccctactatttcctagccaatagcaaatcaatatattgcatgtgggttataaatacttgtgtgcatggatgcatgtatcaatgctaatttactccaatgcacaaataacgaatagacttaatgaatgaacagaaatatgtagatcatttaggaataatcttaaaaaaactatatgtagatcaatttggaatggagggagtagttcgttagagagagaggatcggagaaagaaggtagtgggtagtcatggactcggcccaatgacagtacacttttgtttttggcccattcaggccgtaggtgttctgtctcgttgataacagctatgtggcgtgtctagaaattggatttgtgtctcttttttttcttttcttttaactattttttcttatgtaaaattttctcaagacgacccagttttagaaaaatatacattagtctctagatttatctttctagacacgaagttaattaacctttgcggcgccatcatcccgtgcaacaccatctccttcctccacctccacttgtaacgccatcgcctcctccccttcctctacctccacgttgatgcgatgagagcgtggctggcaagtagggaatttgcaagcgtcaatgactacgtgtgggcagggaagagatgggaaagaggatgtgtgcatgggagcttgccgagggtgtggcggaagcagcaagacaaacgtcgacgacgccgttgttgtcgggacggagactaccagcggcgtggtgggtgaagtcacagggagtcgaggccgacaggacagggagatcgacgggctaagggccaacctctaggtggccgtgcagacaaaggagaagagcaggaaggcgtcggacgacctcaccgccgcactctccggctacgatactttaggggagaaggtaatgctcatgcgcgtccaggcagtcgaggacgaggcccacgcggcagggcaagagaaatgtcaaaatagagagagaagaagaagtttgtgtcgctgacacgtggggtccaccaatttttaatcttattttaaagctgaaatgccgtgacatgtggctcccacgttaacttagccgccacgtcagctaaaaccgggaacaatattaccttgcgaccaaatgtgatccggttttataagttgagggtcggatcatacctgctatgcaggggcgaattttaaactcgacgacaaattgaccgagtcccatcattctaagcccactaactctcctgaatctcccttgcggacttgcggttcgaacagaccaaagcttgggccctcgacttctagctttcgcagcctgcagtattggtaagccctatgggcttacagcccacgtgtcggcccaactcatggctgctggtgcccgtgggcttcatgctgcatcgagttcaaaagaaagggggaaaaaaaggaaaggaaatcgtaacactgccctaagcacgcctactttcaatgaaatctaatccctccgtcctataatataaggaattttgagtttttgtttgtatcgtttgatcactcgtcttatttaatttttttataaatataaaaaataaaaagttatgcttaaagtactgtatataataaaaaataaataataattttaaaaaaatttaaataagacgagtggtcaaatgttgcaagtaaaaactcaaaatcccttatattatgggacggagggagtagttatctaccaatcaaatcaaatgtattctcatactactatcctcatcctaaataagcctaaaaaatagaaaggaaaacaaaaaacaaaaacgccaagaatccaccaactcgtctctgtgtctctctttctgtacttttctttcttcattcatgccgtgatcgatgatagcagcagagtgcaacctcacctcctcctcgccggctgcggcgcgacgtcgaccctcttccccttgccggaggcggcggcggcggcggcggggggaggaggagggtcgggctgcgactggacggcgcggcggaggacgtcgacgacctcggacatggtggggcgctccttggcgttcttgaggaggcaggactcggcgagcttggcgatgtcgcgggcggccttgacggagtactcgccgcggagcctgggatccatgatcatgcggaagttgcggctgtcgggggcgaactgggcgacccactccagcagcttctgctccccctgcggccggtggcggtccagcgtccgccgccccgtcaggatctcgtacagcaccaccccgaagctccacacgtcgctcttcaccgtcaggtgccccgtctctatgtagtccggcgccgcgtacccgtgcgtcccaaccacctgccacacatcatcatcatcatcatcatacaccatcttgagctcagctatgtatgtatcatatagtaagaacatgaaaaagaaaaattcaaacctctgatcgattggactacgacaagaaaaataaacgaagcaactaagaccgatttatggataagacatgtttttagcgaaccgttcaaaagccaaaatgacatcaaatagggtacatgaaggtaaaaacaaaaaaaaaacaatttaaaactaagcaactacaaatagtttatagataaaacctttatatatgtgtgtgttattagtggtttaaagctaaggctattaagggggtgtttggataccctgactaaactttagtccctggtacatcggatgtttggacactaatttagagtattaaatataaactaattataaaactaattacacggtggaggttaatttgcgagacgaatatattaagcctaattagtccatgatttgataatatagtgctacagtaaatatgtgctaatcatggattaattaggcttaaatagatttgtctcgcgaattagcctctatttgtgtaattagttttataagtagtctatgtttaatactccaaattagtgtccaaatatccgatgtaacagggactaaagtttagtcagtgtatccaaacaacccctaaatagactatgatgaaaagacccaaaatcaactttagaattatgttttagaattcaaattttttgttgtggctaataagccaataagcagacaattatagcattgatccatttcctaaggataataacatagctcaaagctccttcgcaatgcaggaatttcatggaaatcttctaaaattcctatgttccaaaggtctggtatggtatgccatagagcagttctgcgtcaatgctgacacaaggtgcaaaattcagggggagaagagtgatgcatgcgtggcatgtgtgcatatgtaaggaagtggtggcaacttggtccatggcattgacttgctggattgcggtcaagattgtcaggtacacatcaaacaggtgcactggactgcttgcctacttcagtcaacgatgctttaaaggctgtagtatataagttgctttcagtgcctgatggatcagacaatgcagttgcgagaaggctatggttttgtttgtaattctaatagcaggttcagatggagacataccgctgttgagacgtgagtgtttgctcctgttggtccctcccttgctagcccgaagtccgacagctttgctctgaagtctttgtccaacaaaatgttagatgctttgaagtcccggtagattacctatcaaaattgagcaaatcagatgaggatcttcccttttgtacaaaatggaaatgtcgtaaccaaagaagaagaaaagctgaagtaactttgtatactaagcagcagtacgcaattagcactgtaaattatgacgatgacctgaaaaaatgtgataggtttagccttccctaacagcctgtatatcttgatgctcaccagctatagagccttcttgcctaagtccttaattgttttctagattggaatacttggttctacagctaaactagaacatagagaggacaaatcgtatacgttggttgcaactaggagtagttagtactgattatgctttcagaaagtgtcaatgaaatttggtgcctggaatcttacaggaaagtaatggagatggagatggaattgaacaaaccacttttgcctctttttcatctagctcatcaattcgtggtccttattttctcattgactttacactggaatactggattcactgcacctctattgcactacctctagttactatggatgcacggtcaaaagaacctattaaaacgttggtgctgtctctcatcatatatttttattgccaaactttctcccacaaaaaacgaaatcacctatttgataaagatatatcttttcagagaagttgaaagcatgtgggcaatgtatgtctgaagtatacctgaacttgcccttcatgcaggtaagctaatccttctgcagcacccaagattatttgaagccttctattccatgagagaggaggataagctcggacgaataagtgatcttccaggctcttattaggcatatactcatacaccaataatctttgtggccccctttcaccatcaacggcacaatatccaagaagctttacaaggtttgggtgctcaagaaccccaaggaactgtacttccgccaaccactgcttatgtccctgggagcaaaattaaaagaaactgcaaaatattaggaacagaagacaggattactcattagagggatagcataggagatcaaccgcatttgttttagtagcattatagcacaaagcaaatataggaaaccaacagacctaatgctgccttacaagtagtttattcataacatcactataattagcgtgcatcctaaattcctaatatacatcaactggtcaagaaaagacatcataactgagtcagtaaaatatcatctaattcgagtagagaaacttggaaaaatccttatatttttagcagacaccacttagagaaaatgaagcttatgcttgggtattctattaagttcaggacttgaaattaattatttcctgtactccactaaacgatatattcactaccggtttgtcagtctttagacatcacttgcataaattcagaatggatatagagtcgcaaagcacatggaaattgaagtttctagctgacttttgttctatatgttcacgcaccaaaatttttcctcctagtgagtgaataatagtcaaataagactagcaacatggttgtgcaggttgcccagaaacgtaatctattctatccattagtcttctttgattgagcaaattagctaacggaatattgatttagagtgaaaggttggttcgcatcattttctaggagacatatttctactgtaagcattcagagaagacatggtctactattaatattgattgccatttgttttatgatgaccatgaatgaatattcaacttccaagtttgaggaagtaaggttcctagatacttgaaaagttcattgccgttcaaattctatcctgtatttcccctccattttgctttattatgaataaacagttgccacgtgtgcccattggtcctatatttaaccacatctccacgcccagcacctcaactagtaatagtttatgcagaccagtaacttctatagtcaactgacaatggactgaagtaatccaatgcaatagattgaccccataaaatatactatcaaaattgtaaaataacagtaacaggcaatatctcatccttgaaagttctgcattttgatcctgtcttcctgtcaagattgtctacacagagagagatttttaacatactgataatagataaccaaaccaatttcaacatttagcaagccaggaatatttccaatattccggcaaactagaaaatgacttgtgtccatggacttcctatggatcagaacaacatacttgtcagtttatccagagaccaattcaagatcagctaacaccaagcacagaatccattaactttactccccataatgaatcttcccataacagtcgttaatctaatctagtggtcactactgatgattttcatcaaatttggcagaactacacattaaaaacaaaaactcgctaagttgcctgaaagcattcttctgcattctatgccaggatcttggcgaagagaagtatcaagaacaacaaaaatggcatcatttgggatctcccttaaaaaaacacttcccttatctaccagcactaatttctgacaatactgaacataagagagcaaaccttaaactaacaaaactcattccccaattctcctattcccaaattcctattcacccctagttatcaaaccggaaatcaatcgcgcagaatcacaaaggggggaatactactcctggatcggaatggaggattcgttcccgggtgacaactgacaagacatgattgatggtgtccaagaaaagtcaagaggagggggtgcagactgcaaagagagacagagacaggggaacgagaaggaggaggagagcacgcaaacaagcgagtacctggagaccccgctggttcaggcacttgacggcgacggcgaggcgatcggcggccttgccgtcggcgggggaggagcggacgaagcccttgtagacgctgccgaagccgccctcgccgagcttctgggcgcggctgaagccgttggtggcggcctggagctcgtcgtagtcgaagtcccggagctggccgtggccgcgctcctcgtacagcgacgagatgctccggtgcgacgacgtcgaccccgtcgacttgctcgccggcctcaccgccccggagtcgtccgacctgctcgtgctcaccgccgacaccgtcgtcgtcgtcgagccccgcctccccgacgattccttgctcttggacgacctccgcttcttgaaccaacccaagcagctcatttcttgcagcaagcaagcacgcacgcacgcacgcgaaccgtgtgcggtccaaaatccttttgtaggcgaagaagaggaggcagaggcagtgtgaactgtgaaccgcggaaggtagcaatagcaaagggagaatcagaaagctcgccaagatttatttcggcaggcgagagagaggagaggggaagagggcgcgtacgtgcgggggtagtactacgtttgatgaagcggccgcgtcggcccggttggctctgccaactcacccctctcgtttctaaaaaagttttatataaaaattgttttaaaagattatattaatttataaataaataacaaatatatatttttttagaattacacaatacaacgcagacattcacaacgcacgcgcactcacccctatgaacacacgcacgcaaaccctacccctatgagcatcttcgaagactgtgccggcaaattctggaagagactgatgaagtcaccacaggcgcctcgctgtcgacgggtacgtcacttaccactgaatacataattaactatatgttaataaatcactacggtttatataaggccagacccagcccaatacattaaatatagtttccataaactccacgttatcaagaaagtaagtattagacactactttttcatacttcaatttaatgaagtactacttatttcatatgatgtcttggatattgtgaaaaaactatgtcttggatatttcttttttcctctctatttccttgtcatattattttttttattttagatgatagtttatttaatgcttcgtaggagtacattattctggttattgcattgaggctggcctaagtgctgccggtggtggccgttgcacgcgcggtgcgtggtagactggtagttgattgatcagctgatcggttgctgctgctggggcgcaccgggcgcacgcggacgcggtgtggtgtgagctcggcgggcgggatggggacggctctgtttggtgttgggtttttgttgtgtggattgcccgcgtcgtcgtacgggtctcaactacgaatctgaacgcctcgtcggcttcgccaaattcgcatgcctgcgcgtctctctctggctctgcaggtggccgtgttcggttgcatcactgtatagcagtcgcagcccccttttctaatcatggaatttaaatttactttgcatgagttgcgtgcgtgatgaaaacaacagctgtgggatggtgatgcgagtgtgtaatcgagaatattttttagggaaacgaatatgttgttctagcctgtgtttagttccacgttaaaattaaaagtttaaagaaattggaacgatgtaacgaaaaaattagaagttcgtgagtataaaaaagtttaatgtgacgaaaagtttgaagtttgaagaaaaaagttagaatctaaacatggccctacttttttatgaaaaaacataggataaacgtagatgtttataacatgcacacgtaaaatctatttgtatgaataccttcagaagactaggatcaacatattttaaaattcaagaagtcaccacatacatctcactagataagtacgtcaactaccactgaaagactaattagccgtaaaggcgtcgtgttacgtttaagatttgaacttgagtgagttgacttcaccaattcaatcagttgagctacgtttattttgcatgtgtttatagtatttgggtgtacactttttctctctaatatcttcacccgcgtggattgaatcttctcgtcagatatatactgatatggaccacaacaaactttattatcactatgttttacagagtttcataatctatttagctccatccttgtatacatcgaagttgtcggccagcccaaataattttgatgatcaatagccacaagcgcgagaataattgtgacgaaagtcaagagggaacatagattatagtgatatatattattcataggctcgtagcttaattcatgttttgttcgacgatttttgatattgtttacttgcatatatgccatgtgtttgttacgttgggcccaaacaatacgacacatatatagacctagtcgcgacagtgtacatgattcttcaattgtttcttgggtaatgggttccatgcatgttccaatagtccaagttgggtgtttaaaacttggaagaaaatgtgaaagaggtgttaggtgaattcacacttcagtgcccaagacaccttcaatgtcaaatactctaatcaatgctggtcaagtgactcataaaaaaaattgttggtcaagtgaaaataataaaatacagacagtcttagaatagtgtgtttgagaggaagaaaacatataatatcccactatatacataggatttcaataaaatatcactcaatggaatgcatcgtataaaataccactcaatacgttgcctaccagatgaaatattactttgaggagttttaaccatttttatactcgaaatgcccttggctgtggctatgaagagagagagagagggagagggtgagtcaggggaggaccgggtgcatggcgccggagacctcgctgagaggcggtggcagcggaaggaggacaagacggcggtggggataaggaggcgacaacaaggatgagacaccactatggaggtggagatagacccgtcgtcccggtcacttctactcgctgcccccctcccaaaaaaaaaagcaaaaatgcaaatggtgtgtttttcataaaaaaaaatacatatgattttttaaaaaaagaatttaaatattgatcacaaaatcattcacctaggccgagtttagttccaaaatttttctttaaacttctaacttttccatcacatcaaaactttcctacacggctacacacataaacttccaactcttccgtcacatcgttccaatttcaaccaaactttcaatttttacgtgaactaaacacacccctattcagctataaaaacaaatagaacaatccatttgtgtactataatagtacaccactggaacaagaaagagggctattattgacccagttgtagagggatcacattgctcagctctaaaccatactattccaaagaacttctgcaagacacccactttgaaaaaaaaaaacacctaaacaaacaaattgccccttggaaggacaggactagttagtgctgtgtgttgacctgtgtaaacaaaatcagattttgtgtaccggctttctagtgaactgcgtacaaacggtgcagatgagaggagacaacagcagcatcatgaagagcactggaggagaagaggacggcgacgcctctgatgaagagaacccgtcgtcgtttctcctccccggtcaaacacacgggctgcaagtctggaatgatggagaaccaaacaacccgctcaatccaacgctcacgtgtgcgtctgttaggctgtgggccccggctgtcaggctgtggggccccggtcaacgtcttgaccgggacgcgactgtcgcgcagtgacgtgctgcttgatgaacaacaacacctggtctcttcacggttagcccaagtgtgaacttaaaagtacagccaatcagccatggttagactttggaacacgcaaaattaacttggtttctgcgaaaattgaattgtcatatggtctctccgtaatttttttatatatagatctttttagatggaggaaatactcacatggtttattccctccgtattagaaagttgtttttttctctagaacggaacgaaatgagtattcgggaatcatgtaaaattttgtgttctgaataatggattaggtcgtgtttagttccaaagtttttttttcaaacttccaactttttcattacatcaaaatttttctacacacacaaactttcaacttttccgtcacatcgttctaattttaaccaaacttctaattttggtgtaaactaaacacagccttaacctcgctgttcagagttgggacatttgaaagacaatactgtataattcatatgtcagggagctaactaaaagttcagaagaaagagcgagtctcaaacattcctctaccagtgtcaaagcgtacggagctatgccagcttgtcagctgcgagctcaccatctcgccatagtcgcgtgccaaaaaaaaaaaaaacaaaagtgattgatcacaagaatcgcattgctgccgggtacaccacgctgagatcataaatttacaatctaattaagaataattaatggtatactacacattgtcaggtcagcccggtgagcttcagaattcgacgatccatcattcatcgcatcgtcatcagggcttaggttgacgacgccccggtcaattcatccactccagccgttgtcatcatcatcatcatctcctcgtcttgctaaccgtcgcgtcctcatcttcttcttcctcctccggattaatcttctgtcgcttctgcaattggtcagcctgtcagcaatgcagatcaagaagttaattagcgaatgtaactattactaagcagtgaactgtgaagcaattcaatccatgagatgcaagtcgtatgaacacatctgaatgcatagaatgtgtccggacagccgtgtcaatcgattgatctagacgaacttggctggaaacagttttgctgttgcagctgacgcgaaggacgttgactccccttactggaatcgcatgctcatctgtgtactactagtactgaggaggattcaggaaaaggtagtagaaagaaagaaaaaagagtcaggactcgagactagttcagttcaatttttccgtaccctttttctgaaacaaatctgccttttgattttgaatgactaataacatgtaggtacgtacttcatatctaacggatttaatatataacagtgatccaggttagaaaacagtactgcagagagaactcatcacctaaaacactgcacggctgcacctaccttcggtcttttcttgtaccaatggttttgaatattttgatcttttcaaccactcaatgtcatgcaggttaattggcgatttaatcgccttttctgcaattcttaaatgcgacaaaagaaaccatcgtcttggccagagaattcagagtttactagttcaaacatggtatttctctttcactgtctagtgcatagtagtatttacaagtagtatccagctagctttttactttcttcatttctttacgtgatcggttaactgtcagctagagaattttggatggtccgaagatttctaccggtatctgtcagtgtccatttttgcagagctgtactactgagccttcattcaggtattgatcgttttcgttgacggatcggatcaacttccaggacaagcacggccattgccattgcatcgatcactatcgaacaaggaccatctatcaaatccggtttccgcgttgcacagatccagagctgttcctctcgtcggtttaagaatcaactccgacgcgcatttactattcctatacttaattaaggttgttgcagtcatgtctcagctacgtgaagaccgggcgtgtcgatcatggcgtcaatggtgaccaactgatgatcaacagtgacagaaaatgcaaatctattttctccattttgaaatataagtatttttatattattcaaaatttatactacaatataagtgtttctggaatactggttctaaggcactgaatacatattatgatagggaatataaacaatttaaaatttaaccaccatagtgagtttttttttacaaaaaaagcctactgtggtgactaaaaaaatctttttactctaacctttagtatttacttaaataactttaaaatacttatgttttgaattaaccaatgtcatatactaatctaactataatatttattaaagtaaaatttactctattttaaactaaccaatgtcatatatcacagatggtaagcatatatggtgtgaagtgaaaatatatgcttatttctagtctattataaaactttggctaataaagatgatcaaagtaaaatttaccctattttaaactaaccaacgtcatatatcaaaggcggaggtagtactattgtactactgcaaggtgttcttttcttctgaagatgaagatgaagattaagttttttacgcaaaacgaggtagtattaacgtatgattgattgagttttaattattataaacttgaaaaatatattaatatggtattttagagcaactttcatatagaaaattttcgcacgaaacgcaccatttagcagtttgaaacgcatcatattgttgttggagaaaagaacgggaccaagtcaagttcagctagcgagcgatgtggaaatcggtagctgcaagcgaacgcgaaagttcagagaatgtgtcgcgcgcggcgtcagtgtcactgtacctggccggcgcggccgccgccgccgctgcttctcgccgcctgcagctgcgacgagacgcggccggcgacttcggcgaagcaggcccgccccaaggacacggcggcctggaggtgcgacgccgtcgcgtccttggcgctggcgcgtagctgcagcaggccgcggtcgatgtcggcctcgtgcctcgccagcaccggctgcaggtagctctcgtagacgtgcttcgcgccctgaaaacgaacagacatggaatgggtctctgaatgttgagaacgatgtctccttgagcgtttctgaatgttcggacttcagcttcagtttgaattcagatttaattttctttttgcagtacttttatggtaggtctctactgttagtattcgatcttggggtgtgtttagttcacgccaaaattagaagtttggttaaaattgaaacgatgtgacggaaaagttggaagtttatatgtgtaggaaagttttaatgtgatagatcgaaaagttggaagtttgaagaaaaattttggaactaaactcggccctactgtgaaaataatctcaaccattaattcctgggttctactattagtagaaaaaagagcactgctacagtgtactgaaaaaaaaccatacaaacataattctcaaccgtttgaatttttttactagatgagcacacgttaattctagagttctatatgatcagatttgtaaaactgtgagtgtttataagaaaaaaaagtgattgtatagcctttttcccagaaaaaattatgcaactacaagtagttgaagtgctagtgaaataccttaatttttgcggttgtcgagtgagtgtactacaagaaactaaatctgataattgattatcggagcagacaattattcacgaatggattagtaacattacaaaacctagaccattgcatcaaagcaaatatagcacatttgagttaatcaggtgagtgcttactcgtgtctttgggtaccagaggtagagcacgagcgcaagctttgcctcgccgtacatgggcagccatgagaccgtgaaataggtgatcgtctccaacgtcgtcagaaacgcgaggagaatcctgaacagcacaagcaattgttcagattcttcagaattcaggcaggatgcagcatgattttgcaggtttgtttgtgtagggtaatgcttcatcaccagtactgacaccagaaacgcaactgatcgatctgcggtttgttcagttccagcgtcttgtagcagtcatacgccgggtaggcgtatcctaaaaccagcctgcgttgcagaaagatgcaaagaggacatgaattgggcttttctgatctcttccacgaactgttcaaacggactgaatattttttcgagattactcacgtcagaagtctagtgataagtaacaccgccatcttcagtcgtcagaacaaaagaagaacacaacaatctgcaaagggacttttcagagatttatcaagcccgtgattaaagaagcaaaattaaacaatgcaatgcaggattcagatttgcaattgcaaaaacaaacgaacttctgaagatactgggaacgtcgtcagaatttaatagggccaaacaatcataaagatcgacgagaaggaaaccaaccaacaatgaagttaatacggatcgcattgcgcaatggaaaattacctccgagaatttttcaccctgcaatcaaatggcttggatagatttgttgcgagggatgaactgaaaccgagaagagcgcgcggttaaaatatgcagggatgcggttaacattggatgggatacggaagatagcccaaccgacgcctcttttcgcgccagaaaaacggttagaggaagcggcaaaatagatgggccaacaattcatggctgaagccacgtttactgaagattgttaactgaccatggttagtggtgatgccctgccatttcacttctggactcctacccaaaataagctgcaaattgtttgtcagatcccaaaataagctgtatattgtttttttaactactcccaaaaatataagacttactttgacggtccaaaaatgagctttgactgtaaatttctgtaacactacttttacttgcagtaacaaaatcatagccataagaaagtagtctcggtctctcggacatgaatccaatattaccattttgtatgccaaaataaatatctttggattattcgcttgtcaaagcttaaaattggacagtcaaaatatatcttatatttctgaatagaggagtagcatttttagtttccagcaaaaacaatttccaggtagtacagagggaaaggcagagtagggcatagtttctggggatccaagaatgtaaatttccaagaggtcctagggtcccaaatgccaattagttatgacatttcgaccaaccatgtggtcactaacgatggccattattataccagcctccctgatccagtgtgtataattgttttgactttattattttctttaaaatttcttggttctttgggacacattcacagaagccaaaggcaaagcatgtcttctcgttacgcttcgttgtgggccatgttgctttatcacctgtaaccctataaaaccacacgccaacaatcatggattaataggccatgatgaaccatactgaaaagatgtccaatttatgtatgaacatactgaacaaactggattaatacttccctctccccatgtgatctcacatgttcagtgcaatgttcatcttgggagggattttacagatcatcaatacaagctaccagagatcattttagaatcaacaaatggaatccgtcctacaaatacaacactcgtagtatcagatagtacaccagcaaaccggatgcaactacgcagcagtatttgtataaacaatagcactatggcacaagaactactactgctaaccacccatcacccaaaagatgaacaacgaagaacaccgtgaaggcgtttcgctgatggcacattgcctttggtcacgccaaaaatctctcattgtacatggctacatgtatatcctcccggttggtcaaagccattgcccaaactctgagagagctctaggtgaacgactgcgccacagaggaagttgtgaccagaccagaaagaagaccaacgagggtgccgctgttgtaagtgcttgactctgtctgaacagcattgtcccgagagtcgacgaaagtgtcattctggaacggcccgcccacgagggctcccatggcgacgtttgggtttgggctcgtagaatgaagatactggaatcctttgcagcctgtctttgcatcagcggggatcgacgcccctctgtggtgtacctgctgtgggtagctgctcccatatccaaccaggtagctaagcttcattgggttgtctcccaagatgtaattagcctgacatgcaacagaatatatgttagaaacttactgcacaacaccttcctggtcagatgctaccaacacagcagagcagaaatagtgtgtaggtcatgagtcatgacaaccaaagttatcatagaatgtagttaagccacaaaggcaagcagtgtgtcacaatgtgccgatggctcgtgacaaaaaaaggtaggcatgtaaatacaaggaatgttttatggtgtttcttgttgaacttcaacatggcaaactggaatttcagtatcttgcaaggttttctgtagttcacctgtgatatagcaaaattgcgtatatctgtaggactgtagtactttccactgcattgcactgctgctgtttgcgatgtgagcatgtagtcactgtaaacaacagcaaggaatgctgcatttgtggcatgctggagagaattccatccacttatccacaccaatccccctgcacaaaaatcaccatcatataattaaatcacaggcaaacaaaatacagtttgcacatattctgtctaaccccagaaaatactatttaatgtaaaaaaaaagtgaacaacaaaagcctatgcataaattctccatgtattgacccataatataagatcaaacagtggaagaatttcaacataccaccagtcctactggcagtagctgatggagaatctggtaggagcccacaaatgacggcttcagcagtgtctctgtacattttgagtcccatgttttcagcattagatgtctgtttggatccaaagaaatttaatcttgacaagagcacctgcacataatagacaaaatgcattgaaagttatattctttggctgaagagtgaactaacgttattaaaggaagataaaaggcgtagcttcattcctagttcccgaataacaaagttgcttcttaaatgttcatgcaaaattgcaaacctgtgtccctgcaagtttgtcatcccaactgaaccatgttggccttccccaatcagcaaaagcttttccattctctacagtcacataactgaggtatgtttggtctcctgtagcatgatagagccaactcgctgcccacaggagttcgtcttgataaccagtagaattatagtagttttggagctttggataggtgtcactggcgaggcctttataagtatcagcaaaagtaaacaacttctgagcatgttgaagaagtgaatcagaatatgtagtgtctctggatttgaaaacaattgatgctgatgccatagctgctgctgcctcagcagcaacatctgatccaggagactttgtgttaatctgtgtgagtggtcttttctcagacatagtctccggcctttcccagcagttgtgatctagatcaggatcaccaacctacaaggtaacagttatacacgttagttgattaatatcaagacgttcaacaaggtgaggttgctgcatctattgtactgatctgttcaaagaaatatataatgtgttctttgttagatggacttaaggcaattaacatgaacaataaactagcttataagttatatctgatttcatcatcttatgtacattgtattctattcatcaggtattgaatgtgctgtacaacctacccaagtaagcatgactaaacatgtcaacgcaagcattgagtgataaaacttccacacatacagaaattcaactcataaaaacatctggcatcccctaatcttcaactttcaaaaacacccatccccctaccatcaagggctaactctacatattaagagatgtgttgaactttactcaattaagtatgggactaccatccaaatttcaaagggaaaaaaaaggactaccttggaacattgtgggtatatcatacggagaagtctatactgatagtgtgaaaagaatgcaactataaagacaaactggaaagggcatggacattgaacttgcaacaaatgtgttgatttaaaccgatttaaacgtatcaagccgaaaacgaagtacctcctaactattaggtgtccagatcacgacatctgacctggcttgcttcttaccaaccaaactttccctctactgaaagtctgaaatgccgccaggccgcaataaaccacaactaaagcaagcatagatcactcaaaatttttacatagtataaagaattatgctacagctctaacctgaatgtagaacacattgtcagatggatgcgcattgacgaggaaatcagtgatccatcggagagcatcaagcgcagggtccagctgcttcgtggcgctcatctgatctccatactcaagtatggaccacgagagcaccgttgccgtgaaggccatcgggaaactaaacttgatatgatcaccagcatcatacattcccttggaaagatccagccccgctggtttcccatcatccagcgccgagtcccccctccacgggatctggttgttctccagcttccccgctgcacaataccaacagaaattaccaacaatttagcaaataagtacttctttagagctactgaagctgaaaagggttagagattgtgctcattcagcctccaaaacactgcatcggtggctggaacaaccaaaactccaatatccatagctaaataagctaaattcacagtttggttaacagatttaagtgaaatctgcgagcacacatttgccaacgacatagtaatcaccacagaaaggaactgctcttgcagaagagcgtaaaattcacactaaaaaaaagtcaaaactataaggtcacggccactgaaatcggtgagaaatctaccgactcgtcaactttcctactgagtaacgattggtgaaattcttcaccacccagaagcagaaaccatcagatcacccgaaacaaccgtatcaacctctccaactaccaccccaaatgcggagatactaaacgaacacacacacacacacacacaagagcttccaagctgggcgccaagaaagaaaagggcattcgccgcgaaatccgccgaattgcggaagaagcattgcggtggcgaggtggtgagcagcagcgaaccagtgcgtgcggcgggggcaagaagaagaagtggagcgagtggtggtggtggtggcggtggcaactcacccttctggacctggaagaactggagcgccaccccgagcgcgtcgccgtacttggagtcgatggccccgggcgggccgggcaccggcagcggcttgagcttgcgcccgctccccccgccgaccttcttcttcatgatggccaccaccgccgccgtcgccaccagcgacgccaccagcgccacgatcagccacccgcagcaccccttcgtcttggaccccatcgcattcgcctcctgcaacccaccggagacgacgacgcctccgcggcgctgctcggctcggcgtctcgctcgctcgccgcctcctcttctactgcaggggatgggctcgcgtgggctttcggctgggttggtggtggtggcgctcgtcgcgtactcgcgtgtggtgcggccgcgggggggttggtgcacggtcggggtaggggtgaggtggaagtctgggagtcgctgtcgggtggggccgaggcgtggtgggccacggatggcagtgagaggggaggactcagcgcgtgggggtgtgtgggtgaggtgaggagtcgagagcaccgacaggacaggagatggacgggccgacgcgcgctggatggatggacggatcgtttgtgagggtgtgtgtccgacctgtatttaggtgtgctgcaccttaacgtacgtacacgagtggttgtgcaccttactgggatagggtatatttccgtatattttgttttgctagtgtctactggcaagagatcatctaaacatttcacgtcaaattggcaattctgtggaaggtgagattatatttttcggtacgacaactagctggcatttcatgacagaatgttcgtgcaattctatggttgtgtttagttcagcgcaaagtttagattttgattgaaattagagatgatgtgactgaaaagttttgtgtgtatgacaggttaatgtgatggaaaagaactgaggtttgaattcaaacttttgatctaaacacagcctatgttcattttgtggcaatggattggcaatgaattatgggcatgatcccgatccctaaactcttaaacggtacaatattataataaaagcttctatatgtgaatttcttatataagtattttatttttttcctattttacaaatacttaattcgtcatttgtatactcgtataattatcatttcatgccctagtcgccaagagtatgaggagtcgaagaatttaactctttatttgacaaattttgtttaatgtaatatctagagtacacacgtctgatagttgtgacgacgttgcttaatggcgtgaccactgagtacgataaattggtacacctggtggtgtaatcatacacgcatgggccgtccaacccaaatattgcatgctaagcaatgaactggcgataatgattgattaaaacgcagctggtgactacccaaaggaatttctggagttagaattatttgcgcaattggtgtggataacgatgtgcatgcgatttttgggtaagaccagagacgatcccaaagaatttggggatctccaggtgtcccgcagtcggaatcttttgatgacggagagctcggcccctttttaaagcgttgatataaagcatcatataacgttttactcaagcggatgccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacaccttagcgtaagcatcatattgacggtcatctcgaccagaatactggtgatgagttagttagtgagtagtgacagcagttgagcacagctcacaccaggagctttgcaaaccatgattagtccatggcccatttgcctttgtaacaaatctggggactttgctcattatcttggcacggttctgaaactgataatagataatctggatccatacacaattatagtacatgcaaccaccgtatctgcttcttgttggcactgacgctggcgacaagaccatgagcaccgtcttatgatgcaatattgccgtgcccatttcccctgcacagtgcaaaacaatcattgcaatagcaatacaacttgaacagaaacagactgggatgtagtattcgttgttcttgatgacgcagataaaagggatcaataggacagtgataactgaccttgtggctgttgcacgcagagtgatgctagataaagaagaccaaaccaacaatgttgataaatgcattccgtattaacaagaaggatagcatgtcaagcttggatccagggcattatgattaatccgtacacatttatgcatcagttgctcaaatgctcagccacaatctgcaaccagaaaaccataacccagctaagaactactagtacatgaataacaatgtgagaaaataatccaaatattaacagtcggcattcaattgagaagtaggaaaataggaatattagcatgtgacatcgtatggttgatctgtagtaaaacagttcatccgatggtcaggtcgaaaggaagggtgttttagcatattactatacaaagtgtaattaaactaaaatgcatgatgtaaaatagaagctgaaagggtcagaactgcataagcacccccgataaaagcatcacctagaaatgatatcctattactggaccaattgatctgcaaaaaaataacttttacatatccacagttgtttgatctccaaaatcctgcaataaaaaacatttcagtttagatacagtacaacagagagatagatgagcacaaatatagggatatccaatcgaatggcttattttcattgagtgtgtatattataaccttctggagtcatcaacatcagagtaatagtgtgcaatgcagtaaaataacagctgcaatgtaaataaaagaaaatgttgcgccaacacattttttagggctctgcacaatgcgttaaaatgtctgtaagg
